United States Patent 10,407,724 (METHODS AND COMPOSITIONS FOR SCREENING AND TREATING DEVELOPMENTAL DISORDERS) - sequence listing, part 28

SEQ ID NO: 624 - DNA, 1261616 bp, Homo sapiens
agaaagacatgctaattaacagaattattaaacccattgtgatacaccattcactcaccatgtgactgcttacaaagagggaaaaaatatggagccctctgttccaagggaacactcctttccccctcccgacacttcctagagatcttagacccacatgactgtgagaaagaagagtgatgtgagagtgaactttggcaaggctgaagtgccctggttttgtctggagcgagaataaaagtgagaggaaggaggcgtccagttggctgagaatactgttggctaagattctttagcagggtgggcttttcggatgcttttctcctctgatctatttaggtttatccttactcttttccatttatctgggaagtgacttgggtttaagagaaccaggagtatcttagcagagtcaaaagggccacggtgaaccccaaatgtcaggaaacaaggaactgactagattactcaaggcttcactcttgaggagggagagaaaagagctcctgcatttccttctatttattgattacagccacaaatggaaaaggaagcaggctttctgccctgaaataatgatgatacatcgggctgcagagctcctatacctataactctcaaaagcaaatggaaaggagactagcgtgtggctagtaccattattctcacatcttcctgcagtgttatgagagcacagagtaggatgcagggtgaggatagacagcagtagagctttcttgagctgcttattcctctccaaattctctctgaaagtggatgaagaactgctgccatgtctggtgtgggttcaatttgtgctctcattgcttctacttctctgtttctccagatcctaccatcacgttcttccttctgtggcttagccatttttctctccacgcttaggaaccatacatactatcattcttctacctctgaagcattatcccatccttctgacaaacatgagtagatgttttcccctcacagtcttgccaaaaagcacttataaagtattgcaccgtagttttcatatttcaaaaacacttcaacaggcaaaatgcgatatacacaaccccaaaatgctgtgctatgatgaatttagttctgtattggtaatactataaattgcttttgaatgaaagatacaatgtctatatattatttaatttgatacttgcagtaactagctatttaagcaagataggtatcagtcctctttagcgaagttcagtggaaccaatggaacaaacgtgtgggagtggaactggaactcggatgtctgattttgtcttaagttattttaatgacaagtcatttagccaccgataaaaagttacttattcagaaaattcaatcttctggacaagttttatttttacatgacataacctaaaatgttatatatgttaaattctgccgttttagatttcaggaaaacaaatgcagagtggtagaggctggtggtgagaatgagctgagaagggtggtaataaactgaggtttctacaacgagtttgcattaaaaaaaacttgttgggggttctggaacccaatcaattctcagatgtttccatagtctatttttatatagcataatacatttttattatgatcaggcaataaagcaagactgttcaccagtcttgctttagccatttaccatttcctatactctatgtatgtcctttgtctgcttttacactaccataaagcctgcttcaactttcccctcaatacactgagatttatttcttcactcaccattctggaaaattccttgttcagccttctaatcactagacacctgcaacctttccttcactggatttctgcctcgaacagtcactcttctccactaagatctacatgtcaccgctaaaatcccctttcttgcttgtcactttgaccatgatgtcacttacttcctgaaaatttcccctggctccctactgctttgcaggccaagtaactgtcacatttcgtttccactttcagctggagtcagccttcattattcccctctccgtccctgtatccttagagaccctctcctttgactcaacagctcactgctcttgtcttctcaaagctcctgtcttttcacacacagttcctgctgtcttttcttcttaaaacaaccagccattcgacagtctccaattctctgagaagacattcccctaaactcaccatcttcaatacttgtgtcatatctttgtgccaaattctaattcacttaagattttaactggcttactaacaaaatatactaacttaaaatgaaggttttatttattaccttaaatgaaacaccagtgtcaacggcaaacaatgaaaagtaagagcaaacgttactatgatgaaagcaacttgaagtcattgcattttaggtagatatttgtgcctgccccagactctgggcttgaaccctgctctgtcttataaaatagggagattagaaaagttaaattgttattaatgttctattaacacctacttgagactttcaactttttatagtaagaagaattgaaaaataattcacagagaattgattcccatgatgcgttcacctatgtcctgctcagaacacatctaggatcatttcagcgctgatagactgttcaaggagatgcagcctaactcaagaaaaattcatcatgctcctcctctttccttctccagttttgttcccacatatgaacattaaatgaaaatttatgaagttcctgctgagtgaaaatcactgctggataggtgaattccaagatgaaatagatagactttctggcctgaagttgcttactgttaccactgaatatatgcccataaaatattaaaatagacctaaatgccttttctgaggtctggaactctcaaagtgttgtgagcctccaatctaattaaagaactcactcaagtataatgcaaaatagaggatgaaaaatgccatacgaatgtatagataatgttttatgggagattagaatagagaaagattatttccagcttgtgcactgttaaaagtcattaggaaagaggtagaatttggaaagcaaagaagagattgcattgcaaagaagacattcaattgcaatgattatttctctgaagcaaaataagtgttcaagcccaatttaatgagcaattaatttttagcaatattttccacatgttcataatctagtaccatttgaaaaaactttctgatgtgaaaaaaatgtgatttaaatacctgtctcaagttctgaaaggcttcctcacatattataaaacaggagccctccctaatttgagtcaggttagagaaagccaaacataggtggaatatggatacctttactacaactacatttggggagtcaacctaatgcttgcttaatcgcttcacagaaagattgaggaaggcagtgatatccagtatcatcatagggctctttggtgccaataatctattgaggtgcttttcgattgtgagacgaccaagaaattagctgatcccagcagaaaaacagagctccttccttacttttcagctgcgttaatttcttctctacgtttcagagtactgctaattccatccactgatcccttctagggcctggttttcagtcctaggcactcaggtaaggctattctctagacacaatatgcatgtgaaacaaaaaaagagaaaagtaataatgacttcaaatattaggatctgactatgaaatatcagatcttttaactcttgtattcatgtaaccttcctacatttttcaagtgaaaatatttcctacattttttaagagacatcagtgttacgtgctacgttatcaatattattttcttattggccatggaaatgcttaaataattgacttgacttgttaaatctattttatacattgcattttaattacatttataattttaagaaacttcactttttagaaagatatagacatgaatacccttggtattaattagtagtagatgtccttacttctgatagcccttacataatgtatccctctctatgagtgctgtagatttttcacttatatctacaaatacagaagatataacttattaaaagttcaataggaataagtcctcatgttatgagagagtataaagcaatagttagagtgatgtgaaatattataactctgtcttctggaattattccttgaaaagattaattatgtatgcctaatgagataacagtgacaaggtataatttagagattataaagctgagaattgaaatgcctagcatgtgcacgtgcacacacacacacacacacacacacacgtaactgctcttttgcaaatcttcatcacatcaattgtgttgaatccattctcttaggctatacattctcatgctagcaaaatgaaaacttgaaagtaatatgttgaagagatactatgttgaagagattcccatgttgattgcagcattatttacaatagccaagatatagaatcaacctaagtgtccatcaacagatgaataaagaaaatgtggtgtatatatacacaattgaatagtactcagccataataagaatgaaatcctgtcattgtggtaacatggatgaatctagaggacaatatgctaagtgaaataagcaaggcacagaaagactaatatcccacgttctcactcatttgtggagtctgaaaaagctgatgtcacaaaagtacagagttattagtgactccggaatgtatcaaggaggggaggataggaagagattggtcaatgacataaaattacaattagacaggagaaataagttctggtgttctatagcatagttgggtgactatagtaaacagtattatagtttgtatttccaaataactagaagagaggatcctgagttctcaccacaaagaaataatgtttcaggagacggatatgcgaaagccaatgtacacatgtatccaatcattatgatgtactccatagatgtgtgtacttattgtgtatcaattaaaaacacaattcaaaaattgtcatgggtttgctctttttttttgcattacaaagtgacatctatttcttgactacatgctaggtgattaattataaaatggctctgtgcattgaagcatctctttcaagagctttacaacctgacttttgggaaagatacattgtatcttttgaatgattcaatagtgaaatttatttctgagtttaccattttgtgatttctgaattttttcactttcagcatttccactagtgttttatttactggttccacaaatcagtcagtttcatcaaatttgccaactgcaagcctaaaccattggaaattggcataatgaatgttctgagtgagaatatatatgttattaggaatattttaaatataagaaaatgtgatacaaacctggctgccaaaatatggcaaaaatgtaaacaaaaattgatgtgtaaaaaataccactgtatttaaaagggataaaactaatcagatagtattttaaagctgatgtcttgatggcacaattttaaattgaagtgctatgggggatattgtcttactggtatttgcagtttgggctcaaaaaaccagaaactatatctttaagggtgtttaacagaataattctaaatattatagttttctctttcctttttgttgtcctgtgattttaactttgacattcttatgtgacaattgaaaaagtctcttcacttttgtgtattctttctaatgtgatcaggagaattaaaatgaacattttctttcataaagctgagagttaattctgaaacgttgtaccagaatacttttatgaatgaaagactagcctttgaaccctaggagagtcaactctacaccaaccctgtctattaaaaaaagtctgtgcttacagatgtcttgtgtgagatgtggctttaccaaaagtatctgaacttcaaatttctcctatcactgccaactacccatgggtattggcaatatatttggtagacttatttcttctgtaggcatatgatgccatggccaaagtgaactctacatttttaagagaggctgctaaatatggccaatcacaacagaaaactagcatttctccaatttggcagtggtttctggatggcacacccagacttacttccttaagcaatgctgatatatggaaatgccatgatagaggctcagaagctaacactgaattcagcagtgcagaaaaactccaaatcatgtggttcttctttgtcaatattttcactaaggcagcataagatattaaatcacctggaattagttatgtgccatttcagcaaccttttgtgctcagtctgctacaagctgcttgtgctgattagcagtttaaaagtctgcaggggaaggaaattttcagtagcttgattttcccccaccctttggtcctgtgtgcattggggaagaaattaccttctgtgcaattcctgaataatttggtttgattattaatagattcatgctgaaaaaagaacaataacagaaaaaaaattacccatggggttgcagctgtgctcccagatacaaaacagggaaagaaaacaggtctctccaagcaaagggtatatgtgtatacgtgtgtgtgcatgtgtagctctgattctaagaagccattggttcatttattcatgcatcaaatatttattgagctgcgaacaaatcccaggcactgtgaggaagacagatttcctgccctcccagagttgccattactaagaatgttagccaataaataaatctttacgggaaagaaacaaaggactgtgatagaaaaaaatgggaggagaaacttactttagaaaggattatctgagaaggtgcctttcacgctgagccagaaagggaagaaggcaaacaggaaaagagccagaagagcagagttcccagcagaggggaagcaagtggagaggcggtgtggaggaatcaatttggccccatctggaatggacagaaggctagaacctgcagtgcagtgagtgtgggagaaaccagctggcacaaggtgagcttagggcagatcacataaggccttgtaggtcatggacaacaatatggatttaagtgcagtataggaacttcaaaggaattccaacagttaagctagttgatgtaatttgtgtctatatgtatatatatttatatatacaaacaaaacaaaccttggctgttgcatgcagagtagattgcaatggagaggaggaccagttggtattccgcaagggagataagaacagcttaggcttgaatgaggatgtgataaaggggattttatgagcaaggctgttttattattttatttattgtacttctattaagatgatatgggtgctttgggggctgttgtaaattataacccacagcccctgcacaggaaacctccacaggaaacaatcaaagaataagtggttgtgagatgacaaggtttacgatacgtgttttcaggcttcttaatagcagagtgattgggtgatttccaaaagacctcagggctgggatgggtgaaattttgtgagcttctggattggatgagggtgtgctcttgcagaaagaattcctgaatactttctgcactgacagaacctgcttattaattcttacagcagttatgttttagaagatgaaagaccctttccattcaattattgatcataagcatgatgtgtgttgattaaaatggcatgataatggtatcaaatggagtttggatatctttttccttaatatacttttgtgtatcatatttaagtttcctcaagtcagtagagaagatgttacccacatcctcttttccaaagaaggaatcatttgatcattgaaaggtttactgaatagaaaataaattatgttgactttagcacaaattcctgccctaagttttagcccatatattgatgatgtcaagtgctgctaaatgtgttcttcttctataaaaattaaagtttaagctttggatgctaactttcaaatctatgtgaaatgatatgatttattgtgatataaagaatgacataaagaacaaaataatacttttttaaatttatgaggaaaaagacaacagaaaggaaaaatgggcaaagaaagagaacacgtttcatgcaaatcaaaaccacaatgagataccatttcgcaccggtcagaatggttataattgaaaagtcaaaaagtaggccgggcgcactggctcacacctgtaatcccagcactttgggaggccaagacgggcggatcacgaggtcaggagatcgagaccgtcctggctaacacggtgaaaccccgtcagtaaataaaaaatacaaaaaaattagctgggcatggtggcgggcacctgtagtcccagctactccagaggctgaggcaggagaatggcatgaacccgggaggtggagcttgcagtgagccgagatcatgccactgcactccagcctgggcgacagagtgagactctgtcaaaaaaaaaaaggtcaaaaaataaaagatgcaggtgaggttgtgtggagaaaaaggaagagaaagtacactgttagcgggggtgtaaattaggtcaaccgttgtagaagacagtgtggtgactcctcaaagacctgaagacagaaataccattcaatcctgcaatcccattactatatatattcccaaaggaatataaatttttacattatgttaaaaagacacattcatatgtatgttcattgcagcactattcacaatagcaaagacataaaatcaacctaaatgcccatcaatgacatcaataacagactggataaaggaaatgtagtacatatgcaccatggactattatgcagccattaaaaaagaatgagatcatgtcctttgcatggacatggatggagctggaggctattatccttagcaaactaatgcaggacctaatgcaggaaaaccaaatactgcatgttctcacttataagtggaagctaagtgatgagaaaacatgaacacttagaggagaacaacacacactggggcctacttgaaggtggagggtgggaggagggagaggatcagaaaaattaactaatgggaactaggcttaatgaaatagtctgtacaacaaacccacatgacacaggtttacctgtgtaacaaactggcacatgtacccctgaacttaaaatgaaagttttttaaaaaagagaacacatttcagaaaaaaactcaaatggccaaaatacatactaagatagacaacctcatgaatagtcaggggaatgcacattgaaatcacagtgaaacaattgttcatctacatcattgaataatacttagtatctaaaagggatggactactgatatatgcaacaaaataaatgactcttaaaagcattatgctaggtgaaagaaagttacatactgtgggatttcatttatacgatattttggaaaaggtgaaattgaagggatagcaatagaatcattgtttttaaagactggggagggtggttgacgactgacatgatgggaatactgtgtgctgattgtggtggtattaataccccatctacctttgtcaatattcattgaattgtacctttacaaatttggttattgtgatgtatgtaaattaaaccttcaatgatctgattttaaacattacagtgaagtcaggagtggtggtatgcacctgtagttccagctactcaggaggctgaggtggaaggatctcttgagcctggaaattcgaggctgtagcatgggtgtccaaccttttgactaccctgggccacattggaagaagaagaattgtcttgagccacacataaaatacactaacactaacgatagctgatgagttgttttttttttaaaaaaaggtccatgcataatttttgtgatatctgtcatgccaccacagatatcaaagaagtcctcacattcaaaggattttacacctatgcatgtagaatgctataattgcacctgtgagtagccactgcactccagcttgggcaacatagtgagatcccatcacaaaaaagactcacaatgagaaaatgttatcatttattagactacaacaatgaaaatatgtagtacagaatcttgtgaaggtgttaggaaatgagaacgctcatgctctgttggtgtgagtggacagtggcataacctccttttagaggaggaatttcacatcagctagtaaagttgaacatgttttaacccacaccttcgaaagtctgataaacatttacaatcaattgtctctgaagcctactacctggaggcctcatctggatagaaccttggtctccacaaccatccttatcttaaccaagacactcccttctatcgattccaggtctttagataaactccttggactagttgccaattagaaaatctttgaatccacctatgacctgaaatcccacactcacccactttgagttgtctcacctttccagaatgaaccaatgtacatgtttcatgcatttattgatgtcttatttctccttaaaatggataaaaccaagctgtagcccgaccaccttgggcacgtgttctcaggatctcctgaagctgtgtcatgggccatggtcactcgtgtggctcggaataaatctcatcaaatattttacagaatttgactcttttcattgacactaatcatcattgtaaaattaagactatagtaatcagtgcattttgagccctcagttgttcaagtactatcacagaagatcgatatcaacttttgtttcagctccagattaaaaggtgagcctattagagtgtttatgtgtagcagaccctacacttattcaaagaatcatttgcttagatctaagagaaatctcatcccttttacttttaatatcatggtccttgtgaaagaccagacaaaaagtcaacccagttagttccttaaaagaggaaaagtagagggaattcgcatgagcaacacctcagtacttaacagtcattcaaggacttatgcatcaacagtacttggcatttcatgtaatccttccaatgttcttatcagttctgtgtgttcttaccattgaaatatagatgtgcacaccattgaaaagtttaaatcattaatttagtattaagttaacaagaacatagatgctacacctaaacttatccaagatattaatccattgtgccttagtactttattgactcaatttataaaaatattgtatgtgttcagtaaaaatataactacatttaagacataagtttgattttatgacttaggtttctgtaagaagcagcatacttttaactcaggcttatgaatataatatcacttcatctccttacaaagtaattagaataaaggcagcatatattttgtatgaactaaaaagaagtacaaaatattggtccccaaaattaaaatgtaagttcttaactacacatttctatgctatattacttgtattagtttcccattatggtaataaccaagttcctcaaatttagtggcttaaaccaacatacctttttctgttagagatctgaagtttagaagtcctaaaatcaaggtggcagcagggctgtacctttctagaagctctaggggagaatctgtttacttgccttttttttagcttctagaggccacttgcactctagctcacggtcctgttggagctcaggggaagctgccctcttgcccttggatggtttgctgaaaaatgaagccacaataaggcatgttaataagaagaaagcataaaatttatttacccatatgcatgtggagaatcacagagtgattacctaattacccaatcaaacccaaacacttatataacctcctttcagaagagcgggggtagatgggaaatataggtaattcctttgacggacattacatgattactagggaaaagtaaatggatccttgggaaaacgaatagatggacttgtaaatgatttggaagttgaatgaacttcagagacaggcactattttgtagaaaggctgtgccagttctgaatacattctttcactcctgtcttgaaatagataatgagataacagggaagggaaggaaaaacaattttttttttggtggatccatcctatttttatgaagatggggaaaagtctcttctaacgcatattgatttctaagggattttaattcaaagtattcattacttccagggaatcatattttggggtgaaattctctgtgtttttttagtgccatccttcatttttatagccagcagtatagcatcttccaattttcctttctttctgggctctgtcctcaaaacatcttttcagattctgaccctccagcttctcttgtgtaaagacacttgttatacattggcccacccacataatccaggacaatatctccctctcaaaatcctgaatcaccttacatttgcaaagtcctatttccaatgtaaggtaatattctcaggtcctagcaactaggacacgaacatctttggggttattattttaatcagttgctccaccctttaaactcttttctggttgatatatccataaaattaagtgacattcgggtgaagtgtcatcacccatcactatccctatctgatataaaacaatgatacttaagtgaagtgttataggaatacaaatttgcactatgaagttaatattagaagataaacatcctctaaatattatcttatggaggtaagatgacttttgtgtgaggactataccatcttttattcttggagtaatttactattcagaatgtggtcagttttggcacgttgtcagaactgcaactgtgtaaggaataaagaataagacctatctcagaaggttgttgcaattattaaataaattattattttggcatatagacttgctatgtatttactgcagttgttaatattagatccatgtgaactatcaaaaattgtattataattgtccaacaggttcttcttgcccactgcatggatagggcaaattcactgagacagcggtattacagtagagaaagagtttaataattgcaggcccagtgaagcagaaggactggatttattattactcagatcagcatctctgaaagctcagaggctaaggtttttccaggatagtttggtaggcagggggctagggaatgggaaatgctgataggttggggcagggatgaaatcataggggtcaaagctgtcttcttacatgaagtcacttcttgggtgggagctccaggactggttgaattagttccttggtatgagtcacagatcctggtggagtcagctggcctgcccaaatgcaagagtctgaaaaatacctcaaagactaatcttaggttttcacaataatgatgttacctataggagcaattgggaaggttacaaatcttgtaacctctggcacaatggctggttattgtttaactgtacctacatcctaatagagttcaggcccctcccataatcctagtcttgtggccttttattacttttacaaaggtggttttggtccctgaacaaggagggagtagtttggggaagggctatttttatccttgttttaaagttaaactataaactaaatttctcccaaagatagcttggcctatgtcgaggaatgaccaaggacagcttggagttgagaagcaagatggagtcagctatgtcagatttctctttgatatagtttgaatatatatctccgccaaatctaatgttgaaatgtaatccccagtgttcgagattaggcctggtaggagaggtgtttgggtcatgggaacagatcccgtatggcctggtgctgtcctcgtgatatagagtgagtactcatgagatctggttgtttaaaagtaggtggctcctccccaactaagtctctctctagcttctccttccaccatatggtgtgcctgctccaactttgccttctaccacgagtaaaaactccctaatgctcacccagaagccaagcagatgccagtgccatgcttgtacagcttgaagaagcatgagccagtgaaaactcttttctttacaaattacccggtctcaggtatttctttatagcaatgcaagaatggcctaatacatttattgtcataattttgcaaacgtagcttccctgttggctacatcaaattgagggtttgctaggatagaaaagtggaaaatatcaattaaacaactcagagccgggtgcagtggctcacgcctgtaatcccagctactcaggaggctgaggcgtgcagatcacctaaggtcgagagttcaagaccagcctggccaacatggtgacaccccatctctactaaaaacagaaaaattagccaggtgtggtggctcacgcctgtaatcccagctactcaggaggccgggcgggagaacacttgaactcaggaggcagaggctgcagtaagccaagatctcgccactgcactccagcctgagtgacagagtgagactctatctcaaaaagaactcaaaaagattgtgttaggtacttacagactagaagattatgttaatgaatcttttattcattcaacatataattattgcccactgagtatgtaacacgttttctgttatgtttagaaataattatgagcaactcagaatgatctccaccctcagagagtgtacagtctacctcagtatgtagatgattaatagacaaacaataagtgttgaatgttgcacaaactgtcctttatttgatccttagagttatatagcatatttaaacattttgaagtttgaaaatgcatacaaattagagagacatccaataaggtaggacttgggttaatgtttactttcctcaagcacgagaatagtatgtgagaattaagaattaattgttaaaacacatctttatatttctttatgagacaactcttgaagcaaaagtgaaagctggctcaaacacagttcaattacacagacgtatacacacacttatagtcacacacacacacaaaaccaccactgtccaggaactaaacaataattgtactcttctagatatgtaaaatcaagcgaggaacagttaagaataggttatggccaagcgtggtggctcacgcctgtaatcccagcactttgggaggctgaggtgggcagatcacgaggtcaggagattgaggccatcctggctaactctgtgaaaacccgtctctactaaaaattcaaaaaattagccaggtgtggtggcaggcacctgtagtcccagctactcggggggctgaggcaggagaatcacttgaacctgggaggcggagcttgcagtgagccgagatagcaccagtgcacttcagcccgggagacagaatgagactctgtctaaaaaaaagagacacgttaatcttaactttttttgagagagtctcgttccgtcgcccaggagagagtgcggaggcacgatctcagctcactgcaacctccaccgtcaggttcaagtgattctcgtgcctcagcctcctgagtagctgggactacaggcatgcaccactatgcccagctaattttttatatttttagtagagacggggttttaccatgttggccacgctaatgttgagctcctggtgtcatgtgatccgcctgcttcggcctcccaaagtgcggatcccaaagtaggattacaggcatgagccaccatgccaggctgaaaattctgtattctattatatattatataatagaatattttatatatatatacttatatattatataatatataattatacacacatatatattttttaattttattattattattattttttctgagacggagttttgctctgtcgcccaggctggggtgcaatggcgtgatctggggtcactgcatcaccgcaacctccaactcccggattcaatcgattctcctgcttcagcctcccgagtggctgggattacaagcgcacaccacgcccagctaattcttgtatttttagtagagacagggtttcaccatgttggccagactgttcttgaactcctgacctcagcagatccacctgccttgacctcccaaagtgctgagattacaggcgtaagccaccgcgcccgacctgtagtacctatattttttatttttctccaatcttttaatcttttaatcattctccaaaatgttgcctttcttctcaatgcttagcagacaatttgataaacaaggatccttttctaagtagacttcatataggagagttttcaaaacagaataagaagggcatattattccttgtcaaaatattttcttgttgaaaatggaaagtttttgctaaaagctgaaatgcatggcagattaatttatgcctattacttcaggtaaataatttcaccaggagtcttcataggtaaaatgaatgtttatgcttgataaaaaagtagcagttgttgatttcaacaggtttaagaagcgtaaatgttgtccacctcttctttccatcccatgcacatcttacttttactctagtaactaccacccatgaatgtccatctattaaacccaagcagagagtagtttttaaaatattcctttcctgttttctgttgaactattttatagacaagctatataaaaaagaaacacaaggaacaaaaaatgatatcttattctagtgaaggaaatccaaagttggggtctagaatacaaatacacctgtgtgcaagctccagtgatgccagttcctagtactggagagcattgtgactctgagcaaaagagggaagacaaacatatgaacagaaaacctcgtcttttctcaaacatcctcaatgactgttacatgaaaatgaggactatcaggctcatatcattttcaaagacaataggtgatatgcatgtggagaacaaatacaaaaggcatgcatagaaatcaaaagtgattaaaaatagtctgaattctggagacaatagcatgtgtggacggacagatgctacagatttaatgctgacatatcagagatgaaatgtcagctttctttattaccagtagctctcagcttttcaggcaaatcgttctttgtactctacgttctttctccttatggagttccttcttgatgcctcttcctacttcttcacatctttctactccttgagatacctgcactcattgcttgcacttctgttagtgattttgttacagtattgtgctgtgtgtttccaggagtggagccaaagtgaaggaagcccagaaatgcctgtcaagggagactatgagatgataacagcactcgtctttttccttgtgcttcttgcagttaacacccacatctatctatccatctatttgtgtatctctgtgtctgtctgtctgactatcgatctatccatcacccattcatctactcatttattttggcatacagcttttcgatagaggcaaacactgcctaatggaattgatctacaacaagaccatagctggagtgaaagaaccaggactcagaagttaaaaccaaagttaatgttattggaatgtatagtcttaaaaacaatatgttttttaaggacaattttaattcaattaagtgtgcaatgaaaacacaggggaatgtttgaagaatcttttatcttttacccaggtgatgtgcttttcgacaggattacatttagtctaagaggtagaaaaacgtcaccaacgacaccttaaaggcttaccccaaccaccagaaaaatatttgtactatttccttcttaaactttgcacaactttttatgtagatattaagtgttcaaggggatccctgcacatggatgaagtcatgtttgcatacactcagtgtaaatatgtgtacacacacacacacacacacacacagcaggggaaatatttctcaaatgactacacttaggttactttccatctctatttattttcttctgtggaataatgcagactagaactaacataaattgaatgctcatgagaccacacatcttcacatggtatagagtgtgttatcgcagcaattttataatggctcattaacccctgtgagaggccagtaatatgggatagcaacggatttctatcaactccatgagggagataagtaaggtggcatcttatgtagatttctaaatcctctactttgaaatcagctcaatggcatattttaaactcaaaatagaatgtcttctggttcctaatggttgatttaatggtggatttgaccatatgtgtatcagatgtaaaaagtattgtccactaagtggagtaaaaaatgatcttttacagaaggaaaaaaaaactgatttaaatctttagattctcatgggatctcattaaggttctctttctttaatacattgtgcagcctaatagttatcagcagccctgcggtgtgcattgctgataggttagtttacacaggattaattgtgtaattttgcaagcaaccagcacagtgaacactgatttttgcattagccccatgtgttgtttccaaggggactctgctttctattttaaggtggtgttacatttcacttcttattaattataatttctgctagcatgttttatgcccaatatgatttattaaaaatccttcataatgtttttttcctaattgttatgtccttcggtaacttcattaattttgagcactgatgtgtaaaaaatggcaggagaaaatggcattcacagaaggttctctgaccagccagtttccccatgcccccgttgataagttgccacaaatcttttgctaaaatacagacacaaattcagttgcagccactccaggtatgcgaagtgaataatcagtgcaggcaacaacctgacaatactacattcctcaaaccaaaagaatgcgaatgttcaaagaagtgttggctaagcagaactcagtccattttccacaatacgtagcttagtattttccagaaatacttgtgtattcggaagaattagaggaaggaaacttttgtttgaattttccacataatagcttagttcaatactcagctactacattttatcgactcttggtgggattatgaaatgcctattgaggtttcagtggaatctttatagctggacttgatattcttttacatggttttgaaaaaacaaaacaaaacaaaatgttgactgtgcacagtttagaacttaatctttaaattctttttgccttgaacttgaaaatcaattatctgtctgtgccccaccacctcttccctcatctcagccttcacgagataaaatttctctccctccggagcacatggtctctcaaaggggaagagtcacatctccttgtctgtgcagctgttgcttcgttttgtttagggtggatcttctctccttatccccgtgagtttctatagtattataaaggcccaataaggttctgtacaaagtgggtacttaaaatgtgtcctgagtgacaaactggcccccactggaagaactctttaaaacactctgttaccagagcttcaaaaagggcttgtttctgaaggatcaaaggatctcttgtataataaattctgagcattcagtacataatgaagagaagaaaacatgtcttttaagctcctatatgatgcctggattatgtgaagagatgaaggaagtggtgactctttctggcttttgtgtcattcacattaaacaggaatagatgaaagcaaaggcttaacactgacaaaatcccaagtaggcaggctctgcatccacagcctgttcacacattcataacaaaccaccagctgatgacttgaaaaaaatatgattttctttctagtgaaagactgactttgttttgtgttttgtgccttttttaaacatctaccttcagaaagtataaaccttttttttttttgacagagtgattgggttacaatattgttacagaaggactagaattagaatcacaatacttgggtgccacacttgacctttgtcacttgttatgtatgacactaaggaagtaatttagtctgtaaattaattttatttttcatcatttataaataaacctagtaaaatgaacatgaatagttgtttcaagggtttaatttaaaaatcatttttgtattgtggtaaaatgtagactcttatattcttataggcagattgcaataaaactctactaagcaattacactagattttatttctctaaattaaggctgaacaatctcttttttcagttccactttgtctgagtagtttgaatggcccagatcagagatgatttttgagactgttgttattgtgtttgatagattgtgctcatgaaggcacgtgcatatttatggagaaagaatccttagctttccccagatgctcacatgtgtttgtgatcctaatggggttaagaacccttaacctgataatctcaaccaattttcctttcacattaagtgggagtcctactattttagtattaagtaccagaagggtgaattttatatgttactttatatttactatcggttttgtctaacaggaattttgtgcagtaaaatatctacctttcaaattccctgggaggagaaagacaatgcatactggagatatgaacacttttccacaatacttataaaaaataaaaataattaccttggtgatttcccataattaaggcagatttttttccttcctccttcctctcctctcttttttacgttaacaccaccaccctcatcattaccactgccacttttctctcttccccttgaacagagtagataattgcatatgtacaatttcctagagaactgaagcaggcttagcccatagttgaactaagtttcaaagtttgcaaagtaagactggattaactatattttctgctaagtgttggttttaataaaaaaagaagtttatattcattgaaattttcagttgggagtacatgttttaaaaccttatttcttccttttttttttttttttttttgagatggagtctcattctgtcacccaggctggagtgcagtggcacaatcctggtttattgcaacttctgcctcctggttcaagcaattctcctgcctcagcctcctgagtagctgggattacaggtgcctgccaccatgcctggctaatttttgtatttttagtagagacggggtttcaccatgttggctaggctggtctcaaactcctgacctctggtgatccaccctccttggcctctcaaagtgctgggattacaggcatgaactaccacacccagcctagaccttatttcttaatctctgaatgtgtttggtgtgacactcaactatactttcagcttacctagcccaatataaattttattttaatgaatggtttccaacattttgactctcctcatgttaaaaaatctctggatttccttatatttgatttctgtacttatcagtatttggcaggaagacaagtcatggcaacaactgatggctgacgagacgttatgcttggaattcgtatattcatctccttaactgagaaggttttggtgtctaccattactgacctcactgtgaggaggcaccggagaatcatgatctcattctgtgtattggcatgtcattacacattattaatttggtcttttgagtgacacaactgtttttgtatatcggtgtgtttgtgcactgtccctggagctctttgtactaagttatttttatttcattttcattaacaatattttgggaattgtcattgaatttgtaccttttctaccttgcactttacaataattagcatattattatagtaaattagaagtttaataattaaggtaacatttagatcctgtcaataactatagcctactttattttttgaacgttttactatgcccctttgtaacagttttaggttttttaaagagtcattagagtcacttatttatgctctgctgattagctatttattttcacagttttacaagttagatgttcgtacttagatattttttacagatcgaagtttctatttgctcatgagtagctataaaataataattatcattaggttagatattttctgtgttacagtttgccatttatatattctcattgccaccctgtgagtgaaatgaatcagaggttgttagctccagttaaaaaaaaaatgaagaaagagaccttcagagaggttggctaaatggcttgctagtaagtgcctgagatggtgctgttctgttcatttaactttacattttagtctagaattttctctgttactccacttccttttctactcaaagacctttttataaaagaaaccagggagcacttaaaatttgttctctaagtttagagctggactcaaaccattactggcaaaatcaatctggtcctttctttcctccttttttttttttctttctctcataatgaatcaagacatccagcatccttgaaaccttaaaggtatctgaggatacaaagataccaaactggagttatcttcctgacacataaatctgatcttgtcatttcttactacaaatccacgatggtcttttacaagataaagtttaattatctgagcatgacacctagggctcttcacattctgtgcgatccaacttttcagcctcgtctctttttattatctattgcttgcccttatacacctcatcttcagcctccaaaatttcatgtatcttcttgactgtgccctgctcttttaggtttctgagttgcctctcttgcttttctataccagcccccaaccccaacaggaatgccattctttcatttgtagcttgctaaactgggtcacttacctaaccaaataactatgtggctttggagaaaatactgtttttatttcttagcttgtttattttgatgtaaaaaaatgtaacgcatgatcattaaaaatatatctattacattaagtcatcttcaatttctgcttaccactttcttcccataaacaatggtagcaagttgatgtttttctttctaatgttatttctcatgtagacattgatacatagtatttttcataagagcaaaattaagctcacattctataaaaaattttgtagtgctttatttcacctaatattatacaaagtctcagcattcaatattctttaaaaacacaactttttaaaattataaacttttctaatacataactatattctacatatttaattatttctctattattgggcacttaggttgtcacccaaattttattgttataaattacactcagtaaagatttttccattggtagttggtgatatattaatatgtttaatccaaacttagttagatttctagatctgggcatactggccaaatgaacataaaaatctatgttagaatatttaaagaagtcaaaatgctcataatattatgtagagataaatagcatatcatttttacgtatgtaatgtattcatacacatatctgtatgtgtgtatatgagtgtagctatagcactgggtgaatattaatatatcaattgaggaaggaaatacactaaaatattattttacagatgatgtccattttattaggtatatgtgtgtgtgtgtatatatatatatatgtatatatgtatgtatgtatacatatatatttgtattttaccaaatatctagagtgagaatttgttacttttagaataaaacaaaactcccacaattatccaccttaaccaattgctgtctcctacaaatcctttccaaccagacttcatgggtagaaagcgagtttctgctggtgaaagggtgaaactacttgaaaattatttattgtctcccaaggttcactgcagcatgagacgttacgtagttatcaagactaaaatacaaagacagccctgaaaatagctggggagtgtgaaaattagtaatatttaaagtactgaaaattagtgatatttaaaggaaaacagaaagtttagctcttggtttgctttgggagaggacgggactctgaagcccccatgctggtgaggcacggatcttggagggtggtcagaggttgaaagccacttgagcaaatactcagtccaaagcagcaggtgcaatggctcaagcaggaaacagagtaatatcctgagattggctatgtttagacaagttcctattttggggacacagggctccccattcatgggtgtgccttgagtgcagtgccagacacagaatagtcaagtaatatgttcttggatgaataaacaaagaccctttgtacaatgctctgggacagaaatgcttcataatagtgatgttaacatcttttcacacctaaataagcctaaaagacttccaggcagttttcacatgtatttcagtgtgacttaatgatttataattctttttttattactattattattattattatttgtaattatactttaagttttagggtacatgtgcacattgtgcaggttagttacatatgtatacatgtgccatgctggtgcgctcacccactaactcgtcatctagcattaggtatatctcccaatgctatccctcccccctctttctaaacattattaaaaatatttgtgtcactaatcttgcggccataaagaacaagagtttgctttaaaggtgtactgatgctgcgataacacctatggcaatatttaaggttatcaaaattataaagctccatcctggagaaatggtcatgtgacattaggcaatatgtaacttcttcatgccttagtttggtcattgttaaatgaaggacattaaaaaaaaagcaaaaccgtatctacctcatgggttgtaaggataaaatgagttaataaaatgtaaagcacttaagagagtgcctggcctgtagttagccctgtataaatgtatcccattatcattaccaaagaagcttgacattggtattaacttgcccacaattaactggtgtgatcaggcattagttcaaggtggtatctgaggttactatcagatacattttggactatataggaaaacatagtgcttctctataaattgtttgcagaattactaccacaaattttaatggccttctacttccaggggaggccatctctatttgcattagaaagtaatataaagtcagaactgggtcctatttgagatctaaaagattatctatttgacttattcttaacttacaacattgacatttttgcttattgctttcaagactgtttcaaacatgatttctttcggtatactatctttgacagtagtgagaaaacaagagatgcctctgccgtcatactccaaggtgggaaacagaggactagcacctccagaagagggcctctggcttctgggaggtggggcttttaagtttcatgatttggtattggtgctgggatctgagttttcaggtttgactatgcaacatgcttgaaacatggcctcaaggattgtttggctgcctcagcattcatggtgggaagaccagcgtctgaatgataagagatttggaccttgtgtggcagcatttggtctcaggccctgctccgcctgcttgatattctactgtgatgaattggctatagctggtttcccaggagctttgtcatatccacattcgactgcagaaaaaaaacaggagttaactaactttcccaaagtgacacagctagtaagtggcagagcttattcattcactcaagaaaatatttagtgatgacctgttttgtgctacatgctggagctggatgaaaaccccaaagtgtctgagtgttactgatatcatcaatcagccccaggtccttctaggtcagccttctatagggaagggaagtgttcttgagaatgtgtcttggttctccatgatgttcttggacagtagcaatgaaatgcatatcctcatttctatgaataaactatgcctgcactggccaaaaatgtgtctctccgtttttggaagctatttatttctttaacatatatgatctattatagtaatataattctattgtgtacgatttgccctcaatttatttctggaggatttcctgtcttccaagttgtaacaggccaaggttgtagaaaacattatactgacattttctgtggcccttaacattttatttcagtctatctattctttgtattcatctttccacactaaagatttctaatgtttctaatcttcctctgtgtgaatcccatggccccagcctcttaaataatgtagtgcctttctctgtacctccttcagtcccattattagagagtttttaaaaaataatcatagacttttagggcaaaaaaaaaaaccttgtaaatagcattcagttgaaattctcatgtcgtggataaggattctgaggccccagttagttaggaaacacgtcattaatagggagtgttactgacatagcaaggaatcaaactcgttaggacctctgacttgccttggaatgttctttgctgatatctctctattacgctgttggcttctaatatggtttggctctgtgttctcacctaaatcttatctcaaattgtaatccccatgtgttgggggaaggacctggtgggaggtgattggattatgggggtggtttcccccatgctgttctcatgatagtgagtgaggtctcacaagatctgatggtttaaaagtgtgtggaagttccccactcactctgtctctctgctgccaccatgcaagatgtcccttgcttccccttcaccttctgccatgattgtaagtctcctgaggcttcccaagccatgcagaactgtgagtcaattaaacctcttttctttataaattacccagtctcaggaagttctttgtagcactgtgaaaacaggctaaaatacagcctcctttagacagttgaatatagcttaaaaatagtaaaagactgaggtataatcagtatggagtccttttctcaaagtattttagatgagtgatgcaataagaaagagggtctactgtagataaaggcacaggccttgaggttacacacattaggttcgtatcttggtgttgacatttattgtcattgtaactttgtaaatcatacctaacttaattgaattcgtttaatcttatgtaaaattaaagttagtggtacccacattaaaggtacttgtattacgtgagattatactaaattattaaatatgacatctgacatataatctgtcttcaactgatattagaaaaaaatcacatatgatgtttagtggagagtcaatatctgtgatttagtaaagaaatggtaaaactcgtgatcagaaataggggctatttctatttagaatgctctttcagaagtattcttagaaaaagttgaacatcttcacattgcctatataaggttttgctgataaataattcccaaaagccaacattaacaaagtatcgtattttttctagttcttactttattgtacatcattttatgttagacatattgaagaatttctgtctgtgtgttcatttttgcagtactagtagcttataacctagggaatattatgtgcctcatgtatcattttcctttttaaaagatacagtcattcaaatttgtattgagtattttggcacacattttgagggtctgggcctccatgatttgaatcaagaactgattcctttcgggtaaatgttagctgatgaccaaaaaagaggtattttcaatcccagtttcttaagaatattgacctaaatattgactaaaagctgaggtgctcacagccttttctagcaatttaaaaaatcactcaaaacctccagtgtttaaagatcaattgagatcagatacattttttaaaggaaaaaaaataaaaaaaatagccagttttgatctcaaatgcatacacatctatgtagaataggcattttttgtcaacatatgtgtattaagcaaccaatatttggcaatctgacagcaattgtgcttgagtactaggaaggcaaaaattaataagatcatttttccccgacctggacttaaggaactcaaaatcttgcataaaacattgtaaagaaacccttttctggccaggtacagtggctcacgcctataatcccagcactttgggaggccgaggtgggtggatcacctgaggtcaggagttcgagaccagcctagctaacatggtgaaaccccgtctctactaaaaatacaaaaaaaaaaaaaatagctggatgtggtggcgggtgtctgtaatcccagctactcaggaggctgaggcaggagaattgcttgaacccaggaagcagaggttgcagtgagccaaaatcgcgccattgcactccagcctgggtgacaagagcaagacttctaaaacaacaaacaaacaaaacaaaacaaaaaatcttttttttttgtcttgtgagaataaggcatgtagctgctcacacatgtagcttatatagcagctgtcaaggttcatatgctaccacgtggggtactgtgtgatttcctcctgatggctgagttgagtggggactgtcaagtagggggaacccggagactgatctcaagtgtccctcccggcttcactggacatcatcaatcagaacagtgatgtggctgctgctaccgcagctgccccttgcttatcacagagcaccggctagatctcagcctagtgctaagcaatttttgcatgttagtaccattcctccaagccattctgcaaaacagatactattatcccttatttaccaatgagacaactagagttctaaaaggctacttgattagcttacgatcgcacaacaagtaagtgcacacttgctccgttttcagtctgtctgtcccttttttctctgctgcagcatctcttttgacagacactgtggtggtaatgtgctccctcctgctccatgaagctatgacattcatacttgtgactgtaaggtgaaggaactatgaatactactattaattgatatgtgtagctttaatgcattcattctttaattcatctaaacagtatatatataaaatatatatattttaaaattattttttcataggcttttgggaaacgggtggtatttggttgcgtaagttcttttatgctgatttgtgagattttggtgcactcattacccaagcagtatacaatgaacccaatttgtagtcttttatccctcaccccactcccaccctttcccccaagtccccaaagtcattcttatgcctttgcatcctcatagcttagctcccacttaagagtgagaacataggatttttggttttccattcctcagttacttcacttagaataatcgtctccagctccatccagggtgctgtgaatgcggttaatttcctcctttcatggctgagtagtattccatcatatatatttaccacaatttctttatccacttgttgattgatggacatttgggctggttccacatttttgcgattgcgaattgtgctgctataaacatgcatgtgcaagtaccttttctgtgtaatgacttcttttcctctgggtagatacccagtagtgggattgctgaatcaaatggtagagctacttttagttctgtaaggaatctccgtactgttttccatagtggttgtgctagttgacattctcaccagcagtgtagaagtgctccctttccattgcatccacaccaacatccactattttttaaatttttttcattatggccattcttgcaggagtcaggtggtacagagatgtagttttgatttgcatttccctgatcattagtgatgttgagcattttttttcttatgtttgttggccatatgtatatcttcttttgagaattgtctattcatgtccttagcccactttatgatgggattttttgtttttttcttgctaatttgtttgagttccttgtagattctggatgtcagtcctttgttggatgtatagattgtgaagattttctcccactctgtgggttgtctatttattctgctgactgttcattttgctgagcagaagctctttaattaagtcccacctatttatctttgtttttgttgcatttgcttttgaattcttggtcttgaagcctttgcctaagccaatgtctagaagagtttttctgacgttatcttctagaatttttataggtatcgggtcttatatttaagtccatgatccctcttgagttgatttttgtataaggtaggagatgaggatccagtttcattctcctacatgtggcttgcgaattatcgcagcatcatttgttaaatagggtgttctttcccccactttatgtttttgtttgctttgtagaagatcagttggctgtaagtatttgggtttatttctgggttctctattctgttccattggtctatgtgcctagttttatacaagtaccatgctgttttggtgattatggccttatccaaagagtatatattatgttttattatggtgccaggcagtgacattggtacaactaatatatgcccttatggaactcaagatttcttatgttaaatacagaataaaggaagtaggaatatttatagctgttaggcctttagttaattttgtctagatggagtttcaaattacttatgatttgttgtcagttcagtgcataaggagaaatttatcttataaatagcttagaaaggagtcatgtcataaaatgacatgtctcaaaatgtcttgtgaagccaagttttcttccagcatggcaagcaatcaccatttctcttgctgagcatctaatgaagtcataggtttgatgtagagggtatgttgtgtgaaaagtactactttgaaatattagataacttcagagtcacaacatgctcatattcagaaaacaagtgaccctgacttccgctgatccgcagctctcatattacaccagccatgggtaggttgtttgctgagtgtaccctcataacccagtttttactgtatcttgctcttcagcaagtgctgtttctccttccagtatacttctctctggtttttttttttactttgcctcaagtcagtagagtttaatttaactagtttttttgtgcatatactatattttctttcagtcatactttttaaatcttagttacaaagcacacaaccaataaggacccaaatgttgtttcgccttaaattactttctttttaatattttctttttaatattcctctccattcttgttttacatttggtgggtatatttatttgtatctcttaagtaaaagaaactaagggactttgaaaaaaaaacaacttttcactaataacagagaataagtaagacgttagtatctatgtcaatggtggtgagggaaagggtaaatgctttctagagtaaataaattcaaaggattgtatgtcatgttaatataacaaaaacaaaattagaaagacgttttcttagattatagtagtgtattgtgtatatacccttatctaatagtgtttgagtctatccctccactatatgtatatcctaaattgtacagagacactagtatgctaaaatttatcataagaaaagattaaaaggagagaaatgtttaaaaatgagatgaaaaaccataagtacatgtgtgtgtatgtatatatatatgtgtgtgtatatatttccatatttcttgtttcattctaaaggatggtctgtgcatctctttccagagatcatgcacctacaacatgaaggaatgaaagaaaacctaataatacagagactggctgagcgcggtggctcacgcctgtaatcccagcactttgggaggctgaggggggcagatcacgaggtcaggagatcgagaccatcctggctaacacggtgaaaccccgtctctactaaaaatacaaaaaattatcccggcgtggtggtgggcgcctgtagtcccagctacctgggaggctgaggcaggagaatggcttgaaccagggaggcagagcttgcagtgagccgagattgtgccactgcactccagcctgggtaacagagtgggactccatctcaaaataaataaataaaataaaataaaataaaataatacagagataattcttcatttacaataaacactaagaacacatgcacacaaacacacacacacacacagagagagagagagattagattagtagcaaggaacttacatacatgattaatgtgaatgccttctgaaccaaagctgaaggaagcagatgagagctctgtgggcgtaggctgctgctgtgagcatacaaataagtttgatcatagctacagtctccatgcctaatgtcaaacaactgtcttgaaaatcctaagtgagagtggggtgggtaattcagcacaagtactgatctctgttgtcatgaatgtccttgacagtggtaagaagtggggacccattgggaagagccacctgaggtggcttcatgacatgatggattttgaagagatgtcttagacagatctaatgttagaacaataaaagtggtaccatggctgtaggagatcctgaatgcatgacattctttatcactgggataaagaacattctagattaagtcatgtaacattcacctcagcaaatggaacagcagggtcagcaaatctcattttgagtcaacaaatgcaaacattgcattatttcttttccccactgagagactgtcgtaacacacataggatgctggacacagcaacatgggagccaggttctgtactcttctacttaggtaaacttctgtcagcccgcagaagtcagtgaacacaattatattaaaacaatgtgtaccatggacccattggtcagaagccatattaaatgcagtttcatgcatggttagtcatccataaacatttctgcttgtaataataatgcggtcagaagtaggccttgtggggctgaaaagaggttactaaacaaaagtattaaggacacagtctgtgcagtgtgtcacttggtcaactggaaagcagtgacgacttttcttatacttgccagggtggaattcttctcagtgtattggtgtgaggttctctccggaggcattgcaatctgtttctaactacttggcaacagcttttggaataaggccaaaaagattgtcaaataatacacagagtggaaatgagctgtttgaatttttcagccatccttccttttcttagggccaaagatgtagttttataaatctccttaattagtaatttctaccagaatgagttagaattattacatggaatttagctcttctgaatgatgttcagtcattaagttatgacagctggtatgcaaaaaaatgttgacttattccaatcgttctgatgcctaatagaaagtagagttttttaaaagcatgttcatgggatggcattcaaaaacaagcttaagcaatctttctgagattgggagccaatccttgagacacctgggaatgaacagtaaaaggattggatatattggttgaatcagtctcctcatttcacatgttgatgttttaagagataggcggcttggcaaaccatggtgagagatgacctcttgagttgaaggcttatgttcactctgtagttcagaggtctgatctttcaatgcttcctgacgaagctctcctcgttttggtccatatcgttttattttgaaagattagtcacagcatcagacagatgcaagtagctattgtgccagacaggtcaggagaaccgctatgtagaaatgcttacagttgtggtctgttgcaaaatacgtgaattcatgagagaagacacatcgataatgttttcaatgagaagtgtaattacgtggctgctttttgcatgcctgccctctctcctccttttgttccttgacagaaattcgcaggaccccttttttagcaacagagcaatactatagcttaggtatttgagtggaaattttgaggggtgtggggagaaagaaaaattaaatccatttttttaaacagaaaatgtaagaattaatttaaaagtgactcaaatgataattgtttccaaaattacaactttctaatctatccctaggtgctgtaaactgcaaaccataatcctgtcttaatactgcaaacaaatcatagtggaactaaggggaacttaatttactggtaagagtattttccttaatcagttgttttatgcatttttgattgtatttaattattgcagtacatagggcaggagtcacaaaagataaggataaggagacgttgcagaacttttgtcttcactacggtcttagcgtagatatggaccagatatatcatatagtgaaggttttttttgttttttgagttccattaaattgctggtttatttttgaaagagcaaaacccttaccttaaagttatttttcttgttggctgacctgttggcatatttgaaagtggcatatttataatatttatcaaaatgtcatttttaatagaaaaaaatagtttcaccactgagatttgagaaggttgacttctaaggaggcttgaagtttcagtgagaaaacctgtattttcagggggttaacagagctcacgcttcatagtctgaacgacttacagcttcagtcactgttccttgaatttgaatccgtttgaaatctgacctgaatccttgattggagttttttcaaattctttgtgcaacaccaagctgaattataactaatttcaaagagtttggaacaataagaaaagttcacattggaaggagggccaaacacacagtgatgtagttctaggtaagctgtttagctattttgatgacccattttgtaaatcataaaactggaataatagttgtaactgcctacaggtgcagcctaaattagattattacgataatgaatattagcactgggtttggtccatagcattgtgtttggttcagtaagtgccaataattagtatcacgactagtttttaaagacaaaataattggaggaaaaacaaaaacgagtaatttttttctcaatgatgaaagaatggttttcttactttctcaggagcacattatgtcaccaagagaatatgcactccagaagaaataagatattacttggtgcatgaagaatttttttctatgcatttgttgcaaatgggaccttaatacaaatataaaataatgaagaccatgtggaaagagatagaaaatcttggctttatgggttactgttagcatacctggttcctggtaacccccagcggccttctaaatgaatgcaggccataccaagaataagtctatgaagaaactctctgtgctttgaaaaacatttgatctcttctctcatccactggagtggttttgccctccactatttttagatcttcacttgggaactttctccaagaggggttctccatacagactttctaaccacagggcatctgaaagtctcttgtaacattaaaaatggtttgaagtatattctaatatccttagagaaaactcttcccaaaacctgattaatcaattcctttgatgatgattgtgtgggatacatttattccattaaaacacttttatgatttcactttaaatgaatttctagttcataagaaacataggtaaatcttctgagatagtaatgaacaaaatacaatacccagggtattaaattttaaaaaagagattatcatactactatgagaaactgtaattgtggttgtgtcatgatgatgtattaataattatttctcttgacattatgaaaatggatggtaacccgcaaaacacccttcttgctcgtagccctgcattctttcctgtattttattgaattatgtttatttcttgtgttcctcttggtgattgatgaaatcattatttaattctacaaaataagttcccttaccgtcagttttcattgtgctagggaaatcagccatcaggttccaggaagggtttgtggaatcgtagtcataaaacacccatacccacacccacacacaaacacgcatttacctaatcttcatttttcttttcagaatctcttgtttggaaatttcctcccagaatacccaacctctcaagaattttaaaacgatggagtaaaataatcttcaagctctgattagattacaacatatgaatgctaattttgtttttacaggtttcaacacccaaatttatctgaacttagggcacaataagcagtttaactgttagaaatcttatgagattgagtttgtgcctatcagatgaatacatatttgtatataacatttcaattattgctacatttatgtataatttatccaaaagcgatgttatccatgcatcttaacagaaggcttaagtagttgaatgacagggactacatttttgctgcagaagatcatgataaaacatgtgctgtgtggtcaccttgggtaatgtgccgagactgcttgatggtacttatctctacacactgcatctcatactgatttatggatttggatgacttattttatgtcaaagacataaagagagtagagaagagagaatagtattttcatttcagtcttaaaaaagttctatcctatgagatgttaacagctgccttctcttggtggtctgtgaagtttttataaagatattgattattttccaatgacacacaaatctactgctagagaccattcaaatgcttagttacaccagggcttggctcctgtaccctgaggaggacacgattaaccaaatcctcctttttaaatgttctcaggacaatgagctgcacatacggcacaaatgcaatttgcttgaccaatcttgcctctgtctccttctatctccgtttacatgcttcatgctcagttgaaattaattctctacacattggtctcatgaacacatctttgagagcagagttcaagttaaatttttattttcatcattacctctgagaacacaatctggggcatattagacgctttgtaagtgtagaggtggggagaaagaagaagaaagagaggaacagaaggagggaaagattttcctgatagatcactttctggacactttctgtgctgagaagttctgagattgcctctctggatcctgctatcttggcagtcttgctaagagtttccatttacacttaaacatggttactgatgcgtcttaatgttgccttaactatcaggtttctgatagccccacatagccaagtgggaccctggtcaagaagttcacctctgttaaataaatatgcatagattttcaacatctcttcacatgcattcagaggtgatgaaagattccactggatgctagaacattgtgcataaataatcgaagttgtatgctcttcagcaatgatgctaccccatatcctttttttttctttcccatgatatgaggatatgagtgcagcagaactagctccatgcccttgtcccagaattaatcattcctatccatatttgatgtctttaccttttaaatatttatgggctgttatgttcctttcttgttgttcacccactctggggacattcagaagcctcacatttcttccttagccaaacaccccattcccttcatcctctctcagctgttctttggattacctccaaattgcatacataattttggtattgaggtgccaaaaatgcatttgtttcaactggagttttattgaagttgcttttactcaaatcaagtacacaaataaatttgatttccaaggcatgaaaattcagttaggtctccgaagggaagctgaggtatacttatatttcattataatgctacaggtagattttaagtcactaggaaaatgacatctcaaaatcaaaagattatagaatgagcactatatgaagaattacattttaaagcataggtctgtgatcattttgtaggtttttgttgttactgtcagtctattggtttttattaataattttattgaggtataactgatacacaaacgacatatttaatgtgtacaatttgatgagtttggacatatccgaggactcatgagactgtcactgcaatcaaggtaataaatgtatttattacttccaaaagtttcctctgtccctctgtttttgtttgtaagattttaataggctcaagctcaatcttcatagcctttttttaagttaattttttctttctttccaaattcagaaggcagattcatttcatcaaaagaaaacagttcctcagttgctactgcattgcagagaaaagactgactataatcaccattaaattattaaagaataaaagatactgaaacccagcaaaacttgggtgatctctttcataagcagacacttttaatcttatattgacatttaaaaggactgttcaagtagcaacatgacagactgcacatataaaatgtccatgaaaatatgtagcacagctaaacaaataactcagagcaaaatccaatgaaaggagaaaattgtgtttcctcaagaaaatgctatttttgccctaaggcaattcttgctggagaaaaataccatgtaaaacattgacacaaatcacagacatctcttctaaacagtggattttattggactgcacacgcgtgcagagatttggcagatatttgaggtcttggaaaggaaacaaaccagcgaaatatatcactattatcaccaacacaactgcagagggcaaagagcagacacatctcagagcctagtgatgaagcagggcattaaaaactaaatcaaagcctctgatcaaaggctaatttagtctgtcataattgacttgcagtggaaggaagcctcatgcacaaagatcaaagattagtgacttcacatttaccacaacatccccaccctaaaggagggaaaaaaatcagaaagaagaaaggggaaaaaagaagaaacatgtcaaagctcactaagaaccctgtgcaatgtaatctacctttcttaaggatagcatgcattattagaaaaatgaaaatgaattttattatggcatgtttgagttctaccttcgaaagagtgagaaactggcactattggcttaagtaacttatttgcaaacaggcattattaggcagtgccttttgctgcagttgcttccctttatttgtagcccttcaaatgcatacattaagattctcttcacagttgcaaacagcaggtaaataattgtatatttgagagactattgcctattgaatttaagttggtcacagactttggtccatggtaacatactaattgttaacttcctgttaaccagttatatcaagccttatgtaatttttgttgtttcagtacatactgtgaatatagccagctccctaactctgtatgaatattatatggggaggaaaaaatcctgtttctctattcttctaaaatctgtacctggggactgtgaattaaactaacaaaagacagattaataggaaaaaaaagcatactttttttttttgagacatgtctcactctgtcacccaggttggaatgtagtggtgcaatcatagctcattgcagctttgatctcccaggctcaaatgattctcttgccttagcctcttgagcagctggcactacaggcatgcatcaccacacctggctaattttttatattcatagagatggggtcacactatgttgcccaggctggtcttgaactcctgagctcaagcaattctcctgcctcagcctcccaaattgctgggattacaagccacaaattttatttgatattagtaatttaatttttacatgcggagaggatgtcatagtaaagaagtgaaaatcaaaaaagcaattagaccaggtttgtatactattttaactaagggtgataaattgtgtagaagtgacaagacaaaggaaaagagatttaggcttctaggagcagttaattgtgagaagttaagtatatgggcaaacctagtggaagattagggttatttttagtaagatttgtctgtgcagatctatctcagtactgagtttctatctccagtgatagtggttgtcctcctggtacagcagtgggaacggggaagaccctcacaaaaggaagtgtatgtcctccttttaggcctatagtggggaggcaaagagctctttctgtgtttgctgcttgctgactgccttcagctcaaagtaaaccttattgccaaagtggcatattttggggtgtcatattctgatctctttcagttcctatttattatattctcctgtcattatgctttgtatattttatgacattttaaacctgtgccatgtgtaaaatgacagtgaaaaggaaggtaatcctcttatgaaatgtctttctagttgtctaattatagggtgccctattagtttgtaggaattaagcattttcaaaggcatttattcaacgattgtttttgtgtggctgttaagagccacagggttgaagatacagtcgcaaagagagacacagttcttatcctcatgaagcttataatcttataaaggcagatatgttattcaagttataatgcaaacaaatgtaaaattgctgctctaataagcgccagaatatggtgatttgacctgtggtggtcagagaaagcttctctgagcaacaaatgcctgatcagagttgagaagtaaactaaaccagaaagtaagactagaaggatccatttgattgggaactttattagaatgctttcatttttcttgagatagatgtggaatccatctgtgctggggaggtaaaaaattagtccacctctcaggcagaggacagacagtgctgtagataatgcactgagaatggattttagttccagaaaaatatgagttccagctttaactcagcaacttttcggttgaagatttggacaaactagtcaacctctctgaacctgaggctgctaatccgtaaagtgggctcataatccttatctcagataatcatctcaactactgtttgttatcagtgtcatcaacatagtgctgatttgcaatgtgatcttaggcaaaccattttatctctttgagtttcaatttcacacttctttaaaatgggggatgttggattaaatggtttcaagatttctttcagctctacatttccatgattttgcaagcaaatgtaaagctggaaatttctgtctagatatcatgggaagcctatatcctggaaagttagaaaaagtgttgtttttggaaagtagactttttaaaagaggcataattccacccgttagcgattttacttatatttctttaatccacacttagaagtttctattatcttagattcaattttatagcacatatttcttctactaaaaagcctttaaagtgtttcagtgggatgtttaatttcccattatggttggtttctcaaatcattccttttgtaattgtcacatttttacagtcctgtttaaaacaaattcagtttttcaactaaaaatatcaagctgagttggaaatcgaaatccaaggactgcaaaatcaaatgataataaaccaaccataaggttaaactttccaaccaccacaaacttagagaccaccagaaatttgtgttacttgtttcttataaaatatagaataatcttttgaagattcttgtggccaaagtaaaattttattacatttctaaatctagaaaagggaaaactatttttaacaccttgttacttatttaaacataaaaatatttagtttgattggagcctcttcttgactctattcatatttcacttaaattactattgttttagctatacaaagcctgcttctgattatatttatgttaaacatttaatctttctttgtagagccacagatttaagaaagcatccagatatatatatatatatatatatatatatatatatatatatttctattttggtattttaaaatctcactcatgttttgattaataaatattcttaagtgctttcatatttatctttatttttaccttaggaaacacatattgaatatattaaataggtataccaggtgctattgtccttacgttataggttagaaaactgggccattgatttattcaagttcgattgtatatttatcgagtgaaaattagatctcatatctcatatcttctaacttcttattttgcattgccttactgattttccaaggtaaggaagaacctacccaatcaaatgaaagagtgctgacatgaattaaatctggttaaatgtctgatggtctgattgtcctcaatgattatagcattcaatggtattttattttcatttacccttccatttgtttcttataatatttcccattttgttagcctatgtatagatacgcttttcattagtgaatgtccaattatcatgctttcattttgggtggaagactgattagcatggattaattaaggtaattaaataattatagttactgtaatgtaactatatagaaatgaacattagcatggcctaattatctagtatttaggaacatatgctttggagaggtgatttaagtgggcttgaatttgaccttccatacttactagtaatgtgtgcttttacaagttacttaatctttatgagccttaatttctcatcagtaaagaggagatagtagtccttacagagtttatttttaatagacacatttctataattgtactatattttacacatggtaaactctcaatattatgattaacaatgcttttattgccctagccatggctgtgatgtatctcgttatgaaccaattatgctcccttagcaccatagttatagaggatgggacagttaatgcgagttaggttgtttagagttcttctctgaggagttattgaattgatgctgaagtaacagagctggtatcagagaattataccagtacgtaagcaagaaagaaacaagaataagcaagaaagtctcagaggtgtttgggtttctggatccaggggtccctgtagctggttccctctctaccttttctgtagtttttgtatgcgggccaataaagttccataacttgttagtttagcttagtttgatttgggttcctgtgacccactaatgtaatccaataatacaacatcttaaagacacatttctttgtcttcaagttaacatgtattactcacaacagtatcttaatacttatttatttatatgtttattttgtttctcccaattactaaaatgtaagctctatttgaacaaaaacttgcagtactctttcttcagctgttggaaaacctctaccacctactaggttctcagtaaatattggacgaataaatggataaaaagagaaagaaagtgacacttttctaaaagtgctcctgaattaaaattgcatctgtatttcttcctgaatagactagaaaaggacacaaatttaacatttattgagaacttacactgagctagccatcatgttagatattatatacattttgaacttgatgatattatctccattttacgaatgcacaaatggagggacaaagagctaaagtcaaattggtggcctcctggttctctgctcagaccgacctttgagaaccagctgcttccccagctgctgggatgtgtccagtagctagcacttaacatgttagccctgctttagggattgcctcagtggaagagagtactcctttgtgcaatgtcatgtcccctttccagggaagcccacatctaatgcctataaaggcccaacaccatcagctcagctctggacaactcctgcttccgaacacccctttcccataaattgatctcacatccctcactaataaacaagactcttcttcccagggaaaccaacctgctatggtaattttcaaatatctctgcccaagctagtgacatggcctctctaaggaggtaaagtgggctgatacccactgaaactgggagaagtatagttccaaggtatgatctgagaaagggctaggtattttctagggtcttaaagataggttttttagctgggatacagggagcttgtgatgagatgattgtcagggcagcagacatcagactatgcagggccttataagccacgtatcttggtgcttttgtgctgctataatagaataccacagactggataccttgtggatagtagaaatttatgtctcacagttctggaggttggaaagtccaagatcaaggcatcagcatctggtgagggccttctcgatgcttccttcagagtggaggtagccatgcctcacatattggaaagtggaaaggcaagctagctaaatcctgcatgaagcctcttctaaggcctttctgagggccttaatcccattcatgagggaggagcccttctgacctaatcacctcttaaaggcccaccagttaatactatcacattgaccattaagtctcaacacttgaatttgggaagggatgcattcaaaccctaccatcatgcaaagaagccaaagttatatttcctattgtccctaccctttcctcagataccaggatttgcctatctccatctctagctacaattgttctgaattttggggcccgtttttgctgcatgaatttgtatttgaattcaagacttgaaagattaattttcctttcagaatgttattcatataccccttcattcttaacctgctcactggtttcctaccataattacagtctcaaacagtggttgcattctggcaaaacgatgttttgagttagagttgttatgcagttagtcagttgtttgtagttaaaaagtctctttcttattcactgaaatgactggagtcccagctgctaggattcaaaggcaacagggaagacttcctagagtttcatgtgatcataaaaacctttccagacgttttaagtgattatgatttctatgctgcattgacttacaattagagatcattcaagtaacttagaattcagtaacttctaggtcacagagaggctcagatacacactgttgacagccttttggtgtctttgtatgtgtgtgtgtgtgtatacatacatacacactaaactgtactgctgtatgtgtgggaaaaagtctaaatactaagcatttttattctattttgggcaagtatctgtgctcaatggatgcaagttggtatctaaaatctaaaaaatgcaaagataaatggatcatctgtgtacttcaagctttattttcttgcatagttttttcctagtatttcctgacaacctagaacagtagttctcgcctttgactgcctattgccattgcccgtagcatattttagatctaaggatccctggacagatactctaactcagtggatggagcccaggtagctgttttgtttgtcgtggtagttgctctttttaatgtctacccattgtcctgtaagacaactagggttgtgaaccatcggttttttacactatctaaaaggaaggtgtctgtggattgaggatatttcttaccttgcctacttccacactttcaactttctaaaattcctgggattcatgctcccattccccaaagaatagtgagttacctataattatctacagcatctatcaataatgcctttagttcctcactttgagttctgcttagagctaaacatattctaagcgaagtaaggaggtttcatgcttctgtgtatgcataagtgtgcctgacaaagagatgaaacatgaaagtgaaacaatactgataaatgaaatttaaaaatatagtatgactttgataggtagtctgtattctggcacttcatgaaatctccaaattattgtatattaccatagcatgcaatttttacttatagcatggtaaagcagagctcctccttttgagtgatgtacagctattgcaccactctaagtggtaacttaacacagaataaatatgaatagaattatctagagttgtacaactcagtacctttggtttggaccagagaaaaaggccttagagtagtggttttcaaccaggagtgatttcgcccttcaggagcatttggtaacatttggaaatatttttagctgttaacgctaatgagggagagacttgcacctggtcagtagaggccaaagatgctgctacatgttctgcaacactcaggacaactgaatgcccaaaaagaattatcttgccccaaatggaatcatgctgaggttgagaaactctggcttagagaattgtattagtcatcctggcccataaaattcccatgaaaatttgggaacgaggggaggattcatatgtatctttttggtattgtatttctggcgcctgggagcttgctcagcatgcagtagttgctaaatatgtttttggatgactgagtgatggcatgatttgaatcagacaacattattttaccagccttggaatctgggcaaaagtgggctgcttaggagcaaagacacgagtctgtgtatttctgtggttgcctttccatggaaattcccattcaaggggatacctaatatgtaaggattaaagatgcctcctccatggattttccatggtgtctcacattctctaattagttattccttaaagttttgtccacctgtgtatctttagtggtatggcttcatgtcacctcaaatatggaggcattagctttgtttagttcagtatataccagattatgggatggaaaatactgaagggatatcaaatgatcatacgtaatctaagatataattaaataataaacttacataaagcatttaaaaaaaatttagttctctttcccttaattctttcaatatttcaggtagagtcaaaggctggttttgtgctatcatgattttataactaatttttaacaccatctccttttcttcttttcttcttcttttttttttttttttgtgagacagagtctctctctgtagtccaggctggagtgcagtggcaccacctcggctcactgcaacctccgcctcccgggttcaagcaattcccctgcctcagcctcccaagtagctgggattacaggtgcctgccaccatgcctggctaattttgcatttttagtagagatggggtttcaccatgctgaccaggctggtctcaaattcctaacctcaggtgatctactgcctcggcctccctaagtgctgggattacaagtgtgagccactgtgcctggctctctttttcataaagagacagcaaacctcaaaatcagagattcagcttgccacaggtctatttaaaattgtttttatttcaattcatgtattttttatgtaaagtagtgttgatttcctgtttatagcagtggagaacatattaagatattttaatttaaatagaaaagtaagccaattacaaataagtgcaagtagcgtacagatatgaaaaaaatcataatcatgtcacttaaataggcgaagaaatcattgaatttatttgttttgttaacattgtctcatcttgaaggagaagatggaatctggagattgcagcttgaatggctccggaagaggcagcatgttcggtggattggatgtgtttgcataactgtgggaccacatgggaggtgacgcaggaaggctgaaagaggacagtctccaaaggagggagcaaaccttgaaaacacctgcagggcccttttaatggccaactgcatcaatttaaaacgttcacttgctcccccatggctgtctgtccaggcagaagcaacatgacctctggtttgaaaggcctctcagattaagagagaatattgtgtcttggggaaatcaatcatattattatgaatcatagaattatgagtcatgtgttataggttgtttcaggcaacaagacctcagatgtccttcacttcaaccactcttgggatactgaagggtattgccattgcaatctgtggccaacatctacttccacatctctccctcttggggctttcaagtccaagcttggagtcatgtttgtaggagcctcaaatctctctctcaagaattttcatttgttttccccagttctcccctgtggaaccatggaaattaaaatcgaaaccctgttctattactttcacatgtttgaagatagatttcatgtcttacttgagccatttttttcttcaagaaaacatttccagctccttcaacttttccgtccatgagataatgtcagtccctttttccatcttcggaccttgcctctgaataagctcagcttgtctgaatcagttttaaatagaagcatttacacttggatacaattttccaggtgttgcttcagtgggacaaacgaaagtgagacaattgcatctcttgttctagatatcatacttctttatccataccctaaggttactaactttttggcaatttcatcacattgttattaactaagtcccctttttttttttataaagaaggtactacaattatcacacacctttattttaaacgtatggcaacatctttttttttttttttttctgagacattctccctttgtcacccaggctggagtgcagtggcttgatcacggctcattgcagcctcgacttcctgggctcaggtggtcctcccacctcagcatcctgggtaactggcattacaggcacatgccaccatgcatgtcttttttttagagagagaatttcaccacatttcaggctggctttgaactcctgggctcaagtgatctgcccatttcagcctccaaaaatgctgggattacaggcttgagccacaatgcctggcctgcaaatgtctttctaataaaagtatgtgtatctgtagtgtgtgtgtgcacacgtgcgtgtgtgtgcttgtgtgtgtgcgtgcttgtgtgtgtgtgtgcatgcgtgtgtgtgtgtgtgatatagtgggggtggggcaggagataggaattgcagagaaatacgaacagttaaacataaagagaaactggaaatttgaaaatatatgaagtgtctgaccccaagttcaagctgagaagctaggcatcaattttatttttccttagcctgtttttaaaaaagtattttttcaaagtttggtccttgagccacttttcagcatcatcttatcagggaggcctttcctgtatgtcccattgcttgttatctcatccaccattccttgctatctgctttaccctgctttattatttttttcatagctcttattacttccaagcattttatatctttttatttatgtattacaaggcttcatgaaaggaggtactttgtttttttaccactgctatttgtcacaacgagtttattaaatgaacaattgaataataagtaaaaggctaacttgggatgtgattgcatattcagatttttgggtcccaagctgggcctacagaattagaatttctggtcatggggcccgtttaacttacttttctagtgtttcatctgtgttctaaaattttagcaagactgaaagtgcacacaatctcagtgcactaaacactgaaaataaagtgtaatgagtaaatttttgaaatatcagctgggcatggtggctcatgcttgcaatcccagcactctaggaggccgaggcaggcctatcactccagatcaggagttcaagaccagcctggccagcatgatgaaaccctgtctctactaaaaatacaaaattagctgggtgtggtggcgcggacctgtaatgccagttactcaggaggctgaggcaagagaatcacttgaacccaggaggtggaggttgcagtgagtcgagatggtgccactgcactccagactgggtgacagagtgaaactctgtctcaaataaataaataaataaatgtttgaaaaatcaaaaaatggccatcttcctttacattcttaaaggaaaacataagtctgtatcaaggcattagaatataattatgctgactgtatattttaagtcaactgcatattactggccaactggagatcactatctattaagacataaaatttgctataatgtaggtttattatttacagaggtaaaagggccttattcaaaccttgtttcgactatgatgatgtcatggttgaggattcactcccaggtcctaaataacattccgataccagcacgacagcagattcacacaggcacaggcacttgcagactgccatagcttaccaaacaagacccaggtagagcatttcaaaaagctaccaaattgacacagctggggtgtagtttgggaaatttgttcaaaatgctaatctttgaagttaaaggtggaaagaaaaagtctacataaaaaccttccttggaaggagaaactcttatttccctataaacttcattactaacaaaataagggaggagagcaataagaaacaaataagattaaggaagccaaatggtttttaaatgagattattttttctcagacttttccacaaggcgtcagcagctctgtaaccaccagattgtcagaaattagcctggttttttttggacagtttgagaagccattccgtcggccttatttattgtttattaaattgattctacttgattttttgcagacataaatgagattcttctgaatgatgacctaagctgttaaaccttataataacatcactagtcactacttctgcctctcagctagtcagaagggcacaccctatggctttacccttgatcattgcacaaaaagaagagccaagactgtgtaacccaagtgtaatcaaagttacataaaaattacttagtgaagccagcccctgatctgtttagcatcatgtttactaatttattttttttacctccaagtaaagtacttggtcttttttaaaaaagaaggaagaagagcaaaatagagggagggaagaagagagggaaggaagaaagaaggaaagaggagaagagaaaaataaaggaaggaaggagggagagagagccttctcaaattcagaaaataatattattttttctattatgaagcatcgtggaagaaaataaggccagttgctacttaaaagtaagcattgggctgaggttaagaaatcatattctatctttaaattttatattcactacctgtttggcctcaaaaagtcacaaactcattgagctaagatcttacttgtaaaatatatgaattagagctgaatgatattattgaaacattccagctttaaaaactatatggctctttgattattaatgtaactgtcagatttgaaacacaaagatagaatgagtatttagaaacataagccacagacttaacaaccagctctcaaaatcctctcctcagtatttataaagagaaataaattttgaataaaaagataataattgggaagtacaattgttactgattataattcaatcttcaatgttttactggaaagaaattgaacaatatatgttcttaataacttcctttagtcaataatcgagtttgggaatttttagcagcttgagtatatttaagcccagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcccagatctacacagtactcacagggcaggattcacacgtttaagcccagatctacacagtactcacagggcaggattcacacgtttaagcctagatctacacagtactcacagggcaggattcacacgtttaagcctagatctacacagtacttacagggcaggattcacacgtttaagcctagatctacacagtactcacagggcaggattcacacatttaaatgctaagggatgaggtatcaggagaggtataagacaacagggagtggtaaggcctggtacactgaaaaacaggattgttttaaagcaggaaagccttgctcaactctggaagaattttgctgtgtgccaaagcagaactagtcttgtcagactttctaagttttggaagaaaggacagaaatcagcatattaatgttaaaactcataatgtttaagacatgggagttcattcaagccttcaaagacatcactgtgcaaactaatcaaaacacacctgtgagtttggccccactagggtttctggagtttccttcctcccattcaactatcaggtgaactacaattaggtattaatccttaatgacagcttcctaatgaccttgtttagctatttcaagaggatccttccctaaagtattcagaatcgccttgaaacatgaagaccacttcaagtgctatgcaaagtgagggaaatttggagagtagattcttctgaagatttctctgctaaataagttgcactcaactgaaatccagatgtgccagcactgaagctccatcgcaggcaaggccgactcattgaccccaacttctgtccactcaagtgccccgagactgctggtgatttagcaagtgaactccttgccagttgtaagagctaattcaatctcatccccagggtggtataggtacattaagagttgcagctcttagagtagttaatccggaaaaagaaaaaaaaaagccaaagtgcttgctgaacatttaactgaaaaatttctcatttgtacctgatggttctgaattttgtcaactgtttctttgtatccttgtgacacgtttcttatttgtcatgttttcttttaagaaagaataatgtgagggaaatgaaatgttcatttgttactggaaacttacagtgatgagatgtggtgcataagacatcataaaatatccctcatttccatttgcatttgtcactgctccaaatcattcacgtatctctgtatctgcgtctgcatctagctttgatttattcacataattgatgtagagtgacttttcccaaagacatgaattatattaaatttttgatttgtgcatgtatttgcttttgcatatcttacttttagatttttatagctcttcgaactcagagaacattcaccacatctatattggcctagggaatgttgaaagaatgattttaattatgccacatatttttgcactgttcttatctacaaacaattgtataagctatgccttttgaatatattcatgtgctgtgccagatagtagtagtgcaaaatgctaatgttgattttaaaagaatgacctttccttgtgtgtttctttccagtgatctgcttatctaagacggatagtattgatggactgcactatcacagtcttagacttgcagaaatgccttggagttttttgtttgacatttctttgtcccttgggtactttgctctgactctgtcatttagactttactgtaaggataaccaattagtagttaaatgagttgaaggagtctttttatgtactctattcaaataacactaaactcactgtcacatgaataggagatatgaattatttctctacgcacttttaaagcaagcccacacagtaaatgatattgttcataacccctgcctttattgctttcttccctacacttagggacttattttaaagaagaatttatagatcctctattctgtattccagtagaaataataactcagtaggaataggagtatgtagttttttttaataaacatataacagaatggtagaattagttttgaaagccatactctgaaggaacaacaatgagaatacttgctgggaattcgcctctttaagaaatagcagaggactgccaaattaacaaaatgcccctggtctgtatcatttatacatggtacagatatatattgtggacctactgtgttccaaacccaaagattgaagaagtaaattctcacttcctgtctttgacatattcagaatttggaaatatttcggaagctagaagtcaatactcacaatctaactcttagaatgaatgatccttggtcttttaacaaaggacatctgactaataaaatagtcttagagttgtaggagaaatgtgtcattctggacaacaaagaccttctgtctctttcgcaatggactgtttgcgtaaaataccagcgtacttagtgaattagacatctacaacactgtgtaaacattcctttccagtcattgcttcctggtcagtcatagagaccactttgaagtgcctttattttgaacactaggaaagaactacaggagagccacagccctctgaagtagtaatttttgtaaatttgcgaataatgatgttacatcacgtcactgggacatcaaacctgtctaatgtgcactactactcccacactactactgctaaggcaacaaccatttactaggcttattggccgtgtgccaagtgctgtgtttatttcttattttcataggatatgttatttaattaacgggtagctaagagagagggttccagagacaaactgctaaggttcacattcttgcttccattatttgctagctgcatgaacttagccaaatttctcaacatttctgtgtctcaactaccttatctataaaatggaaatacttgcctgataggtttttatatgattaaatcagaagatagtggttaagtgcttagagtgcacagactaaatgttcaatttgctataacatttctataatatcactcaatgaatatttgctataatattttcatatctcttactgatcactgtaactcaaataattgtgctgtcttattattcttagtttgcaagtgaaaaactgaagttcacactaaccttttagtcaaaaaatgcactaaatttctgagctgaaattccaacactgtttgatctgattctgcagttccaatgggggatgatatgtaaagagaaggggtaggactgcacctgaaatgttactagaattctattcaatgatctgtgatcctcatattcattcaaaacctatgggtgggagatgtggggaatgggtgggagatgtcagaatttgtatttacagtgaagcagggagtttaataaggtggaatttcaaggtttttaaaactcgatggtttttgtaaggtgggagtggaatggagagtgaggtagtaaattgggataatcaacctcggagtctctgggatgggagagatttctcctcagtattcaaattctggaaaccttttgaacttccaccaaaaataacaagccgtctaataaacaaaccatcccatgcacagagaaagaaatggatggttggggctttgaagccagtggtggttcttagtctgtgtggctaacccactagggacagatggtattattgggggcagctctcagaagatttgtaaaatatggtgaggttagtagcatggccaattttgttgtacagtatcctcagttaagcatgtataccaggagaaggatccatctttcttgcactttgaaggatttggtaacttattcaggacttggtcctatagctgtggcagcaacaagagtagtcagctcagcttaagcctctgttcctaaaggaacttggtctaaacttgtaggtctaaagacctacaagtggctctgatggggacctgcagtgatgcaccagcgagcgacaaatggagacatttctttaacaaggaaagcgatacaatttctacatgggaaggatgcattggaagcaacctggttagaagggggctggggactcattttgaaggtctggctgcacaacaggcatcatgttcttacttagatttaagtttctttggaattaataaaaattatgagcaaactgactcctttcctgaggtacaagtttgctctgcggctgctctttctcttctgtgaaaacgtgaagctccagttttggtgctagcaacaacaggacagaggcttactttgcaatatgtctgatagtgattgtgtggttttcctgcatcaaagggttaaagttgaaataaaacttgcatttcattttgagcaaataaagcaagagcaaatggcattgtcctgagaaatgttagcacactgtagattcttaaatttattgtggttgaggatggatgctctccagattagcaaggcagcacttccaatgttcagtggagggcactttaagatgcaattatttacacttcatgttgtgatattacaacaatagttaataagagctggagagatttcctaattatctgagggtgcaggaaatcatttcaccctccccttacttgaaatactaggaatcaagtctgcaggaagctggctgatcacaaatcacgtgtcagcacctccataacatttacctgcataatttgtccttattattttttatgttgatgaatctatattgataaatcttgcatttatctgttttttgcagtatgtatttcctatttcacagtagtagggaccctacgctctatttactttgtgctctttcacagtacaccataggatttaaataaatgcctattgaaaaattcaacaaataagccatgtcatttttgttaagcagctttacttggaagcaagacttctgttcaaaattatgctaagatgaagagtctcaccatcatttccctggtgacctgtgggcacagaatttaatgagaatttgtttccttgccctcatagcaacttcctctgcataagatcctaattaaccaccataaggtgatttaggccttggggtggggtggaattattcattttcctctattttacatttatattttacttcataatactgcattcacttcctttgaaatgttagtattaagaagttttctagtagctgttctcttaaaattacgaggatttttgattttatgttattttattagtcaaaaactaaaaccaaaagcaaaatctgtaaaattccttttttgaggatgtaaaattgccttatacattatatctcattatctttaccgattttaaaattaacacctaattaaaccgtgtgtgtatttcaaacgtgaggctaggttctcattgatgctctccactaaattgttgcatgaagctcaagaaaaatgtgaaagattatacagtttttgggcaacaaatattctccctaagactcaagatgtgttttcttaagaaaatagatttaaaatgtgaactatttccaaaatataaagcaaattaagaagcattttcttgaaggagaaaatgtaacaattaccatagaaatgcatttgccttgatatcgtcatttttagcaatgagtttgatcagctttgtgttgatgatcaattctaaaatgattctttcctatgaaaaaccatgctttggtttcatttcacagctgctaatttatttacttcacatttgttgtcattatcgcattctctgtttattcttgcttcaaatgtgttttgccccgacacatgttcaatagatacaatcctttacataaaaatgaaagtagatttctaaaactctgtagtatatttacatcaaactgtgggtaaaataatttggaataataaagtgttttagatattatggcagtgatgaagaaaatgtattgaaaatgatgactaggccaggcacagtggctcactcctataatcccagcactttgggaggctgagatgggcagattatttgaggtcacgagtttgagagcagtctggctaacatggtgaaatcctgtctctactaaaaaatacaaaaattacccaggcacagtggtgggcacctgtaatcccagctacttgggaggccgaggcagcagaatcacttgaacctgggaggcagaggctgcagtgagctgagattgcgccactgcagtccagcctgggtgacagagcgggaccccatctaaaaaaaataaaataaagtaaaataaaataaaataaaataaaataatgactagcttatgctctcagtacacattttggattagatttcctacttcagttaatacaggtttcttctttccctcaatattattgcacatgccataaatatatcttgcaaaactgaataagaattaactttgaggcagctatacatcttatagtcttgttagcatacagaaaacaattaataaagaatcttcggaattatttagatttgagttcaaatcctgagttcaattattaggagttaggtttaagaaataattcactctacctctcttccagtattcgagaatacagggttaaaggcagagctcaatcagatggcaaaatattggctttgtttacacttccccagtaattatgaatgttaaagggtgttgagtgggattttgtattttgttgtagctgttgttgctctcaaattggtaactagagttcacagctgcatgcagagattagcctggtataccatttactaaagagagaagcaaaaaattatggtcagaatcctgtctcaggagcttcttaagagttgaaagaaaaaactcaatttccccaaccatcaaccagctgctcggcttgtgcacaaaaagttttggaggcaggaaggaggagagtagctctttgaaatgttctagcattgtggaatgtgcatcatttatgatcagatgggattccttctatagcgcttttctcatctcaagtcaagtgaagggctccaacttaatcatttgtacagactggtgcacgtgaaagaaggagacttgcaaatgttccctgtttagttaactgaatcagtaatgaacttccgaatctgtttctgtgccaatgttgggcagataggagaaaaatggagagagatggtagggagggtcagtggagcacctacattctcgcctttcagcccaggtggggtacatgaatgttctgtagataaaaaagactctctctctctatatatatatatgagatggagttctgctcttgtggcccaggctggagtgcaatggtatgatcttggctcagtgcaacctctgcctcctgggttcaagcgattctcctgcctcagcctcccaagtagctgggattacaggcatgcgccactatgcccagctaattttatctttttagtagagatggggtttcaaccatgttggtcacgctggtctcaaacttctgacctcaagtgatccatctgccctggcctcccaaagtgcacggattacaaggatgagccaccacactcagccaaaacagacccagtattaagcagctgggcttgagctgttgctggtacctcatctaagggggttggtaacaggctacagtgacaaaagcagcaagaggcagtgagatctccaggaagctggaggaaggtgggatgaaggtggaagtacctgagacctgtgcagaacctgacccagtagaggggccaggctagaagagatgtgataattccaaggtgctaaagaggaagggggaatcaaaaaagagacaacgctcttttattttcatttcagctccttccagccatagttctggccagaaatggggggaagggggaaatattttgaatcaaactgagttttagtgacagaaggtgacttgagatttatggaagaatcaaatgcataaaggcatgggaaaggagaatttggcaaaaaatagtgtggaaaactgtgtttgaagaaaaaaaatggaaatatttcaggccaatgagggtctttgataaaccagttacagctggattagagaactctatgaggcttcacatgttatttttcctgaatttaaaccctgggactcaatattatttctaaccaatcataggtagcgaggttgaaagggagactacagagacctgattggtgtttttaccacctggacctggaagcactgtcattgacagatcccaggtgtaggcagaaagggcaggggatccgggtgcaaaagaatgagccttgccttgtttttgaagtttccgttgaaccaagctgatgagacatctacctgttgttctagttactgttagtgcataaaaaattacccaaaatttggtggccaaaaacaataatttattttgctcacgatattgtggattaagaatatagagagggcagttcttgctaaaagttttaaatgcaattgcagtcaagttgttagctggggctgcagttatatgaaggttcacctgggctggctgctcaccacagctttcccacatggctcgtagtggacgtctgctgccaactgggagctcagctggagctgtggacttgagggtgcacacatgtgtgacctctccatcacagcagtctcagggtagttgaacttcaggcatgactgctggctttttcagaaccaagaggaagtagaaagctttgtttgatcacaccttagaataattggttacaagtatatcattaagaccagcctgaattcaaggagagaggtataagcctcatctctcaatgggaagttgtcaaagagtttgtggacatgttttaaatctatcaccctgtgaaaagccaaaaatactgctccaatcaaaaaaaaattcttatattttggccaaagttccatttcctaaggattgtggggagggggaaggaaagtttttgtgaactcgggcaagtcattttaactcgctgattttcagttttctcttaccaaaatgaaagcaaaaatgcctactttattgtgctattgtttaatggggtgaggttggtggctcatgcctgtagttccaggtactcaggaggctgaggcaggaggactgcttgagcccagcagttggagactgcagtgagctgtgattacaccactgcactccagcctgggcaatagagtgagaccctgtctcaaaaaaatcattgcacttttgtaaatttaaatgaaaagacagtgtctaatatatagtagctcttattatttactcatattacatgaggtatccaaagagaatttctcgcaagatataatgaagaagatttgtatattggaagctttcatttatggttggagaaaaactgctaaagatttgtaattttgaatgaacattggcataaatagaaagccagcgcgcagagcagagaaggctgatatttttatgctaagctgtagaaatcaggaaatgtgtgataaggttatctgaaaaatagattcagagaaaccacagagagaggaaggggaaatcaaagtgaacattgatgaatgtgggtaaggatattgtgtgttggggaagcatcttagttcttccatttaatacacatgtgatgtttgaagcactcttatgaaaagtcatctttcatgttaagtggagatcatgtatttgtaacatttccatttggtagtcatatctctagctattaaaaatcacattgtgataaaatactcttttgataggtgctgactgtaaaatcatatggtagacattttctgcaatgtagcatgatttaatagaattgggaaaataatgtttttatatttctattataaataacattcatatagataatcttaccagttgctatcaatacagggaattcttgtttcaattaattagttaaaattttcattgtttttgtgctttactgtaatattgctactgttatttgaaacacattacatttgtataagcacatgtagcaatgccaaaaatattggggtgcctactctgtgcaggggtttacattagttgttgcatatttccaattcataattttgtgttttttgtattcctgtcattatggtatactttgttgtttttgcatagattttatagtctttttccaggttttaggtttggtaatagaaatacttctatctcatcaatttcaagtctactttcagaaatatttcaggaaggcaaactgcattcttaacaagagactatgttttcgttctttggaaatgggaagataattaagacccatattctgtcctcaggtagctaatagagtacactagtgtattagcctattagccatggcattttcaattgcaagaaatctaaggcaaaagggaattttagatcttacaattagaaataccgtagagttgttcacattatgaaaaataagttacaggattagggaagagcttatgttcaaatagttcaaagcagcaatggacgtattttgtattgaaaattccaaagatgatcataaagatgactccttggcacttgctcccaaatggattcatccttttattcattcagtctttcatccatccagtacttactgaactcccatatttgccaggcatttggtgctagagatagagaggtgaataagaccaagttttgcccttatgagagcaacagtctaatctagggagatgacagacagcaaaatcaatgaagagataatgaagggccacctagggatcattcctattaagctggtataagttggtttaaactagataatgaaagaaggtctttctgaagcggtgcctttgaacctgagatttgactgacatctctgcgaagatctgggaaagtcttcaggtggagggtagagcaggtgtaagaccctaggaaagtgggagcttggtagtatttcacaaacagtgaggaggtgggagtaaattcagcactttatgaagttttgtgcattcttcagtgttgttggcatcagtgagtgtgcgatagctagaaacaggtcaataaattattcatgatcaaaatgaatttgctgtttctctggccacattattgcacccttgggaagtggttagtttgccccacctggaccaaaggagagttccttacccaagaacctgaatcaatatgttttagtttagctatgtttttccacaagctcttaagctctttaattccataaagacaattatcactcctagacttaatcatttttctcttagcctctgtgttaccttctttaatcttattcaagacttgtttcctccagtcccttattgttttgccattaagccttatcaatatttgcttggagctatatttaatatattcacgttctttttctattctctctcattttttctgtgcaaggccaaatgtaaatgtcacgaaattatcagaatcttgaattttgatgtcacatttatgttttctatcataatgacttcttttaaagaataagggtatatatctcttatgaatgcttcttatttttaagttataatgtttctgccttttaaattagaggtggtaggatggtaatatgcctatgttaaatttgcttttctactagatgtgtttcctaactgctccaatctactcttgcctatactgtaatgttccatgctgtaaccagataattctttctgaaatacaaatttgaccacgccataattctgcctaaaatgtgttgatgatttcacattctttttgggtaaagatcagctccttacatggcctacaaagcctcaatgaaatagactcagcagcagggaggctcctctctgaccaaatcccttctcacttcaccagtttccattcactgaccttttcctccttagtttctgttctccatgccagtctgaaaacagagaatttgcatgtactcatttgtcgtgttcactacatttttttccctccttgactaactaacctatacatcctcccaaatctcaattcaatgatcacttcatgacagtcaccatctctggatagattgttaaaagcagatctagacagagtaccacatgcaatttctggtcaccctaaaacattatacatgcacacacagtgcatacacacatataccccacacacattccaggtaatattcagaaatcttactattttaataggaatgtgtttgcctaagttgaaccatgctcaaaaaaagaacattccaaattattaagctgactaaagctgtctttaaacagcagaatacatatacccactgttcagattagctaaatggggaaataactgcttttcaaggttattaacccacaatattctaatctcagatgctgtactagaacagtctggcacagttactgtttggtttatttttttactctagtgagctgtaggctgacacgttaccaatagcttcttttcattgtaagcagcatacagtgtgatgctcaaagtgtaaacaggataatttttaccattttcaggagcatctaagtcatctacagttggataacttttttccacaatttgtgaaatacaggtgtatctgtcaaaactgatgcacaattttctctgtttcttttatctgtataatgacttacccaattcctagtgtgcaagaaatattattgatgtcttattgaatcctgttgctttctgtatatactactgtgatcttggtggcatcttcatttattattctggtggacgcatgtagcttactatcagtgtttttatgagacaagaagcaatatctctcttttctaactaagcatttagacagtaaattctctttgcatggatagcagtgtggtcctactcaccactgcaacttcgttgcctagcatggcaccagcacacagttgaaacttcattcttgaaacagcctgtgggttagggatattctacctatttactagtgatgaaactgccccttaaaggaatgggtgagtgattgcccaagtgtacacagctgctaagtggtaggggtcaggctcttagtcgcagtgtggctcattatctagcatttgctaacatgttatggaggcattttgctactttaaaataatttatttattcaaacttcatattcactggtcagatttcccttgtcagactgagaaaagaaaccactcatttgcaggacagtagcaaacatcttacttgcattccagttgtgtatgggttcttttaaacttcataatattcttttcttattcctcttgctatatattgatggcaaccgtaggcctaggtttaccacatctctatagaacaaagccatatcttatgaattgttttaggtgctatctggactgacacagttttgttacctatagcaaaatatttactgctttgttgcagagaaagctagcagatggttttcatgacatcataggcagggaagagtagacatgtagggtccacatgtttggccttttttccaagagtctaacttcatatattcatgagaattttgaatgaagaattcaataaacttgttattgttctataatgagaaatctttatttgctgaaaacaaagcctattactgtgttctaaagaatagatctcagtctgaaaagaatgctagtgcaaagataaacttacataaaaaaactagtataaaatttaaatattattagcaatcatgattaaggatattattaattgtatatatatactatgtgccaaacaattggctaagtagtttatattttaccttatttaatccttaaaacccttttaacatatgaaaaaacttagaacttgaatgtttaagaaggtaatttttgttctaaaaactaataattagaagagttggggttaaagatatgttgaactctaaagtcgaaattattattgtttatattattcttttaaaaattaagataaatattatatattcattgtcatgattacttttataatatatttttccgacctgtctaaaatgctgtgaaggtaaagatcattatgtctgtttaattcaccactatattaaaagtattatattgcaccaccaatcatattgtatatgatttgtgtccattgtagatactcaataaaatatatcaaatgaatcaacttgagctttgaaggttgggattgtcacaacattaagagtgttataacctttcttctcagacatttttgaggagttggagataggaaactgcagagtttagcctgtttggaagaaagctggtgttttatagtttgcagcatgattggaatccagtgactcaactgcctttgaccatgaggtttcaataagaggcaagaagaacttcagttccaaggaaaatctcctgattaaaagagtcgtacactgatctcaaaaagacttcaatggcagcatggcatggagttcaagagtatgggctctggggctgggcacggtggctcacacctgtaatcccagcactttgggaggccgaggggggcggatcacgaggtcaggagattgagaccgtcctggctaacagggtgaaatcccttctctactaaaaatacaaaaaattagctgggcatgctggccggcacctgtagtcccagctactcaggaggctgaggcaggagaatagcgtgaacctggaagtcggaggttgcagagagccgagatcatgccactgcactccagcctgggtgaaagaggaagactccgtctcctaaaaaaaaaaaaaaaaaaaaaaaaaagagtatgggctccgggccagattatccgggttccattctaaagcactccacttattagctggtgacttttcaaatgacttctctatacccaaatgatctcatctgaaaattggagataatgattgtacctgcctcataggattattattattaagattaaatgaattactgataaaatacttagaacagtgcctgatacacaatatgtgttatgtagtgtttgttacatgagtattcattctaaaaagtcttttaaaatataaagtaaatgcttatagattttttttaaaaaattatgcatctgcttgaaaactaaaggatattatttgataaagtgctaagatgttctcagtgctagaattatataatagtagccacatcctggaaccataaaggcattcttaaggaagtttatatttaaaaaagcaaaataaagagccaggaatgagtaactagtgcacagactgtgaaaccagaggataatattctatatctgtaaatacacataacattaaaatccttaatttgacaactggcagaagaacacagcattgaatcttgtatattttcattttctctttctcttctctaccacattcatttccatgttacttttatccttttcagaatgaccaattgcttccgttttaaactatactcactgtacttgggatttatttctcttaccttatactggaaaaaaatgcaaaaaaagggcattcagaacttacgtgtcatttttatattgcgaattcaaggaaaataaatatttttgtgactttatttctaagtgttacatttgcttattttgtcttttccatatttccccctttccctgtctttggcatgacatttggaattgttattggaaagagaatcaactcagaaatcaggaaagttagccagtgacacattcctttattacatgatgcaaatattttgctttgctcttttaacatttttcttttccataacaagaagttttacagctacatttcacagattttacatctctgcatctaacagaaacataaaatgtagtttgcatttaggtatttgtattttattttactaggcaggaatgtggagtgtgtttgtgagcttgtgcatgtgagctggaaggaagtgtggttgcccagtacttcctcaactcatgactgaaactttgttccagttcaagaaggaaataaagagcccttcaaaatagaatactgaatactttcttcatccgctctatagaaatcaggccaggaagcaaattaaaattacaagaatatccaaaacagaattattttgcttgctgtctgtgtatttgaccactgccttttatgattttaacctttccagacattctctttggggtcggttttccttgtggcccataggagatcccactgaaatcatttactagttgttccagatttccccacaatccccattgcgctaagtggcggctaatgtgggagctgtcatgtttggaaaataccatgatgccatgagttaatttcatacctgtcacaagatcttgcatgcgatcccaggggaccagtggtatgtcacacactactgcaagcgttcgttagtacctctcaaagcaatgaaccatggccaagagatcttgttgcaacatatggcagcacctgtcaccaggcttcatgactggcataaaattaacctgttttcctgtttgatgcgctgcttttttttgcttatccgtaaaaaggatgagaataaattgtatttggaaacaatttactgttcctttcaagaagtataatggtagacttgggttactggacacaatgaatagacagtgtccttgtagaagtacacacactgctattcagtaaaggtggtattttatgaatttctgaatggcagtctgcacatctcacacaggaagcaacgttttagtttctgaactctgtcaaacttagacatagagcaagaaatgacattattgtgagccacattgtggaagaaaaatccaggaagcatgagtttcagatgtgagtttgcccttgcctttcgaatggtttcaagcaaccttgagcttcctctctcttctctctatatttctcacgctcagatcttagtattctaatggggacgcacgaaaaagggacccacagaaaaacaatattcagaatgatgccggatattcagtgtcttagaaaaatagattaatgggatttagtctttaagtcttaaaactgcaatttagcagttatttttatggataaagacaaagaatatagtccagcatttatatatggctttctacctcagagaaatagtaaaagttttttgatcaaatgatttctcaatagagaaagtatccggtttcttgcatcatttttcttttcttttcttttctattttggatcttcttatatatctttttgcagagccttaagcttcttaaaatatttattttaatcgaggggggagctgttttctatagctagtctttttccttcttcttaaggtaaatgcttcttagattctgtgagttttaaaattcatatacagcaaagaacaaagataaatttagcagtcttttccctttatgtcactaccaagtctagggaacaaatggtgctgttcttccacaatctggactggttgctttgaattctggagtaatcaatttttcctggcatttcttaaatggtcttttttattcactgaatctcctttgaaagtataaacattagtccttgttctatggttttggaaattgatgactgctattctcaaaggatagtatagttggaatgattgaaggagcagagcaaaaagctgaactgaaacaatggagggaggaaagatagtaccagagacaatgagagaagtgggcagtgattggaagggaatccgaagtagggattggggacttaaaggctgcttagacttgattaataaatgctgtataaatgaaatgctgagacaagggataaaattgcacttgagaagtcacttgaaaatgtgttaatgcctttacttgacaagcatttattttttcatcctgggtataaaaccactgtaggaaaatgtagatcattttttcacactgagtattttttaactgctgattatggttatgttgtcctaaaatcaggtttctattatctgaaaagaaaataaaaagaaataaatataggtgtgtaaagataagtattttggaggcatggatcttcaggtgaagtgtcatgtaatatctttgctaagtcgggataaaaataaaatttaaaactgaaattcatatttaaaaagttcttagtagagtctaggcatttttttttttttagtgtacctaacagtgatgaaaattttgtatctaaaagaatgagggattttgcaagggattttcaggagactgtggcactgtcatggatggtagctataccattttctaacaaagtatgtcaagaaaattgaacatcagtcttcttactagaaaagagaatctgtggcaaattattttattaataacagcaaactgaagagccacaaaataatttagataagaattaaagtgctgaataacttagataagaattaaagtgctgaataatttagataagaattaaagtgctgaaacaattttattactggtaaagctgaattcagaactgcttctggtaattttactgtatcaagcaggccctgagaaagacaacctggaactgtttaaagggagatgttcaacgatggtcacaagatgcaggactcaagagcttccaccattagaaactatcacctttactaccaccaacaaaatacctttttctctgagaaggagtcagtgaagggtagagatgaaataggaaaaatttggttggttgggtgggtagtaagtttaatcattactcttctttaatgagtaatagagtggaaataactttcctctctggttttaaaagttaactaatagtaagtgtctttgttaaaacacgtagacacacacatgcaccacacacacacacacatgcaccacacacacacacacacacacgcacacacaacaactgtttgctacaggatttctaattaatgatatcacattttctaacccagtaattcccaactggggttatttttttcccctaggggacatctgacaatgtctagatacattttttggtagtaatgacttgtattactggtttctcaagggtagagaccagtgattctcctaaattctcctacaacacccagcatatctcctcacaacaaggaattattcagttggaaatttcaagggccctcaggttgataagccctgtaattgcttgaagtaacttaatctccctagtaattgtgcagtatctcatagttattccttcttccactactactccccacaaatttgcccacaaacttgagaatttacataactccaggagtacaatagaaagggacctcacatccaagtgcttgggtactgtgctatcctctggttccttatttgccttcaccactatgatttactattggtaaagttgtggtcatgtcggttctcctggactaccagagcccagaaatcttctcttgttgatggttcacctctgtcttaaagtctactttgtctaatgttaatataactaccccagatttgttttatttttccaatttgtaccttttttttttttttttttgagacaaagtcccactctgtcgcccaggctggaatgcagtggcacaatctcagcttactgcaacctctgtctcctgggttcaagcgattctcatgcctcagccccccaaatagctgggattacaggcacatgccaccatgactggctaatttttgtatttttagtagagatggggtttcaccatgttggccaggctggtcatgaactcctggcctcaagtgatctgcttgccttggcctcccaaagtgctgggattacaggcgtgagccaccatgcccagcctatttctttttcctatatttttgcttttgctttgtaaatacctttgaatatacagtttatctcttctagatacgacataatcatatcatttcaaaaactattctgctaatccttactttttgttagtgtttaattcatttatgtcttatataattactgataaggtagaattgatgcctggtgtttctatgtctttgcttttttattccttcatatctgccttgtttttcattaaataaatattgtctggcatgccattttattaccttgtttcttttgttgtagctttaaaactattttcttagtatctgttctggggaatacaattagcattttactaaaataatctagatcagataaaaattaacttaatagtatacagaaactttgctctaatatgtacctgttacttctttcctccttggctgttattgtcatacaaattacttttatactgtgtaagcccattaacgtggtattataattcttgatttatgtagttgtcttttaatcggatagaagaaaagagttacaacaatattttaatactttcttttgtattttcctttactagtgttctttatttatttgtatagattgaggttaacatctagtgttctttcattttagcttgaaggatccttaacatttttggcagtgcaggactgctagtaagaaattatctcagtttctgtttatccaagaatgtcttattattatttttgtaattttcaaagaatagttttgctgtgtatagaattcttggttgactgtttgtgactggttgactgtctttctccttcagcacattgaatatgtcatcccactgaaaaatgtgaatggcttcacaaatttgcatgtcatctttgcccaaggaccatagtaaccttccctgtatcattcaagttttagatgggtcaccaaagcaagcactctggatctttccatactgcaatagaaatgaggaagacttgggggaacttactatttctctccatataaatcctgcctttgccactttttatctgttttctggactatactgtatagaatacagggtctttctaagaaaacaaaatactttgattttgtgtccagggatccaagtaaaagccctgcttttggggcatctggtggttttctaacagctcctgctctgattgtttccttgtattccagttttctgcctaatcacatgcagaaccattccattcacatagtgaatacatctctcacttgacacagggatcctcatttatgggaaagaaacacaaacctttcatttgaaaaagatattattatgtttgctttatgcagtacataaataaaacttgatgatcactttctcatagccattctcttcacgaatatcattagcattcaatgcagaaattagcctgcagtcttcccctaatgtttgcatgtatcttttttgtgatccaacattttgctattaaatagaatgaattatgtggagacatgattagataataccaagagtataagtttcctgagattagcaatcacacatggtttattttagtcctttgtagaatgttgtgactatctttctatttatgtacacatgtatctatgaagtacttattcatccatccttttattcattagtctagccagtcaactatctattcatctatctgtctgtctatctgtctctaacatatctttttcttcacaggaattcaatttgatgttagcatatgatagttgtctaataaatacatgttaaattaaattcatatgaggaatacagactctagtgtaaactattggcattactgaaatatgggcttgatcattcattgtgtgggtaactaccccatgggtacatacattggatgtttagaaccatcatccccggcatctcaatataagccagtattattctcccaattgtaacaaccaaaaatgtcttcagataacataaaaacatccgtgggggaaaaatccctctcctccaccccagttgagaacagctggtataaaagcatcctttccttcttttatcacagtatgtatgattaaaataaatgttaacaatgactaatagtagggaatttatcagatgaatgaatgcatttacatatgtattttccagatagtcacactctccctcactgattcatccacccatttattattcaacaaacacttactatgtaccaattatccactaagtactttgccaggtagaggggatacattcgtgaaatgtaagtttctgccctgatggggcttacagactttcggtggaactagataaaacaacgaaacaaaagatattactaataagtgttttgtttacaataaggcaggaagttataagggaaagacaggggggctgcatgagattagtggacaaggaaggactttctgaggtgacatttaaggtgagaaatgaataataagaggaaaacaaacaaagatgtgaaaaatttattcattaattttacttatttcttatagcatatgaggtttatgctaggagtgcaaaaggatgatcatttggtggcatatcaacttgcttctctacccatatttgtgaaaaacaccagattgtttgtgtggaagccactgggaactgttccaaaccgtgtgagaagtctgacgttttttattgagggagcatagccctaccaatgtaaaggcgttgttttatgacaatgccgtgaaaactggtaagacattgaaaagcaaaaatgagacatgcagaccttaaaatatcctgtgtgataagaactagtgattgttcactgaaaaagacaaattttagttctatcttcatgacattatatgttgctggggagatggtggtgaccagggaaaactgttcagaggaaaatcctggcctgatacatttaaaagaaagcaggtaaatgcgtattcatctttttttttttttctccaacctcagtagatctaaggacattaatcagaccttgggataattatatatagctgtgctatgagtacgtggattcatttataattccattggtagtagataatgcaattaagtacaaaattctgcagaatctattatatcgttgtttgacgaatcaaataatgtattctgcatttttattctcatgaatatttcccttataaatagatgtctaaaatgaactattttgcatatgcttgccttatgaaagtaggcttatccactggaaatacaaagctgttttaagcatatttgtgtgtttaaacatgcttacgcatgttttcaagcataattgaaataattagaataagtttcattatcacctttcaccttttatgctagatgctggatcaagtcaaaactggaattgcaagtcaaacatcttgatgagatacagaattctgtaaagggaagagatgaattacaaaatacaaccttgtttgaggaagacattatgacagctgggtgacttgggcatttaaatggaatctgatgaagtccctcccaccattttctctataaaatgccaatggcatttaaaagtagtgtcaccagaggagccaatgtatatttttatactgcaattaagcaattgagtacaaaattcagtacagtcagtgggaatgtgatcagatgaataaaggaagtcagagaagataatcatttcagttctttccctaattttgctttctagcctggtacttaaaattcacaggctcacaagtctcactgggctccagagaagaagcctgactcctccccagctgtgtactctcaggcaaactacgtagactctacctcagtttactcaattttaaaattgagatcataattcttgtcttctagaatatttgtgaggattgaatgaaatactatgtataatatgcacattacatagctaatgctcaataaatcataactttatgattagcaatgtttgtttccctcagaagtgacctaaaaccaacaacaacaatatttttattttgctttctatgatcactgctaattatgaaaaaaaaaatgtgcctgccttgatgcttaggaaagaaaaatggttgcaatgagagagaaagcagtgtttccagacttgtgatgactttattcagttttctgcattttgtttctctctggcagttttttttctcctgtcactttcaagattgaacataattacagtaatgaattataaatgaacataatatgtaatgaatataatacataaagtttattacccccattttcataattctgattccaagttagagatccccttccaagataggctccatagcctcctgtgtaagatgtctctgcccaccctaccccagataacaccacccagtttgtctcctgcaaggcacttatcacaacccttaatgttttttgttattcgcagggggtcctgatccatgccccaaaagtgggttcttggatctcgcacaagaaagaatttggggcaagtccatagagtaaagtgaaagcaagtttattaagaaagtagggctgggcatggtggctcatgcctgtaatcccagcactttgggaggccgaagtgagtggatcacctgaggtcaggagatcaagaccagcctggccaacatggtgaaaccccatctctactaaaaatacaaaaattagccaggcatggtgacgcacccctgtaatcccagctacttgggaggctgaggcaggagaaccacttgaacttagtaggcgtaggttgcagtgagccgagattgcgccattgcactccagcctgggtgacagagtgagactttgtctcaaaaaaaaaaaaaaaaaattaaacaaagaaagtaaaggaataaaagaatggctactctatagacagaacagaagcatgagctacccagttgcttatacttattgttacttattgattaatgctaaacaaggggtggattattcatgattttccaggaaagcggtaggcaattcccagaactgagggttctttccctttttagaccatataaggtaactttctgacgttgccatggcatttgtaaactgtcatggcactggtgggagtgtcttttagcgtgctaattagaatataatgagcagtgaggaccaccagaggtcactttcattaccattttggttttggtgggatttggccagcttcttcaccgccacctgttttatcagcaaggtctttatgacctgtatcttgtgccaacctcctatctcatcctctgacttagaatacccatccttctgggaatgcagcccagtaggtctcagccttattttacctaacccccattcaagatggagttgctctggttcaaacgcctctgacattttcatttatacttttcacatatgtatcaacatataatataaaaatttaaaatgtcatatattatatattaatacatattatatttaccatcattagaatgtaaattctagtaggtcagtgaagaaatctgtcttgttcaccactccctctctagacaatagctctgtgccaggtacatgcagacactcaatgtatattgaatgttgaagaacttttcctgcaaaccgtaattgccacctgataggtttacacattcgattgtcttttcacctgctcttatataaatttgtgctgagacacgcaagccatttgatgttgtagttattttttacagtagaggtgctttgggaaagatgattgagatacctccttataatcttagaatccatcctaaaatgtcttctactcagataataaatgccagtctttgatttgatatatttaactctttaggtaatatttacaatacatagaactaactggatttagtaagatgctttaatttactgatagcatgctacttattagtgtgtgccttcaagcatcaaatataccaaaaaaatgatcatttttgttatggtagcagatagatacattgctccactggtgtctttttttgtttttttttttgagatggagtctcactctatcatccagggtggagtgcagtggcacgatctcagttcactgcaacctccgcctcccgggttgaagcgattctcctgcctcagcctcccgagtagctgggactacaggcgtgcgccatcacgccaggctaagttttttgtatttttagtagagatggggttttaccctgttggccaggctggtctcaaactcctgacctcgggcaatctgcccaccttagcctcccaaagtgctgggattacaggcatgagccactatgacccgccttcactggaattctttagctagccttattttacttggattctgattgaaatatgttctcctcagaatacaggatgaaacaaagctaatttaaggtgaccaagtttatacattaagtacaattagtgcatttttcaccagaaagttggtcactactttaagattttaccttcattttcattagaaggtattggttaatctattatctcctctctctaactgcagtcatcatattaaacttttgcaaattttaggtgacaaacacatgtcgaatttacatatatacaggcataatttacatatatgcatatacaatgtacaatatatccagaaggtaattagcaactggttacagtttgctactaatgtacaatatatccagaaggtaattagcaactggttacagtttgctactaatgaggtcaagtttacagatctactgttcctctgagtctgtcttttggctctgttgcattgccacagatcctatcatgatccctgggctgctgtttcacacacgttgtttgtcacaggaggggggccatgaaggaggatgtgattgctcccctgccaaccccctacctctactggtcaaggatctcagcatttttctgacgaatggcatgggcgggatgcgctccatctttgcattctctatgtgtcaggctgtgtccacagggaattgtctgtgaagggtttttaaatcagtgggaccagtaacaccatctttatatagtgaagacagcttatcattaaatatagtttgagacaagcttaattgtgcaactgaaaaatattttcgataatatttacaacttttatctatttagtgttattagatgaagactttatcatttttttccatcatgcctttggttttgtgagcttcttttttgtttttatttcccgatttctttctttcagatacttttaatcaacatttcttcctttggaaaacaggtcaaatgacaatgcgaagggtgatcaaggagaaaatgtgtgaagtagaagcctagaactcaagagaaatgaataatatcttggcatcacttactttgctttaatttcttagttttactcctttaatgtaacaactgtttttcatttaaaagggagtcatgaaacaaacatctatataatattttggggattaaaaatgcatttgcaaagttagatttattggtttttatcttaaagacataaaaacttgatatcatatttaattttgtgctcaaacttaccgataacacattacttaatccttgaaattatttgctttattccctgttgtggattaagatgagtgattttattctgaaaatattaggttgttgtaaaagtaattgtggtttttgccattaataattcacaatatgagagcaattatagaatctagctaaaattatatgtatttatccatctctcattattcatggtagttatcttctataaagtctctgcaaacactgaattagtaaatactgaacaattactcctggtaggtaaataagagcttggttcctgcacgactctggccacatttttgtcaatctatcaatacataatcttattttatatgtatttctgtttaatgatatcttatgtaatacatattgtatgctcattaatacatttatttaatacatattgatttaatacatatcttatttaatacatattttatgctcattaatacatttatttaatacatattgatttaatacatcttatttaatacatattgtatgctcattaatacatttacttaatacatattgatgctcatgtgctttcgagcatcaaatataccaaaaaaatgatcatttttgttatggtagcacatagatacattgctccactggtatctttttttttttttttttttttgagatggagtctcactctatcacccagggtggagtgcagtatactcacagtatactcatagccaatagcaccgtaactcacccctcattgaagcttgttcaacacagtttttttctctgtaaggcatgttatagcctccttgtgcttaagaaaactagggagcacttctgcattatttttaaacagcaagtcattttaaacagcagaatcataaacaaaaaacataaaaatgagaagaactaaatagaccatgaaaaaaccacttgtttatagtaagagaactgaaacatgaaggcagagtttcactttgttcaacctcagctggcaacatgtgtagggggtaactcaaattttgtgattctctgcacatgttggggaaagatcacacaaatattgtgagtattaatttggagtacaaattaatattagcaaatagctgtatttgcaaatatggaatctgtggataatgagaacagacagtatttatattctaggttagaaaagagaaaatgagctccttttagtcatcagaagccaatgaaagacctgggtttagtattttcttccatctcttgatttctgtttgcttaattgaatgacaaattctaattagtcatgcctgactaacataatttaggatgaaactatgtcttcatcactctctacttctgaccctggccctgttcctagagtacagtaggcattcagttaatgcttgttgaaagaatgcataaacccctttcctcatttggaactttatggaattgctgagaacatcagatggcaataaggtgattggagctgtaatcacacacaaaaagttgtctattttaattagccaggtgtggtggcacacacctgtaatcccagctacttgggaggctgaggcaggagaattgcttgaacccgggagacagaggttgtggtgagcagagaatgtaccactgcactccagcttgggcaatagaatgagactctgtctcaaaaaaaaaaaaaagaaagaaagaaaaagaaaaaaagttaaaaccaccaaattgtttattttctattttgaggattttaattttgcttaataacatagtcattgaaattaatttataaataatattgtatagttcaaaacattaatataggacttttttgctgtaaaccagggttgcctgtttaatatttgtatttcattatgagtagtgaactagtatctcttgtaatgcaaggtaaagaggaagaggttggttaacaaaaaggaactatgttaattttgctattaataagggggaaaaccttttgaatttatttatcctggagacacaaaacttaaactcataatgatgtcatatatattagcattactatatttccttattattgcaaatgtattctacccaggtcttttcatcattgtagtcacttaaaaaacatattgggtaagttttattatacaatttttctcagattgattttagttttattttttcttttctcttcttttcttttctttttctttttcttttttttaacctcagaaggaattagatgtccagtataaagaagcctgatcactctggccttacttggctttccaataatagtatttttaggatcactgatataaaacctacaaagtaagtaatttggttcatataagcaggcaagtaataaattttcctatacattgttatttctcattaaatacatactattactctccaaataagagatttttagaggtcattttttttctcatttttttaaaatactgactgacccatatttgcactggtagactcagaagtgtttggtttatacttgttcaaaatgattgtcagcagatgtaatgagccttggaccagtccagtaacttggctaacatatgtctgcagaaggattttaaaatcctgctgactaggctggtcctgtcgagtctcacagcagaaaaattgtcttttgcagctcagcttataaatataacctttgtgtgtttggaaatatcccttctaaggcaggacttatgctcaccctgaaattcaaatgttcattttgatgtcagcactaaccaggagaaagaaaaggtggaaacgattcctcttgcacgtttcagagtgttagaaaccgcctattatttgtgtcttgttctttgctgctctgtacaagctctagaagtcataaaagtgttcctcacaaattgactccttagaaatgctgactctgtgtttcaaatcttataaaaatatctaaatggtagacgtattgttttcattacagatgcattaagtcaaaactgccaaaggctgtgttgtttctgcaaacagggcaactactgcttgaatggggctaatctgtttaggcactgaggggctagctgtgctgtctgcacatatttaatcacaaagctttacttgactttcccacatatttccttttagtatttttacttatggaaagcaagaatcaggttttatagtcattcagtaagtcctctttttaaataaaaattgttatattggaaacagtgtctacaagaccactggtggaaattaatatagccaatataattagtaagttggattcaccacaccacagtaggtaaatcttattgggggcaaaaattgctatcttattcacaagtgtgttgagctgttcttgtattgctataaaggaatacccgagacttagtaatttataaagaaaagaggttagttggctcatggttctgcagtctacaaccatggcaccgctcagcttctggggaagccacagggagcttttactcatggtggaaggtgaagcggaagcaggcacgtcacatggccagagcaggagcaagagggagagagtgggggaggcgccacacgcttctaaacaaccagatctcaagagaactcactatcatggacagcacccagccatgagggatctacccgcatcacccagatacctcctaccaggcaccacctccaaaatcagggagtacgtttcaacaggagatgtggttgagacagatatccaagctgtatcaccaagtgaactaccgaagctttttattgatttgtattaagccaacacatgggtttacccagtaactcatgatttttacacaaaaaccaaattaatgtttatcgaacagttatttggatataaatacatagatatagcacagtgcttcaggttagtttataaaaatcaagtctttcctttaaataataaatgatttatgcattcattcaaatttagaatgctgaggaataaactacaaaaaaaacttgtggctgagtgcagcggctcatgcttgtaatcctagcactttgggaggccgaggtggatggttctcttgaggccaggagtttgagaccagccttgccaacatggggaaaacttgtctctactaaaaatacaaaaaattagccgggcatgatggcaggtgcctgtagtcccagctactctggaggctgtagcacaagaatcgcttcaaccggggaggtgaaggttgcagtgggctgagagatcgagccactgcactccagcctgggccacagagtgacactccatcaaaaaaaattttaaaaaaaccctaattgaatctttccccctgtatttctgagaaaaaggagcaaatataaaataaacaaaaagaatacatatggaacatttatttagaaatcaaagacccagcgtcatacgttctaatgtttgataagatactacccagtttcctgcaactttcacttttgttctgtcaaagattccaaatgatgattgtgagccactgtaacctgaagacatattggatacatttacttatgtgtgttaaattgtgattcttaatgctattttgtggaaaggctggagaagattttttttttttttttgagatggagtcttgctctgtcactcagcctctggggttcaagcaattctcctgcctcagcctcctgagtagctgggattacaggcagttgccaccacacccagctaatttttgaatttttttgtagagacaggcttcactgtgttggccaggttaatctcaaactcctgacttcaggtgacccatccaccttagatttttaaaataaaggttacaggctgggagcagtggctcacacctgtgttctaagcactttgggaggccgaggcaggcagatcggttgagcctaggagttcaagaccagactgggcaacatgacgaaaccctgtctctatacaaaattcaaaaattagctgggtgtggtggcaggcacctgcagtctcggctactcaggagggtgaggttggagaatcacttgagcctgggaggtcgaggatgcagtgagtcatgattacaccactgctctccagtctgggtgacagagcaagactcttgtctcaaaataaataggtacgtacatacctacatacgtactagaatcaagggggttgtttctgagttcattgagttaacgaggaaggtaaattaatcaggaccttcccaagttacccatgtaatattatttaattgtacatgtttaaacaagctcagattacgttgactgtgagtcttaaaacggtaaccacaaacaggttataccaagatccctcacaatgtgtgttgtctgagagaaaaatcttatcattttctttttttccacattcactattgttcctagattatgaaaggtagtcattcactaaacccttctaaaatattccttttttttccaaatatagaattattatattagtaacagtacaggcatgcccataacaaaaaatggaaactaatatagtcaatataattagtaagtttgattcatcacatcccagggtagaatacctcttgaccttcaaaactgcggtcgaccacaattcagattttgagctattcaccagtgagaatgcatggcaatacatgcctaattggcatagttacatgtcattaatttattccttttattcatttaacaaatatttattgaatgtttactatgtgccagacactataatgctgttctaagatagcttatattacttattattgaaattatacttattaaaatggtaataatttgtagagagattaaactttgttttcttgccctccctttctccttctcctcttcctttcttcctttgtttcttttctttctttgcctccttcttttgtgtagccataaacaggagtctactgggtcgtttctgtttgtaaggcacaatctgcctcccaatccccctcccaaaaaaactaacaaaatttagggaaggagctgatttcacatttcttcagagggcctgttagagtgataaaaggcaaaattattttctttacacgaacagtcacagaaccaaaaaggccaaggaagaagccagagagcacatagtatttaattaggagagtttctagtgtcccgaagccacagaagaagcagctgcttaaacattgcttaccctttgactaatggccaaaagcactgaataggagaaggattaacatggataagacttaaataaaagtgatacaatcatcagagcaacaacaaacaaaggcacattaaaaagtaacatgaaatgatgttaagaaagaggtcatggatgcaaaatgataaaatgtttcgttctttggaagtaactctttttttttcttctgttcttagtcatccatctctgtcagagttctcaaataaaaatgcaaaggaaagttagcaccactctaaaacagtgaagggtcagttctctgcttttggatatgtaatttgaatgggaagtgtcctaatgacaattaaacacaattttctaagcacaggaagaggactgataaagtcaagcaatggctgtggcttttcttttgtacttccgttactattaactatatgcaagttaacaaatgctggacagcctgtccagtgagcagggttgctccgttgccaggcttatgttttaagcgacgattgagtgtacacagatctaaacaatcatgtgcaaagtctaagtctctcattttgaattcggaagagagaaccttggtgccccttcttcctgaggaaatttgggaactatagtacaactccctctcaaaaaaaaaatactcctgtaattccatcctaactactgattgctttatatttttgatgtggtgaggagttcagaccccttcttagtgaatgcaatgtttagcacattctttggaatatactgcttgagtctcttggtgcatcagctgaaacttcattttaatatcccgtacgcacttagtagatacttgcctttcctctacattggtgattattcctggcctatcattcagttaagacctatcctccatatacagatttttatatcgttcatcgaaattaagacttgttgcaagtaataaaaactgaactcaagctacctaatacaaatggaatttactattttatataccaaaattctgtgaaaatacaggtgggactggccttagggatacctgatattaggatataaatcctgtcgcctttctctcatgcttttttttcttccctttgtaatcacttctttattatttgtcactgacctcttcatgaatttagaaccacggtcgtcggcactttctaactcatgctttcatagtttcatgaccacagaggaaaagaggctttggaaattctcaaggaatcactgtgactatccacacttgggtcacattttggactcattgcagcagcctgaaggttagatggtatggatgccccagcttaggtcatgagcctgcacttgggaaaaatgaggggaagttatttttaaaatggaaagaagtggaaggcagacattgtatccagttttatatatttatataaacaaaacactgtaagggggaaaatatagacttgaatcagaggagaagagttaaaccaatgtttatatatttctttaggtttgttggaatatatgtgcatgtaattatatcagcaaactacatagtgaagtcagggagacagattagagagataggaagagtgggagggagagaatgtgcaaaacaagcaacagaaagaagagtggggacatcctgagtttgtatgtgaggagaggacagataggagaggtacaaaggaaagggattagaacagagaattagttagaggatggggagataatacaagggagagatagccaggcatggtggtgcgcacctgtagtcccagctgctcgggaggcagaggtgggaggattgcttgagtcggggagatggaggcttcagagagctgtgatcacactactacacttcaacctgtgtgacaaagtgagacctcgtcttaagaaaataaataaaataaaataaatataagggataagtagagagatcatgagagaaaggaacatagagggacacagatgcaagaacagggaaagagaaggggtcagaaaagcgtaatttgtggagagaaaattaaaatgctattattattggtattattgctgcagttgctctcttttgcccattagactattttggcattattggcaggtttaatgtaaaatgagatttgtgagtaacattgatctccaaattataaatgtctttcaataggatatgaacaaatatcatagtaattctcaaagaatattgctatttttaatcaatggagtatacaacatattatattttaaaatcatacaatacttcaaacaccgtgaagagagaacaaagccatatcaaataatgaatgaatggttgtattacggaagtacttgtcctgatagaacacttcaaataccatttggctgctacttctctctgggtttgctttgtatcccatggagatgatctgagcttaagcttttgttagcttcaaagagagctccgttcttgcctcatctctgcagtattgaaaaaacagacccttggttaacaacaggaagccaaactgattttaatattgtgaactctttaccctgatgcaggaaatgttatctgggccatctcagtgggctggggattatagagctggataaggcttcaaaatacaaatgaactccataggtctggtacagctgtaaggtacaggggtagagaatattaggtggtcatcttgataatcatttgtgttatgttaatgcactccaaagtggacttgtttcttctacctgagtgtatatacaaccagtcttttcactattttcagtggttataactcaggaaagagacaacatatcaacatatgaatgtgggtatatccaacgagatctctcttataattttagtccataaataggcataaaaaatgtgttctttcagaaaacacttactggaacctgagataatacaataagtcgaattgctaaaaagagaccccatggatcacaggtctgacctaatatctagttttactaataattttaatggtataggtaatcacatggcatgggtgagccagggagagaggtctttgaccttcagtatagctcgcaaatgctttctttccacataagagcatgcactggacccacaggaaatctctaggtgacatgtgcagtttacattccttgctcaataggagtatttaggtaattaaaatctccatttatattcagatacttgcatagctttttccaggagaccatgcccataaatgcatagatttcaggtttgtttatcataagcagtgctagatagtgagcatttgatagatagggactgtctctaaatgccattaacttgcttgccaggagggtctctcattcatgagtcaaatctcatgtttaataggagatttgactgggctaccttgtttatttccagggagtggtcccttggtgaaaagagagaatgagtggtagacctattatttgaccatattcctcctaaataccttcttggtgatatggatacagagattagcaaaacagtcactgccttcaaatttttttaccatataagatgatgaacacaaaatcaacaccagagataatgtgcctaaacccttaaataacttgtgtgacacagaacaagtatctcaatagacagtaatattttttacgatagtattaacaatgccgtgttaaggtgctataacctggttgaatcttatttggatggtggagtcttagtggacaatggaatttgtacaagttttgagtatacttattctgctgacatttattgagtaacctcccatgtgccagacattatctgacgtgaaatgaaagagaattcctggtttccgtgagtttttagtcttagagaagacacagtcacgtaaataaataattgaaaaatatcataaagtgtttataaaaatctacttgttaagtatgagagtgcagcatacttggcctccagaaatgcagaaagtttcatcaatatacaaattaaatcttgaaggatgagtgaacacttactgggtaaataacaagatgaaagactttaggggaagagaatgagatgggctaagttagcagcatcagtgaacatatggacatgggggtgctgcagattcttaccattggttcccttttggatgttgatctaggaaaatgctggaaaattaggtttgcctcagatgatatattaggccaacaggaatgaatgataataaaaatagctaccaattttgagaaattactatgttccaggtacaatattaggtacacatttttaatattcatgacagattaggaggatgtaacatcttgattttataaataagaatttagttcagcagctagttagatactatgttgggatgtgcctccataactctcttactgcaaacccatccctctccatgaccctgtgtgagctcccctaggcttcgaagcttgcacattgttctcacctgacaggggagcagtgaaacaacactaggaggacaattagtcatcattcagagtgtatatcagtgtgcctctgcgaacacccacaggaaaaaataaatctacgaatagtgagattgctttggaaatacaatatcaaaacaaggtcactgctaccttctctctccattccatcgagattgcagctcctggcacctcttcaacaggaagttgttggccgcctctcccttgaaggttttagtaggagaatgaaaggatcagtattgggtttcagaaagataaattgcttaccaattgatggaaaatggcagcttagagaatctgtggttagagaaaattgtttgaaacttactataatatttcagagatgaagtaataagaagaatctggagtggcaaacatagatcaattgattgaaactaaaactaataagacttgctgtgaccattgaggggacccaagatatcagtttgaatcactacagtgagcagtgaggctacttagatagaaattgccagaaaaagaaaataaatgaacctttggatttactgagtttgtgggggctgaatgctaaagttttttgtttgagttgggggtagcttataggcaggcaggaactggctctgatgcaaacagaggtgatgggatagaagacatggatttgggttctgatgactttgtgagagtgaatgggaaagcacattcaatggcaagaaccttacaaggaggtagggcacaatgtggttaagctataatttttactatatttcttcatttttattggcatccaattattttatatgtactcactatttatttaaacagctttattcatggggtgcctattctgtgcaaggcaatacctttggcaatgacgacatgatgatgagcaaagcctgaatgtttcttactctcctgagtttattgtctagtaagagacaagcatcataagacattacactagtgaatgtataatttgaaactgagataagtgctctcgtgtgaaacatcttatttctaggaaaaaaaaaagtgcaacaaaaaaaagagaaaacccttgtgatatgaaaggtttccgaagaaagtgcagctgtgttaagacctgaaggataagagttgccatctaggcaaaaggtgatgaaagtaaaggattctccagactgatggaaaagttataacaagagattggagtgtttaggaagttaaaagaacatgtaattgaagctcaggagggggaagagagatgagagatgtgtgtagagtccagagcactcagaatttgcagaataataaggattttgatccatgttctgagtaatgacatgccattgaaggtttccattttttaaaaatattaacccagatctcctttacatgagcaatacagataggaagtgctgaggaatcaaagtagaggtagaagggattcagaccccagagtgtctacattaggagggagctgaacctcatcaagttctttccataggattttcttcatgcacaaatatgcatggctggcttagtctgcagaccacatttttggttcacctagtgtttcagatggcagatgacataactctgagtaaattagaagttctggctgtaccaaaaatatatacatcaggaaaatgaaaaaggaaactgttctgtgctgcttaagagaattcattgccaacctcctactggctgttctgacccaataaacaagcaaaagtgacttgttagagccagcagctatattttgagtaccattatccccactgaataattcaacacttaatggtggtgattttggttgctcagagaaggtattcttttgcaattgtgtagctctttgttgagattcagcattgtctagttaacagtatgagaagcaaagcagaattcttgctgtgaaaatcactacttctaaagagatgcggcattgccatatagtagttacattgtgcaattactacatggaaattacttgctgtcttgtagtctttttccggaaagaagacactcttttttattattattatactttaagttctgggttacatgtacagaacatgcagttttgatatataggaatacacatgccgtggtggtttgctgcacccatcaacccatcacctacattagctatttctcctaatggtatccctccccagcaccgcaccgccaacaggccctggtgtgtgatgttcccctccctttatccatgtgttctccttgttcaactcccacttatgcgtgagaatatgtggtgcatggttttctgatcttgtgatagcttgctgagaatgatggtttccagctttatccatgtccctgcaaaggacaagaactcatcctttttatggttgcatagtattccatggtgtatatgtgccacattttcttaatccagtctatcactgatggacatttgggttggttccaagtctttgctattgtgaattgtgccacaataaacatacatgtgcatgtgtctatcgtagaatgatttataattctttgggtatatgcccagtaatgggattgctgggtcaaatggtatttctagttctgcatccttaaggaattgccacactgtcttccacaatggttgaactaatttacactcccaccaacagtgtaaaagcattcctatttttccacaaactctccagcatctgttgtttcctgactttttaaagatggcaattctaactggcatgagatggcatctcattgtggttttgatttgcatttctctaatgaccagtgatgatgagcattttttcatatgtctgttggctgcataaatgtcttcttttgagaaatgtctgttcatatcctttgcccatttgttgatcaggttgtttctttttttcttgtaaatttgtttaagttctttgtagattctggataggtcttcgtcagatggataaattgcaaaaattttctcccaatctgtaggttgcctgttcactctgatgatagtttcttttgctgtgaagaagctctttagtttaattagatcccatttgtcagtgttggcttttgttgccattgcttttagtgttttagacatgaattctttgcccatacctatgttctgaatggtattgcccaggttttcttctagagtttttatggtctaggtcttacgtttaagtctttgacctatcttgagttgatttttgtgtaaggtgtaaggaaggggtccagtttcagttttctgcatatggctaccagttttaccaacaccatttattaaatagggaatctttttcccattgctagtgtgtgtcaggtttgtcaaaaatcagttggttgtagctgcgtggtgttatttctgaggcctccattctgttccactggtctatatatctgttttggtaccagtaccatgctgttttggttactgtagacttgtagtgtagtttgaagttaggtagcgtgatgcctctagctttgttcttcttgcccaggattgttttggatatgcaggctcttttttggttccatatgaagtttaaagtaatttttttccaattctgtgaagaaagtcactggtagcttgatggggatagcattgaatctatacattattttgagcagtatggccattttcacaatattgattcttcctatccatgagcatggaatgcttttctatttgtgtcttctcttgtttccttgagcagtggtttgtagttcttgaagaggcccttcacatcccttgtaagttgtattcctaggcattttattatctcagtagcaattgtgaatgggagttcactcatgatttggctctctgtttgttattggtggataggaatgcttgtgatttttgcacgttgattttgtatcctgaggctttgctgaagttgcttatcagcttaaggagattttgggctgagaagatggggttttctaattatacaatcatgtcaactccaaacagagacaatttgacttcctatttgaatacactttatttctttctcttgcctgattgccctggccggaacttccaatactatgttgaataggagtggtgagagagggcatccttgtcttgtgctggttttcaaagggaatgcttccagtttttgcccattcagtatgatattggttgtgggtttgccataaatagctcttattattttgagatgtgttccattgatacctagtttattgagagattttagcatgaaggggtgttatattttatcaaaggccttttctgtatctattgagataatcatgtggcttttgtcattggttctgtttgtgtgatggattgcatgtattgatttgcatatgttgaaccagccttgcatcccaggtacgaagccaacttcgtacctggtggtaagctttttgatgtgctgctttttgatgtgctgctggattccatttgctagtattttattgaggattttcacatcaatgttcatcagggatattggcctgaatttttgttgttgttgttgtgtttctgccaggttttggtatcaggatgatgctggcctcataaaatgagttagggaggattccctcttttcctgttgtttggaatagtttcagaaggaatggtaccagctcttctttgtacctctggtagaatacggctgtgaatccatctggtcctgggctttattggctggtagattattgattacttcctcgatttcagaacttgttattgttttattcggggatttgacttcttcctggcttagacttgggagggtgtatgtgtccaggaatttatccatttcttctagattttctagtttatttgcatagaggtgtttatagtatcctctgatggtagtttgtatttctgtgggattggtggtgatatcccctttatcattttttactgcatctatttgattcttctctcttttcttctttattagtctggctagcggtctaactattttgttgagtttttcaataaaccagctcctggtttcattgattttttgaagggtttttcgtgtctctatctccttcagttctgctctgatcttagctatttcatgtcttttgctagcttttgaatttgtttgctgtttcttctctagttcttttaattgtgatgttagggtgtcaattttagatctttcctgctttctcttgtgggcatttagtgctataaatttccctctaaacactgctttaaatggaaagaagacactccttaaatgacttggtgggagcttttattttatcaatttctctctgataaattatactggtagtcatatctggtcacggataaactttatttcgtttttgactgtcaggcatgttgaattcaaattgcatgccaaaccataacatttaggaaaacatcatatctctagagttataattgatttgtgctaatgatatgttagtagaaaagaatgacagtttgatttctttcattcaaaggaaaatctctacagtaaggaagaaagtatcatggctaaaagtcacttttatttaatctcaggttttatcaaaatatttacagaacactttgtctttgtcacctgctagtcattcagtatatttcaatgacgacagtattatctttggaatcacaaaaatatgatgtaaaagaaaacttttctagagtagagtgaatgcttaaaaatataatatatatccaataaatgaattacagttaggaatgttgacatgattaagaacgcttgcattactgatagtgacctctgccctattataactttatagctaaaaagtttaagatctttcacagtttctccttcagtaatcctttttccaaactgaatttcgagtgcctagtaacttgtgatttttctaggaaaaacccatggtctttacctgtttgttctatagataacaccctataacttgcttttttcacttaacaaaaaataatagatatatcatttatataacagatataaggcatactatacattatatataatataaatgtacatataaataaaaataaatataaatgtctggaagtgttcatatcttaaatgttttctggcagggatggggagaagagggttgtataatcttcaaatttttactgaatacgttcctttgccattattttctgttacaataagaatatattttattgtaaaataagtaaaaacaaattaattaaaaatggtacgtgatgataaaaacagtagttcttagaaatattatcaatattggaatcaaaacacataagactattaaacatgtgtatttaagtaaactgcacattatatccagaaaattgaatctaactggttatcatgcaaatgaagaaggtaatcagttcaaaaatgacatagtaactgatattgccttcctgttcttatttcttattcatggaaaacgaggacaagatatgaagggtttagggatctaggtcattggcccgggatttggcattaattcttctcatacaagcacagggaacgatcaatcagtgttgacagctctaatgccatcgttggagcagaagatgagccaaaggaaattatgagtttcttataaatgtgtcttaagtatctggaaatcatactttgtatcttatggcttgaatagaatacgtttgcttttaatgatttgtacagtgagaagattaaaatttctaccaacatatccaaagcactgatacatctattaaactgtttgcaacaaaaatacctatacctttttgaatttgaataaaaaatcccatttaaacaaccactgggatgtgattatgccccaaatctctctgattatagttggtttgctttattatattccacttgaaaattttgaattgacaagagggatgtttctgtgaactacagattttagaggaaaataagactaaagttttttgtatcactgtttggtgtttagcatttttcaaccagtaaattgtctttaaccaaaaaatttgtctcagagaatggaaaaagaaatgtgatgacaaaaaaaataatgcaaaaaataaacagttatgaaacagtatagagataaaaaaatcaaaggtgagatatcccaaaccatgaactatttatcttaatcatgcagccttttcatctctgaaagaatctattaatgtcatattcaaatgcttaatgttcactagcagttgataattatgatgaccatccctgtcactacaagatccttaagtgccttttgatgagcaaagaaaaataaaatcatattcaagtaccaactgttggaattcgtactttaaatacaacctgagaaatggccttaggttaaggctaatggtgtataacttgctcacatttctaaagagtatattttctgacaatgattccatatagaaagtttaccgcagataatagtttcttcatatttgcatcctgacctaatttttggtcattaggttactttttataggtatcaatattttccaagtcctagagaaaaatgagagttttaattttctcttataacctagctaccagatgctatgtggcaaggacagtcttaggatgaaattgtccagacaaacaaatatgtattagccatcaaatgtacacatatgctcataagtatgtgtacacatgcacaagcatgcatttacacacacaaacgtacacttcacagaattataccctgtattctgtcagcttgatggagtcccagctgttaaacctttgaggcattgtgacagaaatctgcaagaaagcttcactagaggcagatgagataatattctagctgcaggattcagctacattttcgattggagtcataggaaaaaacactcattgcaaaaatgaatgaaatcctaagcctggagtgcaatgaaattgtgtttaggctgtggggctcccttgattttttaatatcctattcactcaaggatgcttgtgtctgagcaaacatttctagcaaatccaccaatatatacaacactacttgtttttttttaatggaacattctgctaacatcgactatagtgattaagccatacttacacacttaacatactttacgaaataaagatacctgaagtacatgtagtaaccagtgctgctacatttgactagagatttagaagagttttgtttaagaccttttgaatattgactgactatacttatggggtacattaaaattcagtagcctctacattaccacacagcctatgctaaagtattttaaagtaaatttcagaaaagttaatgatttgtttttgttgacacttttaagaaccactaaaacctatgaatatggttggccttaagtagacactgtaaaatgaatgaggttgagagatattcatttaaagttctattagcctttatggaattattgtgagaagcccagcaatgttcagctcagtgttttacattcagatccatatttactttaacgagtatttcagaaagtttaatttctgagttgtctttggatgaatgagaaaataaaaggaattcagaattttatcaaccgtctatatctatgcagattatattcttttgtggacatatgtatgaaattcattcgttcatccagaaggatttattatgtgtatttcctatattctaggcaagcgcaaaaataatgaataggatctggcaactgcctcataaaatgtacagtctcctacaaatatgtagacaaggcaggtacaaaaaattgtgagcccttgtttattttagttttataagtaatgtgctcactactgatatccacctgaacaatttgattaacacaaaaaactggagaagtagattaaaaccatccaaaacattgggagatatagatagacagctgatagatagatagataatcatataaacatagatagtcatataaacatagggagattatatatatagataatatctatattatagaacatatatatgttataataatatgcaatgatatctatattatataatatatatactagaatgataaacaccgttattaggtgagctgagacaggaaggaggcgcgttggtttgcctctccagaccttgatctggctcagatggagctccagttccttgcactctagcacgtgtagccctctgctcagcacggccccatccttatgcgatgcacgacagaagctcgccctgctggaactgctcctccagaagactgctgtttgcggcattcattttcctttcattatatttttttctgaatttgttctggatcgttttttgtttaaaatctcttcctcctcaggagtccgctgggcccccttcttgtggcccggacggtgcacagtggagctcgcactgctgttgccaaggtgcgcggccggcagctcctcgccagggccccggtgcaggccggctggctgtgggtcacacgcagacaagatcagcgaccctcgttttgcgagtgcaacactcccagccacagaagttcccgggtccagcctcagagcccagtatttcccacggcctccccacacacaccccgcgtggatgcggcgagggcccgccttagtcctggcagtgcgcaccccagctcagactcccgcttcttgtggcagctccttctcttgcccctgtgccttctgctgcttgtgccagttgtcgtgagagatgcccggtgctgggcgctggttggaaagaaaaacttaggtatatattttctttttctttccttccttccttccttcctccttccttccttgctttctctcttttcttcctctttctttctctttctttcttttctctttctttctttcttattccttctctctctctctctttctttctttttctccttcctcttccttccttctttccttccttccttcctttttttgaaacggtctcactctgttgcccaggcagaatcatagctcactctagcccgaaactctggggctcaagcaatcctccaaccttggcctcctgagaagctgggagtataggcacgtaccctatgccttgctaatttaaaaaaagaaaatctttgtagagatggggcctcactatgttgcccaaactggtcttgaactcctggccttaggtgatcctccagcctcagtttctcaaagtgctaggaatacaagcatgaggcactgcacttgatcctatgtttttctaattagttttctacttttaaatgtaactgtaagttgtaatcaaacattatatatattatcctttaaaaaattctgaatttattgttatggttaaatttttatcattagtttccagactcaatgagagtcatttttctattaatggaaaataagggacagacctttcagcttacctggaagtgcctcatttcttttttgaaaattcctgccatggtactgatcaatgttgatatatatgtgaaaaaaataaagaggagacaaacagaggggatggtatttaataacaagagaatagtagagaaggagagaagacagttttaaaaatgagcattcatgggttgggcacagtggctagcactttgggaggtcgaggtgggaggatcatttaaggccaggagtttgggaacagcctggacagcatagtgagacccctatctctataattttttttttaattagctgcatgtggtggcggatgcctatagtatcccagctactagagaggctgaggcaggatgctcacttgagccaagagtttaagactgagtgatttcaccactgctgttatcagtctgctgtgattttaggtgtccaaggtgggagtgagtgatgaaaatctgaaaaagaattaagaggatgttctctttaatttacaaatatatttttgaagttgattttttgttatagcttagaaatctgtcatatattattattgcttcctctcacatattgcagtttttctttccaggaagatttcattttttagtgttgttttaggttcacagcaaaattgggcagaacgtgcagaaatttctctcatactaccggttctgcatatgcacagcctctccgttatcaacaccaccagcagtgtgcatttgttacaactgatgaacctacattgacatatcaataacgccccaaatctatagtttacattcgggtttcttttggtgtatacattctacgggttttgacaaaggtatagtgacacatatccacaattgtagtatcatacaaagtagtttcactgccgtaaaaatcctgtcctcctattcattccctcttctcccttaacccctcacaaccacttatctttttactttctcaatagttttgccttttccagagtgtcgtgtagttagaatcaaacagtatctggtgttttcaaattggcctgttcacttaatgtgcctttaggtttccttcacctcttttcatggctgatagctcatttctttttaccactgatattccattgtctggacacagtatagtttatttatccatttacctaccaaagaatatcttggtgactttcaaattttgataaatataaataaagctgttaaacatccatgtacaagttttttgtggacataagttttcaactcctttgggtaaaaaccaaagagttcaatggctggatcacatgtgagagtttgtttagttttgggggaagccatcaaactgtactccattgtgactgcttcaatagtaatgcatatactatatccacaatttattgaccacacaacttttttttttttttttttacccagcatactatagcatcagtatctgtcacagtgagggtttgcacttttcaggtagggctgttcttccttgggcaggactgtgctgagccctgcaggtcgtttattatccacggctcctgcccactggatgcaaatagcactgcccagtcatgtgacaaccccagctgctcccacataatccaaatatcacctggaggagagatagcaccttggttgtaatccaaaaggctagaggaacacaaacaggtcttaccctcttatgagctggccatgtgggatgctccaggagtgaagctagtggaatgtttttagtgactgaaagtccttaagaaatgtgaaaagtggttacctggatttatacatatgtaaaagtttgctgagctgtacacttaagttttgtgcattttagtacatctgagatttttatttaatttgaaaaatagtccctacaggaatttcacagctatataagttgttttctgagaaataactcagaaaataacttaatgttgggattattctccatccctgtagtcaaatgaccatgaatttccgtaattttctttcttagtctccactgtgaaacaatttgaattagatgtcattacagtatactattttttaagaatcttacatgtataggtgggaaaacaaaaacatgtatatacataagtttttatataacctgtatgtatatataggttatattcaattatattccagttagagttcaaccacagtaatttgctatttaaataaatgatattattaatgatattagtttatcccacatcattattaactaaagctgacattttcccaataaaatcaatttgcttataataacatcgacattcctttgatctactgtgtacaaaatgtgccagctctgcagggatgatgagttaacactctaagcagttcttttgtcgtgtcactgcggtgttatgagacatgaaagagtgtttgaatggatatggctataatgcacagtgtttcctttgttttcagagtaaaagccattaacagttatttcaggattactgtgtttatgacacttgtaaattgatttatggtattagccaggcaggtgattgaacaaaagccttttaatgtttgtgtatgtgtttatccttctcagcttcacaatgttgagtgattcagatcacacttcaggcttatggaaatttgctggacctcctccccataagaactgattccaaaccaggggaatagtttaacctagcctgataatcacataaaaaggagtttcataaagggacacttgaggtcagagagaagtgaaggtgacatccactccatcatgaaaatgtcaaatggctttatataagacatcttgcttgatgcagctcagtgattcttaagccattttatcatggagagaaaagaaaatttaaacatttccgagttatagcactgtctcagactattatacaaatccattgagttatttttaaaactataatttggatgccagtgtcataaaatatctcttcctgctggctataataaaagttgttgatctatttcaagcatcctgagtagaaaaatgttgtttaatgattttgcatgcatgaagttaatttctacctctggaactcatagtagctgaaacaacttaatgctgtttcttagtgaagaggaatgtcaacgtagcatgcttttttttcccttcttttttggctgtgtgcattccatgttgtcaatgaaaatggcagatggactgtcactgacatttctgctttgtgtagttgctgccatagaaatgaaaaagtttttaaaatggtgacgataagagtcaccttttgttcactgaatttgctgtgttatattttcttcttggaaatttgacctaaaactgtttgtgaataattattcagaaaaaatgtcaaggatttttaaaaatcactaaaataaaatgtgctatgtcaaaccagctgcctttctaagctgctttttgcccatgtatcacactcatcagattctatttccctctaggataaagtagaaacctctttttttaaattccagcatataaatttgaataatgttatttgcaaaagggaaaatcgaagcatttactattcattagagccattagagaaccatagtgccaaaggttttgtgtaaacatgacatcatgactgttaggtgaaaaaaacaagtgattattaggaaatgattattattcagagtacattaacaatagccttgggtctttaaagtaattttaaaataatttgttttagtgttcagtttataatggtggaatgatctataattgtccaaagtgaaaacttagtcttaaccatttgtatgcattgttgcctttctatgctttattattggaatttaaacagtctccagtggaaacataatgcaaagttggtgaattaaggatcaaagcattaaagaaaaatgaacaggcatcatgtatactaacagctaccaagacttaaatgatggtgtactataaaatgggcttacattttctttaggtgggctataactttcaaaactcttaaaccaagaaagaaaaagcaatgagttacattagttgcttaaactaaatatgcagaacatacacactgatgtttaaagaaaccccacattttctcatcttgttccaatagaagaggtgcagacagtatggtagctttaagaaagtctttttttctgtttgttttttatttttattttagatgtatggcagcaggcattctcaagattttgtctaccttttgcctaaagaatctccttactgctgttgaaatattttaggctgatttctgatttccaaagactgaataaacattaaaaatgtttccattaggaaaatgttaaaatgcacccccaatagaaagattagcataacctccccccaatcttgcactctctctctttctctctctctctctatgtgtatatatatatatatatatatatatatatatatatatatatctgcttcagcaatattcattattgcatcaatttgtttattctatctcttctacctaaattagctatttctaccttgaaaaccatcccaaaacactgattcaataaaggaaacatttattattgttcctaagtctactgtttctttgggagattctgctgaacttagccagtcttgactgatactgaccagctggttctagcatctgtgttcagctgacaggttagtagggcagtctcatctaggatggctgccattttacgtttagtggctggctggctgttggccaggatgatggggatgatgggcaaaatgtctcttatcttccaacagggtagtgcaggcttctttttaaaatagctgagcagagttttcagagacagagagaaagaggaaaaaggtgcaaggcttcttgaggcctagactagaattcatcctagggtcaaaagcctaccagattcaagaagtgaggaaatagcttcttaggaggagctacaaagtcttattacagagagtgtgaccacaaagaggggaagagaatcagagaagattttgcaatcaatctactacactctcacacttttggggagagtattttatatcaatcaatatcatttcaccactatatactttagagaatttgcctttattttgtaagttgttatgattttgtaactctaatagcatccacaaagttaaccatgctccttggatcagaatattagtaggagggactatatcctcattgccactatcaacacaatgatcatcactttcactagtattagcaaattttatttatttttctctgctaatgacacattacctcacttaaatctcataagtgtgctatacagcagcaactatcaccccagtttgtacagctgagtgagcaggctgggtaaactgcccacagccatctagcaatggtggctttgaacccaggtcatactaactttcccatggtctcatcactgcacatcactttgtcatgtgaccagtcaggaggccacagtagctttgcacttacttgggaggccaagtagaatggacaaagacttagccatctctctcctccatttctcaaggaataatatgaatttaaattaagggagcaagttgtttctagatttgccaccatggagcacttttaaaaacatcaaggggatctatgtggtcactttataatactcatgatgtgtatgttagaggcttctgttttgaagaggcaaagaattttatttcctttttgttgtgttggaagttgccctaggaggtacgcacgcttgtccatgttaaactaatgtcttgaaatcagtgtattcttaattcttatcccactagtcgtactggagaacctgagggagtcaggaaggttccattgcattgaagcgactgcattgtctggggtaaatacctggggttcattgtctcatgtcaagaaaatttagaacatggacacatatgaggagtttagaagcagaggtttaataggcaaaagaaagagaaagaaagataaaggaaaacaactctctctctagtgagagagaggggcttcccagaggaaaaggctggcctgctgcggatgcactatattttatagacaggcttgaggaggtggtgtctgatttatgcagggcccacagattggttcgatcaggtgtgacgtttacatagtgtgcagaaaaggcttgccaccctactcttattaccctaatcttatgtgaatgggctttccagttgaccggtgccatcttgtctgctccttactgtacatgtggctgggaagggaagatggagccaccatttttgaacatgattggcacaactgccagggtctatgtctgcagctctattttacaggttgctctttgttagaaaataatttgggggctgcatttcattgaaaaggaaaaccttaccgaggactctagtaccctcactatctgcctaagtaatttcttcttaactcctatgtcagtaagatgtgacagtaagatatgtattatgttggtgcaaaagttattgtggcttttgatggcaaaaaccacaataacttttgcaccaagctaaatttttcttttgaagtggttggcagggatgttttttttcctaaggatgagctacgatcgtaggaattaaaatttaacccagtttacccagattcataaaaattaatagatttctttgtggatctgagttgatatcattaatataagctatcagacatcagcttcatgtgacttaacttcaaaaatattttagtaagagtatgactggaatgtttataacacaaagaaatgataaatgcttcaggtgatggataccccaattaccctgatgtaattattccacattgtatgcctgtatcaaaacatctcatgtaccctataaatactagatactcatagaaagtaaaaattttaaaaaaattagttcttgtcttagtgccagctccatcctgagtttcaacaattgctattatctttgaggtctagcatgaggcattaaatgccattgtttcaagaaagataaatgggaatataattttattgctatcttactgttgcaaaatggaattcctaagaaacataccctttatgaattctggcaatgaaactaagactgactttccgttttcaatctgaaagctattttggagctttcatcgtcagctaatggagtcttacttgaacggggtcacatttaaacttctaataatttttatgttgtagcctgtgaacatacaaatttcaggtaaattgaagctaattcctgcaggaggtaaggtcatatgtagaattagtcattattcatattctgaaaagtgatgatgtcattatgggagagaatttcttgggtcaagaccatgcatttaaaacgattaaaattcaaaaaatgggatcaccattactgaataattagtatctataagctactttactaaaattagagaccagtgaacttactgccctaagtcaagagattaatggaaattgagagtgttctcacttatttggctatctagttattcttgttccctatttcagaggtgagatgatgttaaatattaatctggaaatacgatctcctagtagcataatacttgggaaagtcttgctccttacaaataaaaggcaactcataaaacacatacatgagatgctcttaaagccatcagcattgaaaactaatggaaccgagtattaaataataactagattgcaagtaaagattgatatataataaacaatgactttagatgactattaccaaactgtttcagaaaaaaaaaaaaacaggaaaaagaaaattcgaaggggcagggcattgatattttcctcaaaattttcatattaataatagctacatggtttaatgtctcccaactttgtacaaatacgtaggactcaccttttgtagttaaggcagtattttgctttttataatgaaagcatttttccatgttttatttcattgattaggataactcatttcatcagaagagtagtgtcaattaacatagtgacacattgaacatatatgttaaatttaccagtagaagttaaattacaagtataagttatttgtcattagaaaatattctgaagcatacatgagtcattttttccaattcccattttaagatgggtcagttgaggtcagccagagtagaataatgccattactctaattcaggacaaagattcacaacttttttggaggtgggagggtagtattttcttttatgattaatataattttgttctcaaagtaaagcataaacagtgttgctgttccttaagactgctaaaactgtgaaacaacagccattagttactactttaaattttaccaatcggtacatatatacaaaagatacaggtctataatatcttaagatgcaatttaaagtgaaataataaagcggaaatacttagaatttaatgtaagtttaaagactttactatctctgtgttagctaacttttttcaccagttctaagtgaacacatagagtaattgatttttagaaaacaaaacaaaattacatacctgaaagactaattctcacattttggagcaaattattgtattattacctgcaagaatacatgatagacaatgtataaacaatgtttagacatctattaacacaatgtttcagaaaaaaattgaaattgtaagagaaagtaaaaaaaattaaaaccttaattcttattctatttctgtaaactttgaaatgaataaatattctgtttaaatgagaagcatcttacgcctttgtcttctgcttgaaccaaactcacatttgtaaatttcagttaaaatggtggcctttattcttttgttctttattatttctttcctctatcttgctggaactatccatcttctattagtgtgaaaactttgaagatgaaaagctatttcaccggaaaaatcattgatgtatttgtgatccttaataatgactcaaatgggaatagatatctaatatgaggaactgagtaaaaaagaaccactttttaaataaaattaactaaatgaagttattgtcttagccattaacactcatcagtcatatacaccatggaatactacacagccatataaagaacaaaattgtgtccttgcagcaacatggatgcacctggaggtcattattctaagcaaattaactcaggaccagaaaaccaaataccacatgttctcatttagaagtggaagtccaacactgaatacacacggacataaagataagaataatagaatattatggacataaagataagaataatagaatattatggacataaagataagaataatagaataattgtggactactagatgggggagggtaagaaggagtgaggattgaaaaactacctatcgggtgctatgctcattacctgagtgatggaatcatgtatacaccaagattcagtggcactcaatttacctatgtaacaaacctgcaaagttacctcctgaatctaaaatagaagttgagaataaaaaagaaaaaccactcatgtgtataatatcataccttccaagtaaaacttcctctgacttaggattttttggaatagtctgtggtttacaatagagtatatattcgctgtcctttattttacatacaaagaggaaaaactaatttcattcatgcggagttatgagagaacagtttcataaggaggaaacatactgccaaaccaaaaaaaaaaaaaaaaaaagaaggtatttaatttgttctgttgaaattttagagtttgtgaactaacatgttattctgtttgtgtttttagtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcaggtaaagttaaaacattcagtgcctattaatggaatttcatatttgcattttgatttttaagtagaatacttatggattgaggatgtgacttttctaccatatttctatatattctttagcaatctgtcatgagaattcatatctatctttttcgttttgtgggtggctgatacatgactgctgtaattattttgcaacccaggcttttagttccttatgcaaacttagaacataacaagaatagtaacctatagataagctagtatttttccatatgtcttggattatctgcaatattaccaacaacttcacttttgtatacttaggttagttaatcaagattcagaaattactggcattcaacaaattatgtcgaaaaggaattggatgaactttgtattctttttcaaaatgattatatttaagaatgaaaacaatgaattagcaaaacaataagccattttacaagtaaaagtataagatgatatgaactctcaaaatttacggcattatatagtgtgaattcatattaagaggttaaacagtagtctgatggaaatatataaatatatattctaacatatattggtaaaatggatgcagatttttagccattataaatcagtttgaacgaaccatggtaattaatagttaaaaaaatagatcagcatcagcaggacatggtgacacatgactgtagtcccacctatttaggagtctgaggcaggaggattgcctgagcccaggagttcaagactatagtgtgcaatgatcacacctgcgaatagacattgcacgccaacctggacaatatagtgagactttgtttttttaaaaaaataaaaactaaaaaaatctgcaaacagaacatatgtaatagtatatcaagtctgccatgtatagatcttgcagatttttcttgtattacatgcatatgggttctaaaagacccacgagaggttattaagacatttttatccgtatcattcaggaataatctctattgcatcttctgtatataatttggagggttattatattagaggtgttggttgtttattagaattttagcattgcaggtgatatttgtggattttctaaattctagagaaataatcttgagctcataaaatttaatacatcttagaaaagtgttgggacttaactaaaacgttgcttttgaagtgctcagacagactgaatgtcaatagaaaggaaacaactctctgactatctataatataatgtatttaaaaactattctaagggccaccttaaattacttgatgtacctattttatattatgcactttggaaagaactgaaattgtagttccatccccccaggtagaaatcccttctctattatttttaacagataagtaagctctgttttgacatttccatttcttaagaaattccacttatctgacctacaaatatacagacttaaagtctgctttacatttggctgaaatctttcggcctacacaatgtattagatttcttcactgaccagcctttttgtagaaattctggtcgggagtctaaagtaccttcatctttagtgaattcttttgctttgagtatgcagtagcaagttaagagcaagcttcttggtaatcctgtggaaaaatgttaataatttcacattgtcttccgaatagcaacgaagatgccactgagattactgattcagatttttgaccataatctctggcatacacatttattcttcatcatttcttactttgtcagtggtgaaggatgtgaaattttgtattaattcctggcccacatttttattctggttgtctcagttacttatgcattttcatgctgtaaggtccttagacaacaattgttataaaatattaatggcatattttcagaacatctgaatattattcatttatttcagggctctagagcactcacaaataaatgcaactaaggcagatatccaatttgaatgtcaaggagtctggtgtctctgtaattggcttaattatagaggaaaggatttataatgtagaatatatattcttataaacacccaaaggttattagctccgttccccaaataattagttattgctgagcctttacaaccttagcaaatttaggaaagaataatgttctaataaacaagttgttcacaagttattagctgatatctaagggactgtggccactgtgtatcatccctcaccgtttataactgcaataaaatttaaataatatgaatttgcaataagctcaagtcctgctctacacagaaatagtagtagtcagaaacaaagtaaatgtgaatgaaaatacagacattttgcatgttggtttatgaatatccagtagataaacactgaacttgagctaatatccataacctggtaaaactcacttatcagatttatcgggcaataatgaaaaattaaaaaaatagaattaatagaaaaaaattagagtttggaaaggcatttagtttttattctactctggctgtcaatgctcaaaatgtggtttccagaattcttggggtcccagggacacatccagatggtctgtgagattaaactgtttttatcataaacctaagacgccattttttcattttcactgcgttgtcatttgctctgatgatacaaaagtaatgagggctgggcgtggtgtctcatgcctgtaattgcggcactttgggaggcttgaggtcaggagttcaagaccagcctggcaaatgtaatgagacctcatctctaaattatatatatatataaaatatatatatatatatatatatataattatatatatatatataaaacgaatagctgggtgtggtggcttatacctgtagtcctagctacttgggaggctgaggcagtaggatcatttgagcccaggaggttgaggctgcagtgagccatgatcatgccactacattccagcctggcactggcatcaaatttactggtagtcaggtgatatttaatgtccatatactcagagtaaaaaactctcaaaacaaagcaaaacaaaaacagttttgcttatgattataattgttgaagcacttaaaaattattaatgttattaattatctaccttggaatacatactttctaacattctagtgaactgggaagtagatataaaataattctgctatgcgtcaaagtattatgacaatctctatttcttaattgcatcattgcttgagtcctgagctggacatcatctttactttaaagttatgactgacaaattatggttgttcagatagatataggtcagatattttcctgaaagtgaaccaagtgagcccattcatttcaagataaacaactgaccatatataaggtcattgattaaatgtgagtgttcaagaaaacattagaattgtggaggacatgtattgtccactgtaagcttgagagcttcccgatacttaatactgctgattagatcagtggcaattctaacaagtgtcaatttttgatattctataatgaaatgcatcaatgtttggaagacacaaaattcagtgagcgggtattttttccaaatgaaagctccatgatgttacaaaatcatttgtagattaaaaaaagtaaaatggtttaatggtacacagtatgaaaagttgattgatagggtttagatttcacatttcaatgaatgtttaaaaaactacacttgtatctacaatcatcagaaaggactctaaaatttcccatcattttttaactacgttatctgtgtacggctggattttctttatatctttgaacaaatcaaccctatttcaacagatgaaatgcagaagcagataaaagaatccatctgccttctcaagaaattgcagagatggcctttagttctagccactcgaaaggctgaggcgggaggattacttgagcttgggatttctaggctgcagtgagcaatgatcctgccactgcactgcagcctgcatgagtgagcaagaccctgactcaaagaattaagaaaaaagcaattacagagatttgcaatcatgtaaagtaatgcccttcttctcataatatttaaaggttttcataaaatatgtgatttactttaacattgaattattttaaataaattcataagtaaacattttgaaagacattttgaaagactttttcagtttttattcctgttatagtaaatattgttagctataccccacatgaacaaatgctctttgagatgtcttgtaatttgtaagactgcaaaagagtcctgagaccaacacgttgagaacaatttatctaggctaaatccttaatattacaaatgagaaaacagagagtggttcagggcctggtccaatgtcacaggttttagggcctcatttgcaactctactgtggaatagtacttatttaagttaggctctgtgcctgtctccaaattgcttttctcatactttatttgccaaagtcaggtccctgctgcgaaacagttttcatttccttgtgaatcaaccctgtctttttattagagattctaagaactgtactaaaactgggatgtctccttttgaaaaatattgagtgctcatcagcagtagatctttacacacttcatgatctatgttttatttcaaagcttaatccaagttgtatttccagcattagtaaatttattttatagttgtaattctcagaaatgtaatctcgctgctctactaggtgagaggcaaaatcacttcctactttatttatttatttatttatttatttatttatttatttatttttacttttatgaaagagtctcactctgtcacccaggctcaagcgcagtggcttgatcacacctcacaacagcttcaacctcctggtctcaaaattaatccagttaatttttacatttttttgtagggataagagtctccctatgttacccaggttgttcttgaactcctgggcttaagtgaccttcccacctcagccacccaaagtgttgggattacaggtgtgaggcaccaagtgtggcccactccctactttttaaaattgtgtttgtcttgtagattacttatcaaacactaacagagtttgtcacaagaggaggggatatttgaatatgaagaatctattaatgccattatgcatcagttattattatataataatggttattagtaagttaaattctctaaggaaacagaacaaaacttccaatagataagtgagaaaaggttataaaatgaaaacataaatgaggaataacaaacactaaacaagcccatgaaagaacatttattacccaaaaaaaaaaagaaaattaaaataaagggaataaggagtttatattttcctttgtaataaatgctaaactattttattattttgaaatgttagcattcactggtggcaaaaatatagagaaccactctatttttgttatttgtgtatatattctgtggtgaaatgatatttacaatttacccagagtaattaccacttgtgtccatgcctggaaatttatcataaatcagtaattcaaaaaaggaaaaatctatttactcaaaattcctattgaaatagtttacctggaaagaaaaaaaatggataataatctaatgaccagtaatagaattattaaaaattatagcatatcagtgggaagaaataatgtaaaagcagtacattaattataatgtgtttatagaaacacggaagattacaaacagaactttcaaagtgactgaactaagtaaaaatgcatatgcatgctaacatagattgaatgccaataattttaataatatatatttttaaattgtgatgacatagcaacttttcttctgctataaaaatcattaaattattctgggtttaaataaaatgaacatatattaaaacatgaaatgatggcagtgaagtgtattccttagaagtaagtacatgttgcaaagagagagtgagatttattctgattttcacttttgtatcatcctttcacttatcagtatacaaaagaggtttaaagtgttttcgctatagattaaccttgcctgctgtttgaatagtgtgtttttaagtacatattttaatatttagttcaacaggttccaacaatcataaaacagtcaaaagtccaagttgcctttcccttcgatgagtattttcaaattgaatgtgaagctaaaggaaatccagaaccaacgtgagtattgtttcaaacgaagtggttctttaaatgcgtgctgttctttatgctgctctttactcttaccatcacaagcctgttggactatgaatccacgcatgattaaagctaagggtttacaaaaaatcatatccatgcaaacaaaaaaaaaatttggttatttcacatatgtttttctgccacttgaatttattttgaccataaactaagggctgttattaaaatacttagagtagtctttggtacagcagaaatactccacaatcccttagtctacaaataaataaggtagctgaaaactagaagatcctttattctacttagtaaaatgtagcatttattaagtcaaagtttgtaaataccattctatacatatttataattgtgcgtctttaaatttaaacatcttattttgtggataggttgttacttgattttttttaagttgtcatagaaatattgtcatctcaggtggcagagtactattgcatgatatactactatctagtattattttattttagaattaaataattgttattctaggtgaccataatcactgatgagctttttcaaaataccttctatgtttggggaggaagaaaaaaatgtggatgtattggaagtgagaagggagaggctgtgggaagaattcccaatattaaaactctacgtgattctaaaatggaaagcaaagctacatacttttattattctgcatgattatcttatattcattaagaatatccatatttaatgaaaattgatgattttcaattgtatcatgactattattattgcctgatgggttgatatttaataatcattagtgacccattaacatgctaaattataattatttctatgtttaaccaaatggaatatattcaatcaaaatatgtaagtatggatagaattacaatggaattaaggataatttattcaatcaatatggatatattgatcaatatcatgatatattaatattaattagctgaattattatgtcaaaaggtaataccatacacttgtcaacagtgaaatataagacacacagagagaagtaaaataagtcaggagggtggctgggtaggcctactcctaatgagaatacatgtccattgaaggtttgttattcctgttggaagaataatcacatagattagtgtaagaatatggcgtcctgaaatatacccaaatttgcatgggtaattccaatatacaatgctgaatacaatctaattgggaagtcattgtttgtctatcagactgataaagatttaaagagacttcttaatgtcattgttcatagaactgacactctagcatactggggtgggaatttaactgtgtacattttttttctagaatataattttgcaacatttatcaaatactataaaaagtttttaattattggtttattaatcttatttctaaggaactggcatattgaaatatttggacaagtaccaaagaataaatatatagggttgtttctcacaatattgttcataaaaggaaaaacattgaaatggttaaaagtaattaaattagtaaccatatgacagaagataatgtagctataaaaattgtctttagtatcattataataatggaaaaattcagttggccaaattatatattcagtgtggtctcaaatatgtgacaaaattctaaaaatactaataggaaatattagcaagtgtaataatactgggcttatctgttttgggattttgagtgagttccttacacacacaaatacatgaacagaaattatatatgtttcttgtagtctccagaatattaataataatcttgtattacctttctaattaaaaataaataaataattttaatttaaaaaagcaaaagctaatttcaatcttaatcctctcatttatcaagctgttttatggacagtaatatttctcagattcttctgagacccttatttatatcctgttatattccattaagtatatactttttatcataaaatgtcttggttttgtcaattttatgcaattgttaataagtactctaaacatatgtcattatttttcaggattattaagttcagttttatgttttagattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtaagtactataacgggaatttcattttacaagtgttttagtgaagtgttaaataggagttagattgggttccaatgaaataaagcagttattaactaaatcaacttatatgtgtcttgtattttatttataaggaaaaatttcctccaggtcttgatacttaaaatcggatgaccttagaaaacaacataatttgactctgtttcagtaaccttatatctaacatggaaaaatataatatctgctttgccttataagatgagaattaaacatattattagttaaacttggctaaattctatgcagtaatagataaccccaaaacctctatgtaaacataaagttattccccgataaagcaatttactgtgggcctggcaactctttcatgcagccttcttgctgatcacagctaatggagacatcgtcattctgtggttgcctcttgtgaaacatgccattttggtcaaagagtctgggacgaaacatgaaaaattgtacactggctcttaaatgcttctgacaagaagttatgcaggcaactcctactcatgttttgttaggtggggcaaagcaagttgcatagtcccatctaacatcaatagtatgatgctcattaggaaaggagaaacagctattggtaatgttaaccgtaaataaaatttgtgtaaaactgcaagacactttgttgttagaggtgtatttatcagtaatcgtcccctgaagtagcgtactttattcatagcttatttgccctatgtgcatgggatatccatgaccaccttttatattttatcacgttttccccctgttcttaatatatccaccattacacaattttagccaaagcctttatagagtaaattggtaagtataaaactgtcagccagcttctattcggtaatttcttcttttagagtcctagatatgaaagtatttcaaagaaagtcctaggacttgcaaaatatgaacacttgattctgggggtgcagaatggccacaaacttcagaaaaacaaatgatgaatctttaacccaaaagttcagagagggcattgtatttaaattgtcctaaagtccttatataattctagaggaaggaatataggtcaaatttagactcggaagtaaggtgtgcatcttaaaatttataagtatgtacactaaaattataagaaaatagtattatcacacaatgtggttgatgcagggaagaaaaaataaaggagagaaaaaaagtaagacaagcagaaagaaaaagagatagaaataaattcaaatatatcacaaatgaaagacaaaagtaaatagaataaatgctctgagttaaaaaaaagctataaactttttacaacacatctatctaaaccttaaggatacagaattgttgaaatgaaaaagacagaaaagatatcccagacaaatgctttccaaatgaaggtaggtatgaccatattaatgtcagtcataacagactttatttgtaaaagccttcatggaaattaatttactagacatatataatgttaaaatacctgaagcaaaaatagaactacaaagagaaatagacaaattcaccataataatgagatattaacatatctttttcattatttgctcactcaagcagagaaaaacatcagtgagcatatagaagatttaaagaatacaatcacaagctccatctaatgaaaacacatagaatattgtaactaacacggcaaaatgagttttttcatacacatggggtaaaaggttatatttgatgatatattgggctatgaggaaaatatcaaaatgtaattaagttagaaatcaataataaatagaaaacttaaaaaacttatatctttgaaaactaagaaatacatttctaagtgagtcttaggtcaagtaccaaatggtaaggaaaatagaatatattttgaagtgatgacagtgaaaactctacataacaaaacatgttgaatgcagtgaaagcattatttagagggatctttatcattttaaagacatattagaaaaacataaaggatgaaaattaatgatcttagcttattaggtaacataattttaggataaaaatgaatgagctaatttaaggcaacagaataaactggagtgaagggagaaaatagtataaaagcagaaaataaattcaacaatgtggtatgtaatctttgtagtgaaagtatccatatttattaaaaaaagaaaaaatctagacaaatagaaaataagtaaactatttctatttattggaagaatctatacacttaaaatgctcattctcaatgggttgatatatagaagaattgaaatcagaacgcctatagtttagtttttgtttctgtttgtgaaatgtgaccagctggttcaaaaatatctttgaggaacaaagggcaaacttcagtagaaattattaaagaataacaagtcataggggattcttgttttcagaaatcaagattcagcttaattcaggaattaagccattatggttctgtgcagggttacacaaatcagaatagcatagtaaacccagaaacagaccatcacatgtgtaaaaatagttgagggaattggcatgttagcatggatctctctctctctctctcccccactctctttactttgaactaaacattgtggaacaattgataattcacacagagaaacatttatatggacttccacctcatatcatataaaaatcatctcagagtggataaaaggctgaacagtgaaaggaaaaaatgttttaaaaagtgagactatttgaacaatacgtttatcaccagggtcattaatacagagaaagatttcttttcctttcttttcttcctttctggcttttttgtttgtttgtttgtttgtttgtttgtttttgacaggaactcactctctccaggtcaggctggagtgcagtggtgcagtcatggcttcatggctcactgcagtcttgaactcctgggttcaagtgatcctcccatctcagccttctgagtaactaggactacaggcgagtgctaccgtgcctggccaatttttatttttatttttatttttgtagagatggggtctcactatgttgccccgggtggtcttgacctcccagcctcgagcaatcttcctgcctcagtgtcccaaagtgctgggattacaggcatgagccaccatgcccagtgtgggatgatttctttagtcatattaaagcctcatgaaggaaatcatcaagaatacattctcctacatttgattttagatcctttttttattgaaagactctaggaagaaagtacaaacaaaaataagccacaactcagataaaaattattgataatgcatataactaaaaatggtatgtattcataaataattttacaaatctttataaaaaaggaaaaatgacaaagtggcaacatatataaacttgaacctcagactggagggccaataaaaatgtgaaaatgtgttcaacctctttagttaccagaaacagacctattgtaaccctagtgataaaagcatttgatcctacccaattgggaaatatcagaaaatccaaaagtaaaaattttagattgcaatatacatccaacagaatacgtatccactactgatgacagtccagtttactgcgtgatctttggaaaacattttctaatcccctccttcgttgaagatgctcttacttatgaccaaacaattccgttccctagctcatgtgcatgtgcctcttgtccatacataccaggaagatttgtggtcacattgtttatatttaaaaatatgctggaaaaaatacagcagtccactcaaagtagaatggatcaatgcattgtgctctattcataccaaaaatactattcaatagtaaataaaacgtcaagaatatgttgagcaataaaagtaaatcttggagaaagtttgaaatatgtaaaactgactacaattttgattggtataattttattgttaaattataatgaaaaataagagaatgataaaaacaatattcatggcagtaattacctgtaatggaagtaaaaattggaaaatggaagtgggggttgagatcagcacctgacaaaaaggtgatgacgatattcctattttgtaaaatgggtagtaagtgaatggatttccattgtgtttctttctttctttgtgttttttttacatttattctataaacaattgttttatattcttaaaatgagtaagtgtgaagcatcccgtttgtctcaagtggacatttctgagttactgagatattttagaatcagaccagtgacatgtcaacctgaaaattgttctcaggagtttggatttgaattgactttcagtaggaaatgtccatgaattctggattagaaagtattgctatgaaaattgtggttgatcatcgttaaactgtatattacatttatatacttcactgaaataagttaagaccagagaaaaggacagataaaatatcttttgtaggaggcaagtcatgaggatgattcctaacctaaattctaggggttgctatggagacacaaaggaaaaggcagcagctagatctattgcaaagaaaggagcggcagaatttggtttaagattctgcaattaaaggatttcagtttttttttctgtcattatctaggcagaccaagtgaagacatgaacaatataaggataattctgaccagaatatgatatgagagtattgtattaagagctgggagttggatctgagctacgttgttggataattgctctattttttttattttttttttttgctgctgctgcagaaaagagcaaaataaattaggtttcttatgcatcatttccagcctctcctgaaattacttcatcatctgacagctttctgcaaccatctatatattgaatagtaacccaacccaatacttaggagtttataaatcagagacaatttaaagcttcctacaatctttaatcgattcttctcttaaactgtagagaattggttcttctcaaagattgatagaaactttgtgattcaaatgttacagtttctacttctcaatctcctgttaacaaacagaaacctttgtatacaatgtccagttttctattttcaacaacattgcagttaagtttcctagggaaagagtgaaagaaacaacaacaacaagaaccaaacaaacagaatgtaccatttttatatacacgaaaaactatttaactaaatgtattatccaagacatggcacagggattttgtcagtgagttattcaacaatcttcctgaaactcccataatacaccagccactttctagtaatttgggatttaacagtgaataaaaacaaagactgtcctccagaaatatacatcctgtgcatgtatatggtgattgggtctggaaaggaagggagctactctcttgccttcattatccaactatcagtaaggttaaaatgataatataaataatcctaatttgactgttgaatactactcacacttcagtgcacagattagatttctccacttagcattcctggcctattccagcctagataatttttttcctttttctgagtttttaaacaacttgtttgtttgtttgtttgtttttgttttgagacaggatcttgctctgttgcccaggctagagtgcagtggtacaaacatggctcactgcagcctcatcctcctgggctctagcaatccttccacctaaacctacccagtagctgggactacaggcatgtaccaccatgcccacctataaacatcttttttgaagtataatttacatatcataaattttacttgttttaagtgtataattactagtttttatacattatttatttatttatcttagagatggggttttgctatgttgcccacactggtcttaaactcctgggctcaggtgatcctcctgcttcagcttcctgaatagctgggattattggcacatgacactatgccccaccaatgacttttttagtaatttttttagtgaagtatcattataatgtagtattaaaacatttccatcaccacaaaaagatttcttgtgcccatttgcagtcactctctgttcccatctccaggccttaggcaaccaccaattaattttctgcctccttaaatgtacttttctggacatttcatataattggaatcatgtatatggtctttttcatatgtcttctttcacttagcatgttttggaggttcatccatgtagtagcatatatcagtagtttatttctctatattgctgaagagtatttcactgcatggatatcatttcctgttaatccatccaccagttgatgaacatttgaattatttccacttttggctattataaatagtgatactgcaaattctctggggttattaaagcatttagttgtgtactgttagggacagtctatcaattgtcatatgtattaattaggatccttaagaatgagaaaaaatatcagacagactgtcatatccttcccgttctgcattgccttgtagatgtcacaagaatgtgtattatatttatttcattgatttattggttgataggctgaaaaataaaagaatgaataaaagtaacactgcaatttgcacatgctattaaaatagtctacgaaatgtctgacaaagatgaaattttctatataataatttaatgaaaactaattagaaatattcatgcactaggtttctacatttgtgttaacatacttcctcagattcctcaggacaatttccttaagataaaccctggctttttaccaccctgattttggagggggagtgtaggaaacctggatgttgtagcctgtgctaaattctcctaagtgcaaatcaacaaaaacagatcaatttgttcaattaagggtgcaactttgaattctaaagctttaattaagttcgaggattttactctgattcaccaaagtatgtgaatgcctgtaatgaaatgggctgaactgggtgtccttccttagcatgaattcattatgagctcatggactgaaagccagtgttatttctctgtagtcctaagtggattaatgggatgttctgcaggaaatgggaatcaattaaatctctttaccaaaggaaaccggagttagaggtgataaagtatgtgcactcagtagcatgcagttgtgacaatgatggcagactgtgagcaattcgccaagcatatttaagtgaaatgtacggccctggaaagctcaccaggccagtcctgtaaacggagtgccaagtcaaaatagataaagctttttggtataggaagattcgtccaatgatggaaaaagggaaaataattcaataaacacatcatatgttctacatgaaatgaacaaatgaacaggattttcttccttctgtccttctacctcctctgaaaatgttaattcaaataattgcacaaagtcacagaagttgttgagatgcaggctatggagaaaatcaggagcagcagcagaagaaaactccctgtccctttggcctaccttgtctctgtgcgtttggctgtaccatgcaaagtgaaaatatttgaggagtagccaagatgtattgaataatttttaagtgcttgctcctattttaatcgattcatgtgaaatatttaaatttcaacataaatcaaatgagttaggtgttattacatttcccacttatgaatgacgacactgaaacatattaagtagcagattcaaagatcgcataggaagagaagccaggacgcaggcccaagcagctgacttcagtgtttatggataatctgatgctacagtgttgtctgtactttgagactcaggtaacacatgctacagatgagcaaaaaggcattgtacttctttgttgaaaataccttgatactagattacagtatcatctagaaataggaaaatataaggaaaccttctattttgttcctagagtgccggagaatctgtagtgttgcataacatggtagcggttaagatgccagtgttttttggtttttgtttttttcatcacagtggttagttagcatgaattgtatttagttaaatttccctgatggcatttcactactactcttcactattaaacatgttggcatgatgggattacacagcttaggttttattatatctctacccttaagaagcttctaccctggtgaggtgtttgaggagcctagagagatgaattcaaaggattctaagacaccaaaggaaaacaaaatgagatacagaaaaaggtaaagatattggtctgaatctttgtaaccagttagttttctagtgcctgggctagaacctagtttatgctgtaggatatcctatagatataaattctgttttcagaagtcttctttatttcaggaatgaagatgctatttttctgtatattatgttgaaataattgggatgatgagttttcaaaactcattgacagcatctgaagtcatagagctcctgcaaattttgtatctgcaggttggttgtgccttgatagttgtggtaataagactcctgtgcagctagcttgtctgtagggaagtgtttccatgatggatttcaactggggaagttttcaaaaacctagatgtgaatatatttgaatgtcacttatacccttggtgttagttgttgctagaaatctgtctatgacactgaataataaatgtgaaagcctaatggagaagagtgaaaagatagatgctgtgatatgcttgctttgctgatgcaaatggattaatagtggcattagatagaaaggaaattgatctcatctagacttggttataatgggatttccaaacattcttttgtttttgtttttttttttttttttgagacggggtcttgctctgtcgcccaggctggagggcagtggcacaatctctgctcactgcaagctccgcctcccgggttcccgccattctcctgcctcagcctcccgagtagctgggaccacaggcgcccgccaccacgcccggctaatttttttatatatattttttaaattatactttaagttctagggtacatgtgcacaatgtgcaggttagttacatatgtatacgtgtgccatgctggtgtgctgcacccattaactcatcatttacattaggtatgtctcccaatgctatccctcccctctccccccaccccacaacaggccccggtgtgtgatgtcccccttcctatgtccaagtgttctcattgttcaattcccacttatgagtgagaacatgcaatgtttggttttttgtccttgcgataatttgctgataatgatggttttcagcttcaaccatgtccctacaaaggacatgaactcatcatttttatggcttcatagtattccatggtgtatatgtgccacattttcttaatccagtctatcattgttggttccaggacatttgggttggttgcaggtctttactattgtgaatagtgacacaataaacatatgtgtgcatgtgtcttcatagcagcatgatttataatcctttgggtatatacccagtaatgggatggctgggtcaaatggtatttctagttctagatccctgaggaataacactgtcttccacaatggttgaaccagtttacagtcccaccaacagtttgaaagtgttcctatttctccacatcctctccagcacctttttttggcatttttagtagagacggggtttcaccatgttagccaggatggtctcgatctcctgaccttgtgatccgcccacctcggcctcccaaagtgcaaacattcttgaaattctgcttagctagactgttatgtgcaagttgattctgatccctttgcagagaggccattcaggatcaagtccagtcttgttgaaacaaagttaagtgatttttggttttggtgttgatgaagtacccatgtgaaatatattggcaagataaaggagtgtaattacctcatttaccgaaaaaaatatttttttaatttacttttaaaaatattactgttgtccaaactcagcaatgctaatgtttgtcaccagataaacacagtaaatgccactggttggatttatttttaaatggagtcatttctttatctgaattgaggtagacttcatgttagctgctgtgttatagtaattaaagttcacatttatctgtgagtgttaaaattttcactttttatcgtgccatcaaactcactaaatagtttcagagtcaaaggataagacataaaaaattcctgaaaaattaatgccatttatatatcttctaaaaccttaaatttattgatgtataagtatgcgtccctgttttccaatattcattttgtatttagttaaaagctgttctgaagatttatggcacgcgatagcagttttggtagagttataaattttcttttcttttttattgttggtgccttagaagccagttgaattacaaatttacattttcagaattagaattgtataatctagatttaattaatgcaaggatgataatgcttcagtggcagtactatctgttcgaattgctaggttttttttaacgctctcagggagcagctctccaattagggatttatacatcttattaattaactactttacaatagatattatccagtgaactgtgtattcatattagggactgtatagtttgcttgttatcgaagtggattacatgccctttccattttctaatccatattttatttcctctgctgcctcttgtatctgagtatagatagattcaccaactacccaacagcaccactgacttcaatgccagtgtttactgggcttaagttacagcgaataaaactaaataagtggttcaatttggagatttgggtacataaacgttttgtatattactatgccttatgtctataaggtgtactttctgcaaaatgttttccatagcatttgatgtcaatcaaagccgaggctttaccaaatagctggcatgatgttttatctacaagctcttaatgtagtgaatatactaaacatactttcccgacttttgagggaaatttcatgctacctatagcaaaaatgtgattcaaagatggttgctatttcaaaaatgtttccagagactttctaaaaggaatcttatagaacgagttgagcaagaggaaacccactaaaggactgtcacatggctgaatgtataaagagaaccaaagtctgccttccgaaattgcaaaggcagtgtaatagccacaccgccccctgcaatgttaagccttggaaggtccttgaatttagacaaaaagcaattcactgtaaccagctggtgcatcgataagagaaatgtcagcaaattccctcaacctctaaaggcatggatgggggttgaggggctataggacaaatatataggaagtgcacaaagcttctcaagaagaaattttacagtaaatgagtaaacctttatatttccaagaacaatgaaaatcggttgtgaatcataatttaagaatgaaacatacaaataaataccttctaatgaattccatcaagttgggactgttataactgccttcctaagatccttctcctccacaagagactgtgtaattctataatgcaaattcccccaccaaaagttgaaagatatcaatgtaatgctcaggaagaatacattttgaatatccttataaatatcaatacttccataaaaatattaaactttggtgttagatttcaaattctgcacaattctgacttatattctgattataactgcattgctcttttaagaaattgactccagtgtggggaggaaacaataggttgaaatattgacaagtctcatttcctacatcaattccatttcatttaaatttttatttaatgggagtaatttcaatgtggctggctctttttgcaacttaaagtggtcaaatttggctttccattgcattcttaccattttctccatatgggctgggaagtttttatttagtgtggttaatgcactggctggaatatttgccaatcacattcaaggccttcccaataaagcgagagatagagaatatgcaaccgcccaaagtgaaatcagtgtttggagaaaaagatttcacatctatcaaagctaaagcaagaaaatcctgtgactctgggtttatatctctgctcagagaaatatgcacaagtatgttattgccttattgttgtcgcataacaaaaacattattgtctggggtttcaaaatgcagaaatatttttaaagttgtgtaaagatgcacaccagtttcttaatagtatttaactctgaaggggagatgtaagaaccaggatctgtagcatagaatttatttaaattgctgaattttgaaaaaaaagaacatattaagatatttgttgttatagtcaaagttaattttaaaataacacattaaaatgattttttacaccaggtgttccaaaattcccaaaagaaaaaattgaccctcttgaagtggaggagggagatccaattgtcctcccatgcaatcctcccaaaggcctcccacctttacacatttattggatgaatattggtaagtaatgctccgttccatcaaaaaagggggacattttaattctatccatcatatcaataacataatgaatccaaagacaaaataaaaaataaagatctcttaattttttcatatttgaagaggagatgctactaatatgataagatttgtctgtgaagacaatacttcctatatttcaaacagtgcacttacctttggaatatagatcatgtgaaagctgaggatggcatgggtttgtgttgctagcttcatctttctattttagtaatgctctacctgctaattgcagtcacctaccaggaaattagtattaacttttttgcttaattttctaaaaggtttgctgactctgatctgaaaatctagctttgtaaagtctacttctagcatatgccttagcagtgatctctacatgttttctcattgtgaaccatagagaaaaatgctatttgcacagcactcagaagaaagcaaatgaagctactcttaggtacagccaattgttccagacatcagttcccctagaaccttccaggctgcaaccagaacagggagattaatatcacggataaaacttttggagagctttttgttttttctttttaaatcatgttttaaataaacgtgattctcagaaaatacaagtgttaattaggtcattgtctgcattgatcagttttcagttcagccaattcagattcatagggcagaggtggagacaaagatggtaaacagagtttaccactgtttgtctactggtggacttctttggttaatggtaaaaagtatcctcccaagggttttgctgctgtttttgttttgttttgttttcctatttgctcattgttcctgtagtaagaccagacttgagaggaattaaagagcaaacaggaaaaaccaaatgaaataataatgtaaaagaaaatgaaaaaggaagatgaagcacagtaagggacaattgcccttttcaatggcaagatatctcttttcagaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagttgtaagtccacataatttatcgtttcatcatgtatgctgaatgcaaatgtgtctgtaatttccttctggctgaagccatttaaagctgggttgatattttgcaccattgtgcagttcaactctggagacttcttccagatgaaatagacatctgcagctgcagattcacggtagctctgtctctcacagccaggaaatcacatctcaattcacaggacaaatgtatttcatctgacatctgcaggatcttgtcattttcagtggatgaaatatacaatgaaattccagggttttctaagcaaatcttgggcatcgattcactgtgatcttggataaactggcagactgaaaatgggggagaaaacaacagaggcaaaaagatggaaatttgtatcaccaaactggcaaacttacttgaatcaccctttcccgacttgattctgtggaggccagcctgggttcccaaatgggaagagtaattagagggaggaagaaccgtaagattcaaagggaagaaataatccccaacagtttgctgagcgaataattggccctggtatagttgaaagttggcattaccatttcattgtttaatttggtccatgattttttcatttttatgtgtagatatgccatgccagggcttcactataacattcttctagtagcctcagttctcttcagtggagctataacttgaatcttctccacctggattcaagattaaactcactataattattttctatgtaaaactatattcccaaaggcaatgttctagtgaagcatggttctacatcattttgtaatttttctaagacaaaaatatgacttttcattctttattgatatcagcatccaccattatgtttgtgttttttccttccgtttttttatttcagtaaagcatgctaatgactcaagttcatccacagaaattggttccaagggtaagttgaacccatgtggagtgttggcatttgtgtatagctcattgtcatctcagattttgaattttttctttaatatcctcttaagtttattacaatactgttattatgaaaaacatctgaacttagagggttctattgccccccatgccctcttaaatatatgcaaagggagtgatttttataaatatataactgtataaatataatgaaatacttatatataatgcattgaatagacagatagagatatttaatggagtaattattttgggtctcccaaaacgtctcttatggtatataaggttgatacttttgcagaaagaaaagaaatggttaagtgtcaaaagacgtagagaaaacactgcgtttaagaaagttaagtggatttttttcttgcaaggctttttgaaatatttgacatgcaactgtacattgtggctttctgagaaaaaaacagtttgtagcatttttcaagttcatgtgtctgcgtgatctttttatttaattctttcccccatagaacgtctaccagaacttgtgttctatggaaaatgcctgagtaaatctgagttgtatagcaggctagttctctataatgagaagagtcagttacataattgcagcaaatattctctataaaatgtggaccagtgataacttagataccttgcatacttgcaagttcagtggaggaggatgtaagctccttttgaagaaccgtcagttttaaggtggactgattcatccccaacatcatttcctttgagattaataactcacacatatatagtgctatattttcacagcactcaatgaaaaatcattgcacatagtacatattcaacaattatttttcaaaaaataaacacgaagtatagaagactgtctactgctaaagtccctttgaagatggaagtcttctaatttgccattgtatttgaaaaatattcttaagaaaataagaaatgggacacttcaatatgcaggtagtgaggatgcttactagtcatttcctaaaactgtgtttttctttaaggagctgagactacaggtagagttgccgaaagagcttgataaattcatagatgcctagtgtctaccacagccttcctcagtgagaatttctgagtgcaggagtgaggaagctgtttttagcagaaacctcgttaaattcttaggcaatttaaattaaataaaaacataaacataaagtcattgcacatgacatgattgaagtatagaatataaaatcatagattttcaattaaggacttctgtttgaccttctgagttagcagatatggtataaataataatatttataaaattttgcagtgctacgctcagtaaaaacatatgagggacaacccatgcttcatggtaagagagaagaggagtctatttaaatggaaatatgtgaaatgtgtatagaacacacacacacacacacacacactcgtgtgtcggattttttgttttaagaaagatgtggtgtcacagaattttatgtatattaatttgaaaaaattctgacttttcttttctattttgtagcaaattccatcaagcaaagaaaacccaaactgctgttgcctcccactgagagtggcagtgagtcttcaattaccatcctcaaaggggaaatcttgctgcttgagtgttttgctgaaggcttgtgagtaacctgactctcactcatgactttgtccatccagttctgtaaagaataagacatcaagcacattaagactgtgcttgcaaagatattttaaaattatttccttaaaaaaattaaattctgccgggcactgcagatattctgctcaggactgttattccaggtacttaagaggctgaagcaggaagattgcttgagcccaggagttggaggctgcagtgagctatgataatgccattgcactaaaacctggatgacagagaaagacctcatctaaaataaaatgaaattaaaattaataaaataaaataaataataaacataaattctgtcattatatctctggaggaagtaatttgtacttcactctacagacttcaggcagtaacaggctcataaaattagatctctctgtcaatttatgatattgtggatggaggggatgatgataacattctccttagttaagtttaagaagcctgaggttgttggtagtcagtccctcacttttggtgctgagttttctctctatgctatactacttgccccactcctgtttgctatgttacttactaaatctgctgctttgcaggttccaaggagccctatttatatctatttttactctgctgccctttgcacacatggaggtccagaccatgtaatttaagagagttttacatcaaaatctaattaagtgaactttctttacacctgaaaaagcaatccatttatttatttatttatttatttaattatttattcatttattcatttatttatttttttgagacagggtctcactctgtcacccatgctggagtgcagaggcgcgatctcagctcactgcaacctctgcctcctgggttcaagcgattctcctgcctcagcctcctgagtagctgaagctacaggtgtgtgccaccacacctggccagttttttgtatttttagtagagacagggtttcaacatgttagccaggaaggtctcgatctccggaccctgtgatccacctgagttggcctcccaaaatgctgggattataggcatgagccaccgggcccagcccgcaatgcacctttttaaatcctccaagaaaaccctaaaggacctcacttggtcacctcttaaaattgttccatttattaactactgttaagtacatgtaaacagggaccatcttatttaatatttaatcatacagggtctcctatttttaccactatccttccgaacttacggtccttccctaccattgaggataccttgggaaaatgcattccagcttcctagcacctgggattactcatttgaaatataatctgttcgtaagctaagggctttggggactctagttagtggactaggatttgaaattcaaaaaatcatattcattcataatttagagtacattctgaacgactggtttagaaatggagcagattttattggttttacagcccctaagctttgtaagtttctctttccaaccaccaaaaatatcaaagttgcttgtctgtcttcaactcccaatgtgtatttacataaattagttagaagtactatgacacagactctgtttggaatgtttggtctgtgtattattttagaagaggaaagtctcatattgagtttgaatcatgatggcaacaacctgctctactggttgtatttgtacatgtttacagtggtagaaattacattcttgcagagttcatcactgtattgagttgggcagggtgatcctttctgtaattcttttttcttatttcccacaaatgccttcactgacctcttggattgactagcaactgcgcagaatgtcttcaaaataatgaaatgctctcatgtgctttttagaaaatgaagagtcatgaaggaatatataaaaacagagtggatgaaaatatatgttgttgtgaggacatgaaaattcttgatgcgctgtcctaagacttttcacctgaagtagtttcttcttactcatactgattttgtgttgggtaatcctgtctgatctgggtcgtctctcagaagatgatacatttttaaaaagttttttgggtcctttaaaaaactctttctaagaagttttcaagccattaacctcctatagtaacaaaaataattataattaaagtattgtactattattttgtgtcaagcactatatttgggtctttgaaaactagtctaattgtctaatacattttacttgaaagaataaagtaaaatgattatctataagtgtcaggtgaacatgagatataatttatctcaagataggtctatatcttggcaagaatttccagctatattcttgcaaatgtttttcatttccttttgttttagatttaagggatatttaccaacagtatctgaacaaatgtgttttgagggaaaacttataaaatggccatagatggactcatgtgcactgctcaaatagtttttttttctgttttgtaaattcgtgggtttaaagtaggtataattctttcacaagatactactttataaatagagaaatatgcaaataaaagttggccagacaaggacctgaaaaaaattgagattatgaggtagtgtattttgtgtgcaaaaaggcattaagcaatatattttccctcaaaacacattgcttaaatgctgttagtaaatgttatttaaatttaaaaaaaggcaggaggtataaaaaaattggcaagaatagagctgaaaatttttgccatggtatagacctatcctgagattaaattatatctcattttcacataatactttagatcattattttactttattctttcaagtaaatggtattagaaaattagactagttttcaaagacccaaagactagggagtccgggagatcttgctgaaagtgagttacttgctctaataaaggatggactcttgaaaaaatcctgttttaggggaagtgagttccagagcagcctataacttggcaaattgtcattttgacagatggagtgaaaagccagcagttaggagacttgagctatgcatcctcttaggtggtgtgctcagaaagccagcagctaatatgctctcacagctgtctgcccaggcatcattaccatttcctacacaagcgtgccatgtgctcttagcctggtaaaatataagattattattccaggctgcacagcacgttagtgtttgaggcttgaaggaagaaggaaaagagtagatatatagagattaaagagccttcatctttacctccaattttttttgcataaataactgaattattttaaccacaaactatcaatacaaataatttgagaatattgacacacacgatttcaaggaattgctcaattattacatagtaactaatgggcaatttgacaggaagcatatattctaagactatagagttaggaaggacataggttgaaaagcacaaaataatagaacacactgataaaaaaggaacaagtttagagtagacaaatataagttggggtatatcatttattgctccagtgaccttaagaaattaatttattggagcttcagactccttactgttaaatgatcacaataatatgcccatctttagaactcaccaaataacctacagctactaataacaagaagaaatatggagaggaaaagtgttgcatcaataaaattagcaaagttgtttctcctactcacttatagaacctgactggggaagagaaagagacagtcatccttcatttagaaccaaccctttatgctttccacataatttttaaatcaaatgagtcacagaaggtatgacttctgcacttgtctgcttttcatgaggaggggtttttcttaatgtagctgccttgactccccagtccttttttcctccttactaaggtggggaaagttatcatgctggtgtgtaacaagttatcatgctggttttgttttgtctttactttcctgtttgttttgactgggtgagctaatcttttgaaagcgctaagcaagggaagatttggttcattcctcctttcctctgcttcccgacaagggcgagaacgtgatccaggaggcagtatctgtgctgcagattccagcttgccctggaataggctgttcatgggtctaatcgacatgtccagctttcacgcaggagccccattctccatgatcagcatcataggattaaaagggaaacttctctctgctgactgttaagtcccactttactgtgttttacacaaacagggaatagggctgttatcactggctgccccaaaccacccactgggagattttcacacttggaaaatatcttggtaatattatttcaatgagctccagctatttttccttcgctcagccacacctagtcagcacttacatgtagttagcccttgtaatagaggagagagaagacttccaaggagacagaccactggaggaactttcagtgaaagagacttgcttcaacaccagtgttcactattgttggtggtgggtgtgtctgtccactggtaaggatgacgtgattcagtggaatatgagcacatgtgtaaaagcaccctgataaaggatgtgtcctaaggttttctttgtattttactttccgcttttaaaaaaatgtttatttatttaactattttttgcaggccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaaggtacctttcccatgttggtctatttctctgcttttcaaaaaagtaactgtatacatgtagtaggccttgcttctaaatcatacatgttaaaacaggtcagcagtttcaacttttaattgtagtgcgggcattgaattatattacacttcaactaagcaggtttgtcatttacgccccaaaatgacatagaagggacaaatgacaagaaaagatctcatgttagggattaaacacagacagtttacatgatttattcaaatagtcattaaagctagtctcctaaattatttttattgtaatacacatatacatttcataatattaaatcataaaagcagcagtaaggattatgatgaaaggaagtattaaaatgagcctggaagaaagcttggatttaacttgctgtgccctttgccatttatttcactctccgtacctcaggctcttcaccaaagaagtgaaagaggcaggcaaattgttgtgtcagctctttcctgcatataacacttttgtaatccatatcttgggttcagatgataaattcagtatgttacttacaggcaaaaaagaatagactgtatgctataatattaattctctcaaaaagtgcaaaaacattatattcaagtcatcttctctctgtaaattcagagattttgatcaatcaaggttttattggtattagttacatttataggaataagtaggcaaagatgataccatttaaatgtggaatgtagttattagtgctgtgactggctgatgtgaagtttgtctagtcctctgaatgtgattgacacagactattttctgtggatccaatcacactgaggctttctatctacaatgtagttgaccgtattgatcaaattaatggaatgatgactgcatttgtacttatttagtgcagtgtaagcttagctactgaaaggaattattctttttagactacaatttagtgaactagtgctctaggcacccattaatattccagtaaagttcacctcttaaaactttagtttccacaaggaacacctaagtaatggcctgttgtttaaattaatggaaaaaaaaaaggactcagacacaaattctcctcccaagtaaatgttaacacagttgatttaggcaaacccctgtttggaataacactgcatttccaagccttctccataatgcatattattatttaaggtaggaagaatagaaaaccgaagttgagaattttattttctttgacttgacaaaagcaaaacttatatagatatgcattaacgtcaacatctgccaaacagtgatatattcctttgacattaaattattcacaaagaaattcaaggaagaagagtttgaaagatttatgttatgtatatttttagtcatcatttgatgtttctatataatttggctacatcgtgcaacaggggtatttttctgtaaccccctcctcccctccctggcacacacacacccacgaaccagacatatctaattgttagattctcctccaagttgctgactattagaaacacttccagatggctggaacatagctacggtagctgaatattttaacaatctggccacagttttcttgactataaaaccaaacctttcaaaagaattgcaagggttgcaaaaaacgaaatcaaagatgtaacattaattatgcaatttaaaatgttgactataggactccaaaggaatatagatttcctgaacaaattgttctcactactcataaaacagctattagcactattgagatgtaaatgatgtttttatgaagaacttttaatcctctctctttagtaagaaactattaaatgtaccttcagttgtatgtttttgaagtttctctttacctatacacatgaaaaacaaattgagcttaagaagtctttacttttttttctaaagtgtggaggtaataaataaaaactttgttaatcatctggatggatgagctcgtgtttattcaattttttctgccttcctgcaccctctccttttccttttttgtctcttttttagaagcccacattaaataataaggatttgccatgtgagaaaatagcaatgctattgtatattttgaaaatctactccattctgaaaacacccattgtgcttaagtaaaatcatggattcgattggattctttctgtatgtgcaatgtctttcctattaccaaacataatataatcaaatactatgagcttgtaatttaggttgcaacatcctaaatataaaatcagactgcacttcaaatcctataatatgtatgagcaaaagcagccaggatgtcttgactaggtacaactgtatattctaaatatctaagatatgattaattacacattcaataaaaagagatatattatagtgacatctaaaacagtctacatccagaaatcaaaatataatcacaatcacatttcaatagactatttaaaaataagctcccaccaataatttttatgttgtcaacttttgaattatttaaagcctttgaattttagtaagtgaaataggaaagcatttatatgtaattatagagccatagtataatccaaaatgtttttgcattttcaaaggttgtcataaaatcaaatgcaactcagtcattaatatacttgagaaatccttgttttcaaataacaaacctatttctaaaatgttgcgattaaatccaatttttgttgaacctaacaagttttgatttattaaaatatagattttaataagaacctgtgaagaaacagttttactaaaaataaccagtgttgtatgttctataggtaccaagtttgttttattttgtttttttcctagtgataaacatctctatttagcttgcttaatatatagtcccaatgttcagacatttgcatctgtttccagcaacatgagaaatatttatcatcttatttttgtatttacaattatgagaaaatgcataaagtttcaacataagcaattttcatctgttaccatatgtcttaggataatagataaaagaatgggtttctatgaggatggtatttttcctcagaatttttggttttaaggctcaagaagcagctgtttctgagcagaacaagcttgactcaagtccctcccaatattacatgattcaggaccagcttacttctataggagaaatggatgaaaagcattaaagtaaattttcaagcaattataaagaaagcttataaagaagggttaaggtaaagtatagtgaggaagcctagtgaatgctcagaacttcttgagtcagttgataaatattgggggagcttggatttggaagcataaattgggctggccttctttcctgtctttgatacaaattcataagataacactaaattagaaacaaaaaccacatgacttcagagtctaaatgctgctcatccatagttgctgtgtatttatctgtggaatggcgagaacaggaactggagcttcctttgctggtgggcctgggcaagttaggcaacttctccaaagctcagccctctgtctgtaagatgaaaggattggatgacgtgataatttggaacctctttcagtaatactaatattactaatagtcctaatagtaaatatcctaatggcaatagtaattattcaagaagatttacagaaatatcattattgcttgattttctttatttctgcatacgttgaaagcaatagttgtaattttctattataaatatgatatgccataatgttcatgttcatggaatatttttctctaacttacagatatttagttttatattggttgtattaaaataaccagaaaaaaagtaaggatatcattaaaaaaatgcaaaatagacaaaaataaaccttcacctcagaaaatgatcgcagtttataatttggactagtgtattttaaaccaagtgactaaacatttacaggtagtacagcttatgaatacagatatttaacttggaatttaacaattaagtccacaccctgtggagtaattacaaaggcacttatctcacttggacttgaacttgaacttgccaaggctagttgtgtacttttgtttcctctgatgaacttacagttctttcctttttacataatcctctttttcttcctttacttagaaaaattttaatgatattttttcattgtatacatacatatatctttgaagactttcgtttttagctaaaaatggaaatctaaaatatctttggggaaataaccaaactacacttgatgggagttgctacctgcaggttttgtgcaattttctctgaaatcaaattatccaaaccatcaacactttaatctaaaccttttagttacccctgacatagcaatattcatgaagttataaaacatagagttataaaaacatggaaatccagtaaaatgtgtcatctgtttctgacatactttgtagtattgttacactggagcattagggcatagaaagatacaggtaattttaaggtatattttgctgcattgttttgactgcagaaagctaaacactgcttttgggcttctctctctcccctcttacaaaaaaactctaggaaataatatttttcaagtagattatatgtataaatgctataagatcactaagaaatattcaaaataagcattaaatattttaattagttttatttttaaaattcttacaatataattcttgtgtatccacctttttagatgccatgctgcagcttgaaaataacctgtagtgagctctaaataaactcaccatctgcttattcttccctcattttttcctagtggggtagctacttgtatagctaaataaaatggttgtatataactattttcagtatgttgatgtatgatacatgctgagtccaaattaaacacaagcacacacacacacacacacacacacaccatacaacacaaaagcagctcccaccttgctttgcagagcaagtttaccaaaaagagctactatgaaaccctttgtggtgtctgccctctgctggtgcaaagtagaaatacaggccttaacatttttggactttttgacatagataacatctctcatgagctcttcactttacatccagagcctcctcgctggacaaagaagcctcagagtgctgtgtatagcaccggaagcaatggcatcttgttatgtgaggctgaaggagaacctcaacccacaatcaagtggagagtcaatggctccccagttgacagtaagtttaaaaaccaattgcaatgcaatgctgaaggccctggtttgacgggattaatgatggtcagacgtgtgtaaaatgaagttggtatgtggttggattagcaggacagatacaaccagcaaatcagagattgtttatttctaagcaatttggttgttaagacttgatattcatggaagagccataaataatatttatactgcctgtgccctcttataaattatatataagaataaagatttttaatttttaaaaagaaaattgaatgagaaagaggatgcatccaaggaaaaaagccaattattgttcctgtccctgagaagaaacagaacagtagcctagcagctgagggcacaggttcaaagtcaggacctcctttaggctcaggcaacagcaacacctgtcctgggctctgcccttttaagggacttgctctgatcaccctctggtcccgcttgtctccatgatttgaaagcatcctcagggaaaaggaggcatcccaagtctgaacatggtcccattactgcctatttgctaccaacctcaagcacaaagacctgaaaatccccatgcccggtccaccctgagcccactccaaatgggctgggcggggaaagacaggaatggcccagcactgagggccaactctccccatttcaccatgctcagcatagagctccaaggagtccccaaatcttccactggaacctagagctcagattattttggatgtccttgttcaggaagaaggatagaacatatttttacgtgtcaattgcttaattaagagcaggtacgatagtggcttccatttgtccttttgctctggggcctgcacaagtcaagggtgagccacttggtggataacagacctcgggtcccgtctaggatgtgcaccttgccagctgtttcatcttgaggtgttttctgaatctccccaagcttacgttttttaaactgcaaaatggagatagtggcggttggttgtgcttgaatgaaaaaaaatgtggccagctgcctagggcagtgattcatctgtagagcactgtgatggtttataaactctggagccagactgcctgggtttgcatactgactctaccacttactagctgcgtgacggggagtatcactgaccctcttcaaacccatttcttcatcagtaaattgggataaaaataacactgactcacggggttgttttgtggattaaaggaaacatcatgcagagaatgcttagcacggggactgccacaaaaacagccccccgtaaggtatggttggttggtattgttttcccataacagacactcaggaaaccttagtcctcattattaactatcttcagatttgggatttttctcttcatctctttagggaacagaataaaaaatgaaaaataataatgaggttttgggtagacgaagggaaatgaaagcaacttttgtttataatgaatgttcaggttacaaaagtaaggaacgcagattctccggaacacaaaatcataaaatattatatttggatggtatttggctgtttacaaaagacattcacaaattacttagaatcctcaaaagaactttataaaggaggtgctattattcatatttaactgattcgttcattcaataatatttatggggtactttctatgttcccggcactggacttcatgcttgagatatacaacagtgaataaaatggatggaatccttgctctcctgccattagacaaataacacatgagtgtgtgctatggtgtgataaagcagaaaatagctgggtaagggcagtgcctgaaagaggttcaggacccagagttgcaatcttaagatcataatagtaagacccctgtggtaatttacctttgagtggagatgggaaggaagtgaggaagtcagccacctaaatagcagggaaagtgctgtctcagtggagaggtgtgttgaggaggagaaaagaggtgagtgtgactgaagctgagggagtgcaaggggcagccctaggccaccagatccgccagcaggggaaggggccagagctcaggtaaagatgaacatcgaagtagggccttgggattttgagaatacactaggcagctcttggagaattttaagcagaagagtgacacaatctaatttacatttttacaaggtattttcctggcctttgaatggagaatggactgtgtgattgatactaggtaggaggccatctgagaggctctgcgctcagggctagattggtggcagtcatggttggcttctggatttattttgaaattgagccaataggtttgttaatggatgaggaggtcaaggctgaaaataaacttatgcgagaccacacagctgaataatggtagacttcaaaccaaagccaggtggctggaatccaagctcggtgttctgttcacagcttttggccctggctctacttgttgccctgcaaacaggtcgtaaacttttataggctgggatatttgatgacagagtgttggctagaggatttgaaacctctttaagcttattttagttttagaggttatatatcctttccccatgttatttcaaaattaaatcaaaatgattgctattattgattatcggactaacccttttcacatgctttgcatatgatatttctgaacctcgtagcagcttgaaaaatagattctattattctccattggcaactgagactcagagaggttacattacttactggagaatgcaacccaggtacatttaaaaccaggaactaaacccaggaaggattaactccagagctgaagtttcgtccattttattgcatgatttctcacagggttgaccaaagacaaaactgagaaagaatttctgaagtatgtcaggactagtgtgttttataaagacttggccttcttgaatcctgggagcttctgttagcctttgtcaatacacaacaatttccatacccatgccaacaggcagatttaagcaatgtttaattacttaaataaagtatcatttatatagtctaatttcttacttttgtaatgcagtgttaattcagagccatgcatggatcagacgggataaggagaactaaatgggaggatggcgttaactctgaaagtcttaggaccctgagtggggtgtggaagtgaagagtgggattagagactcagtgctttgcagcattcctaaagagtttagcctttaaaaacttggaagagctactcatcttgctaatttgcaagaaataagtgataaattgttcaacaggattgtattagttttctaacattgctgtaacaaattaaattaccataaacttagtgtcttaaaatagtgcatgtacactattttacatttctgtaaaagtccaacacgagtcttggctaaaatcaaaatgtcagcagtgccatgtcctggaagtgcttggagagcattccttcgtttgccttttccagcttttccaggctgcccacattcctggctcccttccgccattttgaaagccagctacactgcatctctctgaccatccttccatggtcacatttccctctgaccatagccaaggagggccttctgattttcaggagctttgtgattacattgagcccacttgggtcatccagatgtaggaaataattttcctacctcaatgtccttaatcttaatcacatctgcaagtcccttttttccatgtaaagtaacaaagtcatacattctgggacttagaacgtgtacatctttcaggggctattgttttgcctacttacaggggcctttcaggaataaaggttacccaacctaacattttaagtcattccaataagtatttactggctggattttctctggtagctgctctttgggcagtggggacacactgcacaacctcacactcaggtcctgcccttagagagctcacagtcaagtgaaaaaaatcttcatttgtgactcctaggcagaaaaagatgtgtaagtcttttatttcaatatgtagtattcatgttttctagaacctaaagcttagtatagtcattatctcgtataatggagagacaatcagaaaagtagaattcgattgattattaatcttgtaatgtcctttaaactaaaaatttttgcatttgtgcccttcccttgacatttccagctaacatgttttccttcccactggatttatatatataaaatatatgttatatatatatatattatatacggatattatatataatataataatatatatttatatctatatatatactatagatatagataaagatatacacatacatagtatcatagcaagggcagggcttttagagtcagaaaagtggccaaatgttgtgggatgtgtcatccaacttctctgtaatccagtcccctcacctttaaaatggccatgtaaatgctgatccatcgagttctgagcagtgtcagtgagatcatgcatgtgccacatccagtagagtttttggtccttaaatgcatcagaaatgttaggtattcttttttttcttccttttctttttcttcacttttattttaaagtctctctccatcacccagtctggagtgcagtggcgagatcttggctcactgtaacctccacctcctgggttcaagtgattctcctgcctagcctcccaactagctggggttacaggagtgcaccaccacacctggctgatttttgtatttttagtggagacagggttttgccgtgttggctaggctggtcttgaactcctgacttcaagtgatccatctgcctcagcctcccaaagtgctgggattacaggtatgagccaccatgcccagcctcatgttaggtattctcatttccaaaagatattcccagaattatacttggatcaggagtggggaaggttttattgccccaaagtagaaaatctggccctttttctcaagaagagtttagtcttcctgggaaaatgaaatatacaagcaatgtacatgaagtggttaaatagtgaagcaaggcaaatgaaatcaatggtgcagatcagaaaactgtagagaggcagagaactgaaacgggaacaaaagcgtcaagggggaaaatagcagccagtactggtagctagggagatcgtgatgtgttgaccatgtgacttgtgccaggcagcatcagtgtctaaattcagaagagtaacagagtgtcacttcatcataggtcttgaatgcctaaaggataatccagaatagtgccatgagtataggtatggaaattctgggaggtccagatgagcagatattttgttgctaaatattaacttgaaagataattgaaaattcacatggatctggaaagaaaagtccatagttgatgttcagaaaacctaaagaattggcttcaatgaactattagtcaccctaaactggtttgaaaatataaatactgtgtgacacatttaataaatggtgtataaatattttatgtcctgttccttatcaaactgacattctttaatctctttcagatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtgggtgagtgtgcctgggagctgacttaacatgctattttcctaaggaaagtggtcaaggtcatgttcagaagtgtattaactcttgacacataatatatggagggaaaaatcaaactacttttcaccatacatttgagttttagacttcacactgaaattgtactttcttttttttttttattatactttaagttttagggtacatgtgcacaatgtgcaggttagttacatatgtatacatgtgccatgctggtgcgctgcacccactaactcgtcatctagcattaggtatatctcccgatgctatcccgccccccctccccccaccccacaacagtccccagagtgtgatgttccccttcctgtgtccatgtgatctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcatagatggacatttgggttggttccaagtctttgctattgtgaataatgccgcaaaaaacatacgtgtgcaggtgtctttatagcagcatgatttatctttgacaaacctgagaaaaacaagcaatggggaaaggaatccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccagaagcaatggcaacaaaagacaaaattgacaaatgggatctaattaaaccaaagagcttctgcacagcaaaggaaactaccatcagagtgaacaggcaacctacaaaatgggagaaaatttttgcaacctactcatctgacaaagggctaatatccagaatctacaatgaactcaaacaaatttacaagaaattgtactttcaaaaatgtattgaattgggatacttctataattcaaaacagacaccataatattctgctgttttctgtttgtattcgtatgactaggacatagaaaaatttaatttgcatatctttcttccacaaaagtttaaaactgcgtttatgttattttcaaatagatgtccgtccattgatacaaaccaaagatggagaaaattacgctacagtggttgggtacagtgctttcttacattgcgagttctttgcttcacctgaggcagtcgtgtcctggtaagccggtggctcatggttttcttaagagaatgtcaattgtagatttgaccttgtttcttcatccgtcatttgacaggctgtattgtgtctatattgttacatgtacccagtacctctgagacataaggtaacaaacttaccggtccaggaaattagctctactgaaagcattggctagatttctaggattttctcacatagagacatacagagagccacttgtgttcataaagaaaagcagagaattgaagagattacagagacaattttaaaggtagttttggtttttcattatgaggtaccacaaggtcatgttttactctattgttgttgttttgggattatctaaatgattatctaagctcgaatttaattccaaatgcatgtgcttaagacttttccagcattcattttgattttaatttcaatgaattaattggtatcataagtccaaagacattatcaatatggatctaccttattagttgctttactgaaaaagcttggttaaatagttcttgaataattttgtcattggtctgtagggcagtgtgagatgagtgaccccaggtcataaatttatagggtcagatattgcctttattttaaatcatgatacgtattttgttcatcgtgggttttttgcattattgtgatttttcaaaatactagattgaaatattatttaccttgcttactgagatgtttggcaccctgttaaattttgcatctggggcaagcctcccacttgcctcagcctagtccctgtcctgtatgatcctacatggaccgcatccacagcttatccttaaaaaaaaaaaagaaactcaagcagtcgcttattgtcaaatgtacagggtaaatcaagctgtagcagcaagggcttggaaatggctgaatgttggaggaaatggctctggggttgatagggtaaatgtaatccatgtccacaggacaggcaagactccccagcttataatatttctgaatgaccaatgttctcccaggacagcaggaggtttgaaaggttcattatctctttcaattactagctttcccatttagtaccctggagcaatcattaactaaagagttcaccatcaataagccagaaaatatttattaagctctgaggacacatgcaaaccggtgctggtggctatgacaaatacagcagaagcactgagcatggacttggattttctatagccacagtctatttgggtagataagatatacaatcttggtccattttgagaaaaatatgaaacccactggaacatttcatgaggttttctgagctattgaaaggggattagcctgaatgacgtcactgactagtattaaaaagcgtatacaattttgccctacctcagatggatgtacgctttctttgtccataggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaagtatttttatttcactgttactttgcatgaattgtcacatgggttcagtctgtcttcatttgcccaaatggaataataccatttaagttggagtaccagataaagttctttgaaccgtttttcaaaattcctagaatgggtttcatctaaaagattattgcaagaactacagggtatgcccatgatatgtgcacagcttcatcctattttaagaggcagccaggtgtctgtagtgacagatggctgtcaatatttaaaaattacctattaaccatactacaccatatttctgtaactatattttatttccaaagctaactcaaggtaatggtaacagtaatcaagtttttgagctaaagatttcacaaactcataactttataatgactgaggcatgacagaatgaggagggtttttgatcctctttttgagtcataaacagctttgtattattccttctcacttcagggcacagtcctgggagctgttaatagtttcttgggcttcactgatattttgattttaatattgctcagagaatcttcaagaaaacacaaaatggaaaggatcttcggtattaataaggagcatttttgtttcttctgtcgtgtccatatcccagcctgcttctcacttccacctagataagggagagcatatttgtttgatcatctgttttcactgatgccacttttcctcatacatatctgctgttgtatccactgatgtcttgacatttctttctctcttcccatatatatccttccttccttcttttttcatcctgttttccttttcttttgctgtacatccttttcttattttatagcatttgtctctttctgtgccctgagtaaatcagtgtgccagccccacagactatatttttaaagcactcaaatactctcccacaatatctacttatctctgatgtcttttacattttcaagtgtcatgtacacttttcaagatgccctcatgaagtcactgaagatggtgatgattgtttttatacttcaaaaagtaaacctatatcaaggttaagcaactcagctaggtgtaaggagcgtgaagcctcgaatccaaatggaactttgcactcctattgcccaatacagtgcttggcccaaaatggacctcaaaactgctagtggccagagagatggacaagtttagaaagtttcaatatgctgtagtgtctattttatatgttaaaaatatatacgaatcgtatcaatggaggattaaggacacttttttttttacatatacaaaaggcatgttgagaatggagttaagtgagagcctatatagtatagtgattgagagcatgagctttagtctcaggcagatttgggttcaaatcctggttcagcccattcccggttaggaaaccttgtcttatggctcaatttcattttagccttaaattattttctctgtaaggtgggagtattaatattcataaagttgttataattataaaatgccacaatgaatatgcattacttagcagagccctgatagagaagtgtttattaaattgtatctattattattaaatgaatttctggctttaaatttagaattagaagtaggatgtcaaataattcacttaaaattaattcaatttaatagtctcttcaagttttgtgcctggaataacaattaattttattaatactttccatttttagccagttccttgagaaaaatgtacatagccaatatcagagtataattatagaattggaggtcagcttgtgcagttggtctctgggaggtccccaaaatgccaaatgccacattaagagtatacttacttttaatagggcattaaagagtaaggattgcacgttttgaaacaatcataatgaaccaaacattttcttaaggcagccataaaccaatctttgagtttcataatgttgataactacaaatttatttttgtttcaaactatcactccctgtaattcattcaaaaggagacttaacactatgtattgaatgcctacggtgtacaggctcccttctaggctctggagacactgcagtgtcatgaaacagtcacaggccctacttccctgaggcttgctttctagttccccaccttcatgttaatagttcatccattcatgggcttaaacatttaccctcaggtttctgaattaataataaacaccctaacagaaaatcaaatatctttcccttttcctttacagtgctttgattatatatccagaagcacttgaaggagaaattatgttattttcaacttctagagacatttgtttgcttatactttgcttactcccttccccaagaaataatgagggaaattcctaaactattagttgatatttccacttaaattttgtcagatgtccaagcctggatggaaagaaaataataatgacatacaatgttaggaaattacagtgggacaaaccctgcatgaggattggacagttatggtgacaatttgggttacttaacttgcaggcacttaataacaaagtaagttacgcttagttctaactaatatctttgtttggtaaaaacagatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggtaggtaaactattatgatatgtcataatatttgcttggggtaaacaacttgcatttgatttaaaaagttctaggtcgggcatgctgactcacgcttgtaatcccagcactttgggagaccgaggcgagtggatcacttgaggtcaggagttcgagactagcctgaccaacacggtgaaaccccgtctccactaaaaatacaaaaattagccgggcatgatggcacgtgcctgtgatcccagctactcgagaggctggtgcacaagaatcacttgaactcaggaggcggaggttgtggtgagctgagatcacaccactgtactccagcctgggggacagagagagactctgtctcaaaaaaaaaaaaaaagttcttaaagcattcatacagaaacaaaaacaaaaactgagtaatatttctgtcttcaagtcacttcactctgctatcatatgtttatcatcctgtttttgctactgacttttcatgtaacatgtaccattctattagtgtgtgaaatggaaaccactctaagtaaccgaggaagaattgcatgggcttggatggttgcaaaaaaaaaaaaaaaaaactggaggagctaggcctagaagaggctgcatactagtcttctaggttcttgatcacaaagcactgcagctgcaatccaggtgtctggaaactgctgccatcttcatggccacctcaccccattggtactactcgtgagtcctgccactgccacctctcatgtctgccagaaccactgtctgctcccactggcccagagaagatggcatccattttccttctacttttcaatctcacatgagtttatttaactcactagcaaaacctaaatcatatctgggattcttcctgccagagagtactgagaagtacacctttgagtcttccaaactctgtatagagaatatagacaaaatataaaagagaacatatagaggaaagtgtgaatggatgcttaatagcactagatgatattaagtacatcaaagaaataaaaagtcagcatttgctgaatgtctactctcttttgaaaatatgagaaagtcagcttcgcgtccttttgcattgttactaagtaagggttaaaacttaaccatcttggagccaaatctcccctctcattaattttgtaatttattaccctgtaaaactacaaatctgaaaatgtttagataggacatgtgctgcttgcatgagacagcaacactgccatgggtaagatcatgaactctgaagctcaatggctcagattcaaatctcagctcagtcacttattagatctttgaacttagacaagctgcttaacatctttgtgctttagttttaaatcccataacatagtttgaattaaaagtattaaaaaggtactttcattatagggttaacaataccaagtacttagaaaacattaacatacagagcacttagaaaataccaactgcacagtccatttttgcttttgtgatttgtactgctaatttcttcatttttttccttatgacaaatttctttttttaatttttgtttttctttacatcttcattaaaaaatgggatacatgaacagaacatgcagatttgttacataggtatacatgtgccatgatggtttgctgcacctattgacctgtcctctaagttccctccccttgccctccacaccccaaaagtccctggtatgtgtgattcacctctctgtgtccatatgttctcattgttcttctcccacatgtttgctgatgatgatggcttccagcttcatccatgtccctgaaaaggacatgatctcattcctttttatggctgtatagtattccatggtgtatctgtaccacattttctttatccagcctaccactgatgggccttggtatcggtttcatgtctttactattgtaaatagtgctgcaataaacatatatgtgtatgtgtctttatagtagaatgatatatattctgttgggtatataccaagtaatgtgattgctgggtcaaatggtatttctggttctagatccttgaggaatcaccacactgtcttccacaacggttgaactaatttacattcccaccaacagtgtaaaagtgttcctttttctctgcagcctcaccagcatctgttgtttcttgactttttaataattgccattctgactggcatgagatggtatctcattgtggttttcatttgcatctctctgatgatcggtcatgttgagctttttttcatatgtttgttggccatgtaaatgtcttcttttgagaagtgtctgttcatatcctttgcccatgtttgatggggttgtttgtttcttataaatatgtttaagttccttttaaattaagaatattagacctttgtcagatgggtagttgtaaaaattttctgtcattctgtaggttgcctgttcgctctgatgatagtttcttttgctgtgcagaagtgctttagtttgattagatcccatttgtaaattctggcttttgtttcaattgcttttgccattttcatcatgaagtctttgcccatgcctatgtactgaatggtactgcctaggttttcttctagggtttttaatggttttgggttttatatttaagtctttaattcatcttgaattaatttttgtttaatgtgtaaggaaggggtttactttcagttgtttgcacatggctagccagttttcccagcaccatttgttgaataggagatcctttccccagcgcttcgatttgtcagttttgtcaaagatcagatgattatagatgtgtggtgttatttttgaggtctctgttctgctccatttgtctatatgtctgttttcataccagtaccatgctgttttggttactgtcgccttgtagtgtagtttgaagtcaggtagcgtgatgcctccagctttgttctttttgcttaggattgttttgtctatatggggtcttctttgattccatatgaaatttaaagtagttttttttctaattctgtgtagaatgtcaatggtagtttgatgggaatagcattgaatctataaattactttgggcagtgtggccattttcgtgatatttattctttgtatccatgaggatgggatttttttttttcatttgtttatgtccttttttatttccttgagcagtggtttgtagttctccttgaagaggtcctttgcatcccttgttagctgtattcctaggtatttgattctctttgtagcaattgtgaatgggagttcatttatgatttggctctctgctggtctattgctggtgtaaaggaatgcttgtgatttttgcacattgattttgtatcctgagacattgctaaaattgcttatcagttcaaggagttttggggcttagacaacggggttttctaaatataaaatcatgtcatctgcaaacagacaatttgacttcctctcttcctatatgaataccctttatttttttcttttgcctgatggccctggccagaacttccaatactatgttgaataggagtggtgagagagggcatccttgtcttgtactagtttgccaagggaatgcttccagcttttgccaattcaatatgatattggctgtgggtttatcataaatagctcttattattttgagatgtgttccatcaataactagttaattgacagtttttaacatgaaggaatgatgaattttatcaaaggccttttctgcatctattgagataatcatgtggattttgtctttggttctgtttatgtgatgaattacatttattgatctgaatatgttgaatcagccttgaatcccagagatgaagctgacttgttcatggtggataagttttttgatgtgctgctggatttggtctgccagtattttattgaggatttttgcatcaatgttcatcagtgatgttggcctgaatgttcctttttttgtgtgtctcttcctggttttggtatcaggatgatgctggcttcacaaaattatttagggacgagtcccttcttttcaattgtgtggaatagttttagaaggaatggtatcagctcctctttgtacttctggtagaattcggctgtcaatccatctggtcctgggctttattggctggtagactattaattactgcctcaatttcagaatttgttattgctctattcagggattcaacttcttctggatttagtattgggagggtgtatgtgtccaagaatatgtccatttcttctagattttctagtttatttgcatagaggtgtttatagtattctttgatggtagtttgcatttctgtggggtcagtggtgatgtcccctttatcattttttattgtgtctatttgatacttctctcttttcttctttatcagtctagctagtcatctatctattttgttaattttttcaaaaaaaaaaaaccagctcctggattcatttatttttttggagggtttttcatatctctgtctccttcaattctgctctgattttagttgtttctcttgtcttctgctagctcttggattagtttgctcttgcctctctggttcttttaattgtgatgttagcatgtgaatttgagatctttctagctttctgatgtgggcatttagtgctataaatttccctcttaacactgctttagctgtgtcccacagactctgatacattgtgtctttgttctcattggtttcaaacttcttaatttctgccttaatttcattatttacctaggagtcattcaggagcaagtttatcaatttccatgtagttgtgtggttttgcgtgagtttcttaatcctgagttctaatttgattgcattgtggtctgagagacggtttgttataatttacggttttttgtatttgctgaggagtgttttacttcaaattatgtggtgggttttagaataagggtgatgtggtgctgagaagaatgtatattctgttgatttggggtggagagttctgtagatgtctattaggtctgcttggtccagagctgggttcaagttctgaatatctttgttaattttctgtctcattgatctgtctaatattgacagtgggttgttaaagtctcccactattattgtgtgggagtctcagtgtctttgtatgtgtctctaagaacttgttttatgaatctgggtgctcctgtattggatgcatatatatttagaatagttaactcttctggttgaattgttccctttaccactatgtaatgcccttctttgtcttttctgatctttgttggttttaagtttgttttgtcagagactaggattgcaatccctgctttgttttgctttccatttgcttggtaaattttcctccatccctttattttgaatctatgtgtgtctttgcatgtgagatgggtctcctgaatacagcacacagatgagtcttgtctccttatctgatttgccagtctgtgacttttaatttggctactcagtgcatttacatttaaggttagtattgttatgtgtgaatttgatcctgtcatcatgatgctgtttggtcattttgctcattagttggtgaagtttcttcatcatgtcattggtctttatattttggtgtgtttttgcatgactggttctggtttttcctttccatatttagtgctttttttcgggagatcttgcaaggcaggcctggtggtaatgaaatctctcagcatttgcttgtctggaaaggattttatttctccttcacttgtgaagcttagtttgacaggatatgaaattctgggctgaaaattcttttctttaagaatattgaatattggcctccactctcttctggcttgtagagtttcttctgagaggtccaccgttagtctgatgggtttccctttgtaggtgacctggcctttctctctggctgccctgagcattttttccttcatttcagccttagagaatctgatgattatgtgtcttagggttaatcttctcatggagtatcttagtggtgtactctgtatttccttaatttgcatgttggcctgtcttgctaggtttgggaagttctcctggataatatccggaagtgtgtttttcagcttgtttccattctacccatctccttcaggtactccaaccagttgcaggttcagtctttttatgaagtcccgtatttcttgaaggctttgttcattcctttgcattcttttttctctagtcttgtctgcacactgtatttcagcaaagtggtcttcaaaatctcatgtcctttcttccacttggtagctttggctactgatacttgtgtatgcttcatgaagttctcctgctgtgtttttcagctccatcaggtcatttatattcctctctgaaatggttattctagttagcagctcctgtgaccttttatcaaggttcttagcttccttgcattgggttagaacattctcctttaggtcagcatagttttttattacccatcctctgaagcctactcctgtcaattcatctgcctcatcctccatccagttctgcgcccttggtggagagacattgtgatcactgggaggagaggggtttttagcattttttttgttgattctttctcatcttcataaatttgtcttccttctatctttgaggctgctgacacttggatggggttttttgtgggagattttgttgttgatgctgttgttgttgctttcttttctttcttttttttttttctttcaatggtcaggtctaccttctgtagggctgctgcagtttgctgggggtccacttcagtccctattcatctggttcacgcctatgcctggagatgtcactcaaggaggctggagaacagccaagatgggtgcctgctccttcttgtgggatctcagacctcaaaggtcaccaacctgttggcagtaggatcactcctatatagggtgtctgacaagccctcttggagggtctcacccagttgggtggcacggggaataggacccatctaataaagcactttgtcccttggtggaggggatgtgcttcactagggggaaaccgacttgtctgggctgcctggattcctcagaactaccaggaggagacgctaagtctgctggtctgcagagaccatggccacccctccccctaggggctcaggcccagggagatctggattctgtccctgagcctctggctggagttattggagttcctgcagggaagccccacccaaggaggaatgatgggtcagggtcaggcctgaaaaggcactcagggtcaggcctgaagaggcattgattctgccacagtgggtgtgttgggctgtgggggacgtgtcttgggaccaagccatccagcctccctggctccagcaggggagaaagcacagcctggagctacagatatgaatgttgcctctcccccacccagggagcttagcgtgttaggcagttgtgattcccagtgctggctgctgcccctcttctaaggagctcaaatggcttaggaagcaggcagctgcagctgtggggctggccgcccctccaccaggagctcggtaggcttaagcagattccagctgaaaggctgttgagaatctgtggggcttcggggttgtgatgctagacccagtggctggagtttgtgagtggggtcttccaatccatgggtttcacagttctgtggaaaaagctgggtagcacattcactcaccgcctcccttggctggggggaagggtctcccctgccccgtgcggctctcaggtggaccactgcaccacactgttcttccctcctctccgcggatcatgccagcctcctagtcagttcttctaagagaaacctggataccttggttgccagggaaggattcacacacttactatagttcttttccatgggagcctccgaacacagctgtttctagttcgctatcttggtcctgctccctgcctccgcctcccccagcccccaccgccccactgccttcatttcttcatctgcttgtctcatttctgttgcttgcttggtctatgttggtatttatgtgtgagccgcctctatgcaaaggcattggtctcagccttggttcttgatttattctctcccctccttccgatatatacaaaggtttgcagaaaggcagtgtatgtattacaaccagttctcattgaaacacgagattaattatatacctctaaaggctacgctttgcaatacagatctccagcctcaggttaggtctccgctgatctgccaactgctcagatatgcctaaattctgcctcttttgttactactgcctgactatccggggtcttccatgtgacctctgggctacagccaagaagggaatcagagacccatggctggtgggtaatatgacatggacatttaggctttgaccccagaagccctaagcaaccttttcatgtgacccagttttacagttcctgcaggatcccagagctgacactgaaatgaacctctggctatctgagtggactgagcaagtgacacagatgttctgccaatttccctaaacaagtaacagggataaaggacaataaccttagctcagaagaggccccaggagcaaggaagcctgggagtaactgctgctggctggccttgactgctgccaagggcatgcacggtgatatagcagggagtagaagtcacaggtatctgctaattttctacaaagccatatcagtaacctcatacttcttaccttctgctgagacaccttctccttattactatgcagaagaccggaagctttaacctaaagggaggttaaacttctaatcaaatatacatggtgaacaatgagaagtgaaaattccttcttctcttctcgcttgtcccctttcttgtgtagggatgcagtaagtgctgggaactgccactctgaaccattagacctacggggcttcatgttatgttagtacttcccatacatgctttctctctttaggcctcccaataatactattaggtagattgaaatgcccccccaggaattttctgtggatttcctacctgcaggtggccatagaccatacaggctatagaccatacactatggttatgaaaaatgaaatggagcatggctatgaaaccatttttagaatttatatcgtgcttaacaaaggtaatggggactgttcatgactgtaggcaaagggagggacctagtcctgtgggagagaccactgtagcatgaaaagtgggatatactgataactaggagggcgtgggaggaaagggcattgagaatccagtgggagggtttttccttggcaccaaataggagctgcttttttccccctccagaaatagtggcaaattaatgagggaaggggagaagttgaagatgcaaagatgaagatgcagtcatagtgaaaggtctctttctaacaaattaggaaataaggtaatttgttcaagcagagaggcaggagaaatgggagttggggacattaaaacaccaaccatgagaaatgtgattagcaataagccaaaaatgaatgaaatcaacttgattaatattattagtaacactctctgagcacatactctgccaggctgtatgcactaatcactttatgtgctttacctcatttaattctcctaaagagaaagaaaatattgttatccccatttttcagataagatgaattaggctcaatgttttgttcaaggttgtacaaataataattgatggaactgagccgcaaacacaggtctccaaagagagaatcgttttgtcatagtgccttcagggaaacacggatattactcagctgaacagggtaagacaacaatggctgctgacatggattagggactagcagactggataccgcagatgaaggagtcgagtggttttagtggatagatttctcaggcaaggtaattaagcagatgaaggcaaacagaggaaaagattggggcacgaagatgtgaagaggtttttagcttcttctaagagttcaagtgttatgagagtagaaatgatacaactttttaaagcagaatcccagctgacctatgatgggaacataatgtgagggaggaataagtgactgttttcttgggcatggggaatttggagctgtctgttactgcagcacaccatagtgtgaccccgtgtgtgattttctgtgtgaccctatgtgtgacaactatttgtgattttgacatgtgacagaattatccaggcttcatgttcaaatgcaatggcccttgccccatctccaaatgtactgatttggaacctggactgaggctggaacacgacatttttaataagttctttaggtataccatacctaccacatttcgaggactagtgaggcacccaacgttgattaattggaggcacctaagatacatttgtgagactggaaacaaggcatagtgcaaccatgacttgccaaaaaaattggtagctttcttctctggcctgaaacaccccgtgccagggtataaatcttggcaagatttcagctactatgggccctcgtgcagggcacagaagtcctatttcaagaggttattaaagtatattctttcatctaagaaggtacatttttcaaaaattgtcaggatatgcagtattctaatattgtatcaaatggacacctgagtaacatgacctgacatgttaattcatgtcaaagttttattatgtctagaattatggtgagattcttgattaacaattcaaggtaatattggttggcaaatctttctattattggtgtaggaataagggctgattctgtctataatcaaaataactatgtttcattacactgcaatttaaagtaggtttatataattcaaaattctcagcattttatatgaaatgtacataaaaatattaattatgtgagcctcctttcctcctcacaaggatgacactatttaagttatttcaacaaaatgctaattattatgaatacattttaaattttacggaacttgaaaaatactttaatagttatctcaacaatggtacggggtaaaaggtgaagtttataaagaagcagttttctcatagtaaacctgatcacaaattggtaaaaacaaatgataaaaagtgaggtgaaatgatttgcaaaaagaagtactacactgccatcttctgttcaaataagtcatatgcttcaattgctatctgatcttaatgtgcattgtacttgggagtggaggggcggagaaaagagaaacttgtgaaaaactgagattatccgactccttctcaggtattctggttctgtggaatggagatggaattcaggaatctgcctttgtaggaagcactccaatcgagcctatataggtgattccctaaacataccttaagaattactcaaatatatcttggccattgtgaggtatgatgcactctttaaacatgccaggcaacatacagttccatcactgacccatgcaaacagatggttagatttcataatttttaatgtgattttgtttatggctatgtagacagttgtgtatgctagaataattctttatctccaggtttcaactgtggcattctctaatcaaatttgcattgcataaagtcatctttcactcttagattgttttcgataaggaatatgcatttttaaaagaattgggtttctatcatttctattgttttccttctcatcatgtactcactttttttctgataggataattattgatggagctaatttgaccatatctaatgtaactttagaggaccaaggtatttactgctgttcagctcatactgctctagacagtgctgccgatataactcaagtaactgttcttggtaagtgcactaactaatgagaaatctgttcatttcttcatttctgattaaatcccatcgttcctggccaataaagctaatgattctttgagcccctgcacatatattgttagtttcaaatttttgtttaaaaagcaacacaacttcaaatcctttctccttttttcatataaaagaaattaattaatgcttaattttttttccctacatgtgttaatttgccaatagcagtgggaggtaagtgatgctatccgcagaaagaaaaataaagcacgcttgagttcctagcactcttgagctactctttcctggtgtacaaagaaatggggctgaggaatggaggtgggctagactggaggatctcgataggggtcaagaggtggatgcacggtggtcatctctaaaccaaaggcacagactgagttcccagggttccaggaaggatggagaggaacttccagcattctacaaaggaatgtctttgatttttgtcgttgttgttgttgatgaaagtactaatcaggaaacagtgtgcacacttcactagtataatcaatgcaattactcctgaaatcaccaatgtttaaagctcttagaccatctgctggatgttttccaaaatttcccttccagattcactctctaccagctctttgacctagaaaggttgcttttaaggacaacatcagcaaaccactttccttccagctattatttggttcagcaagtggagggccgtttggagtgttgtactgattctccctactccatccctgtggactggctgtgtcccactgccaaagtcatggcttctgcagacagggtctcctcacaccattccttctgatgaggctctagcagctgcatcccaccaccaatatttcaagtctctctcacacccaacctactgaacatcctgcccacatctttttaaagacgttttattaaaacattttggaactatcgtaaatttgtgtgagttattcattgattttctgcagggaccctaacagctacagacatttgttctgtttcggtggccaccatgtagtctttcttttagtttgcagacattccttaaaagtgttggttttgcctacccttctttatcatatgtctacattaatcactgttatcaacagacctttgtgtctttagcactccagctgttggggccacctgttaggttccaaacaagggaggtggtggtacagaccaagggagaaagttcagtctcttctgagagactgataaaaaaatgggtcaacaggctggatcccttcaagtaaagcaaatggccaacctgtctcgggcgaaacaaatggccatcaaggttgggttctaaaataaaagaacagtttccacttacagaaggtatggacttgtagagttgtcgagtcggctcagtagaattgtacctttaggcagaatgtttggccattgggtatttgagcattttcaggtctttacaagcagaaaggtttaatcccctaggatgatttcaacaataattcatcagataaagtagtcgagcttcagataaactggaattcatcccaggcctagtgagtagaggggtaagtgtcaggctccgtgcgctttgtccctaagtattttgagcagtctcagccaccaaaaggaccgggtctcctactgcttggtgctccccttctcaatttccttacaaaatttaaaagttcattcttgcgattaggctgccatttttggaactattaatttttttaattctacataaattttacctacgattatatgtactggttatatacgcagtaatctaccagtgtttacagaataaaaataaaaataaattttggagaatattatgtttaaaatttacattcttttattttttagacaaacttctgatttaccaaagcatctctcgacaattgacaataaaaaaataattatatagacacatacgaggtttctaaaagactatgttttaccccctggaaaacaattttttaaagtacatacttgaccccctttaatcaaaagttatttttaaaagccttgacataaacatgctttcaggatatcattttttaaaagtttcagttgcaagttcatcagttctagctccatacgattctcagaagagccagattttaatatcagatgcaatacacagccttagtttattccaggaagcttcagaaatcagtggactcagtaaatactgaagagaaaccaaagtcctctgagctcagagattctgaaacctgttgaagaattaactttttatttatggctttaatgtttggacacagtcatgaaccacattttttaaaaaacatgttctctcttctgaattggaaacgatgctttttgtcaatgtaaatttctaacaattagcaaatattcaggaggagcaatggacggtgctttccacttggagaagaaagagcccattgaaaggctacattagataatatcttccttttctcttctgctaaaagataaaagtcctccaatgcttgagagaattcaaacccaattttcagagtaaataccattagaaataagatttctttttactgttgctttattttcaaagtaccagaaattttcattttctttagtactcaaaaatttgtgatcatttacttacttaattttccagtttctgtcacaacatttaacaatgccaaatctccctgttctgatataaactgccttcctactctttttgagaactccaggttaagacggtatcaaagttgctataatgaaaattcattgttatcaataatgataaaaatccaacacagttgcagaaaagaaagcagagctcatgatctctttttctataaccataagacctaatgtttattgctttaatataataattatacacatgattgaagtaataatatctttttcactgatttatttagttataaaacatttatgtgtgaggcactgtgggcaatgcaaagcttaataaaatatgacccctattcttggagatgaatcaggcatataaacaaatatgtactggacaaacagaaatgattcatttgagatacatcatgtttcccagacttgggtatacctaatccccatccaaggaacttgtttgcaaatgcagattcctgggcccaccttcctcagtaagccagaaatagggcctaggaattttcattgttattaactactcctaaaagaattctgatgtccctggtcaaggataaccccttgagactgtaatcagagaagagggaggtaatatggtccattggggaggacatgtggagatgctgcattttacaaagaaccccagaccccagagcctgatgcgattgaacacagtggagacatgggcccagaaaagaagggtttttatggaaccaaactggggtccaccaacccagtgcagtaagaccaggtatctatactgaggtttgcagtgggagaaaggaagacacttatctgcagggcaccaaacaagaactggtcagctcatgcttaagtcccaacctccccagtggcttgcaggtgaaggtatttaaaagcaggagtaaatttcaggagagcaaatgctataggcaaaatagtaaattagtacattgaggttacacattgctttatgcctaaaagggtgaggtatcttgaactggagttggggcatggcttacaggtcataggtggattcaaagattttctgatttgcaattggttaaggaagagaagctttgtttaaaaattgggagtcagccaaaaagaatattagctctggctcatggatgtggctccctttaggccctcaggaagaaatttacaaaaaatgatggtcagaactcagacttcagtttccccttatctgaggtctccatgccagcaaagttatttggtgagagtctgggttccagaaaaacaacttagagacatatattaagatgttatcttcagtttctataggagaaccaaacatccctgtgattccagcttccttggctattgtttaaagctactattacctccgttcttatcaagttgtttatttacttcttagggctagctaggtgcctgaattacccttgaaactccacctttcccttccatatgtggggtggggggcgggggtgcttcccaggtccctaagagggtggtacctcctctgtctccgggtagctggcaatgtgtctgaggaagggaatcaggtaaacaaaggcaattatctacattttcccttcctttattaattagatgttccggatccaccagaaaaccttcacttgtctgaaagacagaacaggagtgttcggctgacctgggaagctggagctgaccacaacagcaatattagcggtaggaagacttgggataactgttttcattactctagatagtcaaaattaatagcgaagtcactttttaaccactcttactggtttattcttcttataacatccttttgaacttttaatattgagtataaattttggtataacttatccatactccatacattctaatattttttccctgtttatactaccagagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcaggtatgcaggttctcacatcaggtttctaacaaaatatttgtttgtccccatctttgaacatctaaaaaaaaaagattgatagagtaatgtaggattttagatttctccaaatagtgttaacagttctctaaacagcacacaaaatattcaaagcacacaagtttcagaagtgttacatacgagttcgataaaagcaggaaattaggggagtgacatatgaaaaaaaaacattactttcagtaattttgtgatggctaaatatcaagtttaaccagatatcatcaagtaagttctaaattaaaattcaatatgtatgcatctaacattattaatttttatgcattcagtgtcttttcttgtgtctcaacatcaatctaaatttccaagatgcgtttgaaaaaatctcaaggatgactgctaaaatttgtattactgaattgttattgatcatcaatgtggtcatagcatgatattttatttttccttggctaaaataaatactctaggacataatttcctttttggactgagaaaaagcaagtgaaggttataactggatcagatagaaattaacacttgtgtgattttagtgcatgtcaacctttgcactaaactccacatttagctatttctaataaaacgaatccatctaaaaatattcatgactactgtacaggttttattcattttgatgtccttaaaacttggctgctgatattaatacatggtgtttactttattcttctacaggcaaatattcacaacatatgtttctaatgacaattctaatagaaaaaatagagcaggcttaaattaaaatttttttttaaaaaagcaggttcagaattttaaaaagcagttttaaaaattttaaaagcagattcaaaattaagacacatatactaaaccatctactctccactggataataattatttcactccaagaagactgttttactcttttaaataaaatacatatttaaaatctaccttaaatctttttaggaactggaccagatataaattaataagtacaatcaaacttacttaattatctgtgtttttggggggcaggagttgtgatatgatgacttacctatgggttaaaaggaaaaataatgttaatgtttttaatttttcagctccagataggaatccacaaaacataagggttcaagcctctcaacccaaggaaatgattataaagtgggaggtgtgtatttcttaatacgttatgtatttctttgtgcttttctcttcctcttaggtctgcatgctaactacaatgatagcacaacatttttttaagaacaaagataagatttggaaatgaaattaacttgtgagtcatcatcacaaattttaaagatcattgtgattaaaatgatgttatgaaatcgagtttaacactggtcaacaatttagggaagattatacagattgatttagttgtaatacattaccgaagtttcaaattattaataatttaattaacaatattctagattctcttccattcaaaaaatactgaaaatctttaattaatttagtataatctactagatattatgcatatcaaactgatgaacccccataaagtattcactactcattaaacaccagtagacattttgtattctcctttctagtaattctgaggatggtcttgtgaagaaagcatcatgaacgccttattctagatctggagatggcatccaggattatgaatgtcttgcccatcaccacacaaccagaaatccgcaaagctaggatttatgtatgaggatctttggactccaaacctcactttttcctcctttacatatctcggttaaatgttattaaatagacttcaccatttgaattttgcataaaaatgcccatctacccagataattttaattattctagggtcatttccaaattttttctgtaacagtggggcattttattttctctctactacttggatgtatttaatgaccagtatattggcctacctaaaaggaaattatcattcaaccattctgatgagtaataggcctccaacattgaatttataaaattttgtgtaaacatagaacatttttaatgtatgctgaaatatactaatttatttccacaattcattccaggtataatttttgggagaattttagaatgcacaaagtttagtttgctttttatcctcatatgttggtctttgtactcattacacaatcacatggcccatacctgcaaaatatttagtcaatattttttagatcaaaattagatctttatttccacttcagtgaaattaagttttacaagtttaagatgtggaaaactttttttaaaatggtaatacatagaaatgaaatatattcaataatattatttctttccttgaatgtgtggttatagttactactacattgtcttgataattacttaatttatagtctaaaatgatgttagtcttttagggtgtatctgtattatcctcccttaagttccatagaaattttcataaagtagataatatagttggttagatatcagtaatactgtgtatttgccagtcagttcctcagagaagcacatcatgttccagtaacattagctcattaatcctcactactcctttgggagggctgtggtccatgatggtgtcagtcttatatgtcataaagagaaactgggaatctcagagtttaatgacctcacccagatgccatgggctgagtcatatggaaaaaaggccagaaatcttcagtctttttgactgctcctctcactcataagtcattttttattaccccaaagatacacaagattgattattaatgctctcttcttgtaagaatgggactgtactaagaaagcatctatggccaggtgctgtggctcatgcctgtaatcccagcactttgggaggccaaggcgggcagatcacaagatcaggagtttgagaccagcctggacaatatggtgaaactgcatctctactaaaaatataaaaattagccaggtgtggtggcacatacctgtaatccctgctacttgggaggctgaggcagaaaaatatcttgaacccgggaggtggaggttacagtgagttgagatcatgccactacgctccagcctgggtgacagagcgagactctgtctcaaaaaaaaaaaaaaaaaagcatttaaaattggtctttgaggagcaaacgacatgtcatttagtaattaattgactagaggaaggaagtagtcacaggatttggatctaggctgacagttacattcccaatatgtcccatggtgtctcctattatcttgatgtgtcagagatctaatcactactgacacagccagtgaagtttaagaacattcattcactgagtatggttctgtatggatcatcctgcggaaaggagttagactccaggtttttcccagtttcacaatcagatagtattgtgaatgaattaccagaccccctccagagatgtactagaaataattcctatctacatgataatggtcagagggacataatttgaaaaaaaaaaaaaaaaagctgatctttcccaaaagaattaacaatgaagatgagcagtaggaacagactggacatccctaatttttgtttatttgtttatgttttacatttaacattaaacatgattcaatttaaagtaacattacaatttaacttaatggtagaactaggctttttagttagcattaccttcagacattcacttctcatatattaagtcggtcatgactcactcatatattttgagtgttcgaacatcataatgttctacttgcaaaacaggacaaaagagtctactgcaaccttatcagttaaatacctgtatcaggataatttttgcttgagagtttccattgttcttaagcatatgtatgtgaatttttaactttgctcagcaaaataacacatttcaaacttaaaggacaccaaaagcaaaaccaaaagcccaaaaccccactaatgttgggaagcaggaacatctttaattacctggttatataatcgcatccaagatagttaactcctaatggatctaggttttattatttataatacaagtataataagaagacctactggctttaaaatgaaaataagtggaattaaatgaaatattgtataacataatgactatagtagataacaatgtattgtattcttgaaaattgttgagagactaggttttaagtgttctcatcataaaaaataagtatatgaagtaacatatattttgagtagctcaatttagccactccacaatgtatacatatttcaaaacatgttgtacataataagtagatacaatttttgtttctcaagaataaataaaaatgttcaacaattttttaaaaaatggaatcaaggcaggacggcagtctttctgttttctagattaatagttataaccttgcttgggtcatagatctctttgaaactatgttggacgtgcaagctctttttctagaaaattacacacaaaaagtcatactaacaatatcattggtttctcagatcctctaaaggatacacatgtaccccatctagagattcctacaccccacgttaagaacctcttttctaaagactccttcctcgtgggctccttcacgagaggcagagggaagggaaggctggtggcctcttcctgcttactctgccctggctccttttgttctttcttgaagagattatttgggaaatgtctgaggctcagtaggcattgccttcaagtcaaatacaaagcattcaggctgtttatttgggttcccaggtactaaaaaggccgctaatatagctaaaatatttttgtttaaagtgttatggtttattatttatttatttaaaatttgtcagagaactttattaaatttaactcctttctttggagcaaaatgtgtaaaatgaataatattatttgcacacacttattgtcagcagagactgaagaaaactatcattccagattgcagtacggcactacaagcccatggcctaattcactgggacaatgctaaagcccctggtgaatttatatccatttcacactctaaaatatcttggagcaaaactttccaatgaatccaagtattaacaaggtctgcagaaaatctcagaaagttttcattttgttttgattttttttttccctcagttagtttagtttattcaccttggaataggaatacacttaaaattattttgctgatatgtcactaccctttcaacttaattccaagcaatgcctctaataagtgttttagtaaattagattaagttgagaaggattacagattctgtaagaacactatgtatgacattgttgactcactcacatatccagagaaaattactgtttatataagtgaaccttaaatttaggattaaaatcgtattttaaacttattttatataactgattcatttcaatgcacaatcccattatctttgaaagctaaacaggcagtttaaaccacattattgtttttaaattaaagtgttgctcaattaaaaactaaagtggaaataaacaatttcccatactagaaattattcctccaggctgggtgctgtggcccatgcctataatcccagcactctgggaggccgaggcaggcggatcacctgaggttgggagttcaagaccagcctgaccaacatggagaaaccctgtctctactaaaaatacaaaattagccgggcgtggtggtgcatgcctgtaatcccagctactcaggaggctgaggaaagagaatcgcttgcacccgggagatggaggttgccgtgagccgagatcacaccactgcaatccagcctgggcagcaagagtgaaactccgtctcaagaaaaaaaaaaaaaaaaagaaacgaaaaaaaaagttattcctccaaatatttctatggagaaaaataaagtgggtaagggtgacattttttcttaaagaaaaataaagaatggtcaaggagctgggaaattataagaaagaggagctactgtttttttgtattaaaatatgaacattcatattctccaaaaatatttacatgatctctctcttcttatagaagaaaaatggagaaggatagaaccaggtgcaagaaagagttctcttcaaaaagccatgggagaatcccattcacaaccaaagaattcgtggccatattattttttatttcagcctgttctttgaaaatgaaaaggcggaatgtagtggaaagcataagcaaaaagctaaaacactttgtggaatttctttgtaacttccttcgtgtgtaaaaacttaagactttaccatgaggacataatccaggcatctgattgtaggcttctcgttacttggggagttaagggattaattttcatacttaagctcatatgatgacaaaactttttcacaactgtctctaaaccaagaagggggatttaagatctctcaacaaatgaccatttcattacattgttccttattccacttagggtggttcaccatcatctctgagtcaacacatctgtgatcagactaaatgagtcttgccttctgttttagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactgtaagtgatgcacctaaaactgctaagcacgtcagtaactgttgctttcaaatatattgtacttcaatcaacaaatatttgtgaacaactactgcatgcaaagaggatgtactagccgtgggagataaaaacaaatataacacatgacttctatcttaggattgattgtaggacagttgatcgtatagagtaccaaggaagtatgttgaaagttttcattttattcagtttcctataaagctctttctacattgaaaattgaagacctggaattatcactgcaatcatttaaagcagcataactgtcataagattttcaagtacatctgccctttgcccttacttgtcaaggatcccctaagagccacttgctctcatgccctgggcttcagtggcatgtctggagctttcctaatactgatgagatatatacccagatttatatgtagaattatatgcacacacaccttctgatgccatagtaactgctgcaaataggttattggaagaagaaaaaaacactgcattctgtattgctaatactgtgaataatattaggggttattctcattgcctttccagcatctaaaggaataatttgatccaaaaatagaaaaggttcagaatgagaaatagccaactcattactcacctgccgtctaaattcttctacccaaataaaagcacacaaaacacatatcacaagtgaattaagatagtattagccttgactgctctgtatttggcttattactctgtagtaagaactcctgtagaacagagataataatatcctcttcacagggttgtatgaaccaatttaggtaagtcccttagaacagtgcctgacacatagcatatgctcaaatgttagctgttattaatatttgattaacaaaattcctgaccaattttatttatattactagtttaattcacttgcttccaaaggcaagatgcccacagaatagtttctggttttatttatccacattgtatctatctggagggctttgtttctcagtgtgatacagtctgtcctcttctttgggaaatctatttgggctgataaacttatctatcatgagaaactcttttggttccatttggagtgaatttcacaaaagtgctttctccagaagaaacattatgaaaatttttgaaaaggatcctaacaatcacatttgcaggttattgaaaactaatcaatcttctatgattaacagatcctgatacagctccagtgatccatggggtggacgttataaacagtacattagttaaagttacctggtcaacagttccaaaggacagagtacatggacgtctgaaaggctatcaggtttttatcatcatggtttttcctcttcttgttgaattggtatctttcctgagaataaagaagaattgatttcagaagaagtcaaagagaatctgcgaccacaatggatatactaaaagattttggttttcattgcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggaggtgagaggataatgatgtagagtcatgtcaaaaatggaggtgatccatggccatattaaacattcttccttatggccaggcacagtggctcatgcctgtaaatcccagcactttgggaggccaaggcagatggatcacttgaagtcaggagttccaaaccagcttggccaacatgatgaaatcctgtctctatcaaaaatacaaaaattagccagatgtagtagtgcatgcctgtagtcccagctactcgggaggctgaggcaggagaatcacttgaacccgggaggcggaggttgcaatgagccaagattgggctactgcattccatctagcctgggccacgtgagactctgtctcaaaaaaataaataaataaacattattccttattagtagttaattaatatttacttcagatgagtttgcttgtcaatttctataaaatttataatataataaggcttttttgaatttttctaattgatgtgagtttatttttggtcttgtgttttctagtacctgaacagccaacttttctaaaggtcatcaaagttgataaagacactgccactttatcttggggactacctaagaaattaaatggaaacttaactggctatcttttgcaatatcagataagtaagtagaaatttgaattggagttaacttgttaatgtttcattttttggttgaatattctctgtgctatgttgggagtctaatgatcacttaaggccatggtttgtaagctgccgttcttccttgtagcccaggggtctgtaaactggcttgcaggccaaattcagcctgctgcctgtttttaggaataaagttttatgacgacatggccatgtccacttatttatatatgtctacagctactttctccctggagtggcaaagttgagtcatctcaatggagactacacagcctacaaaggctaaatgtttaccgtctggccctttaatgaaaggtttgcttacctgttttagaaaaaaagcagtgtgctgatgggtacacaaaacacgtgtttaatgtttatatataagatgtttggagaagtaggaaacatgtgaaagagttattgagtgatgtgatggagattcaaagcataggtaccttccacgctacctcttctgcctcagatatatgctcccagactcaatcctaaatatgcttgtgtttatccaatgtctatgggttgctcactgtttcatggagatgatattgcaaggactaaataattgtctttggatcatgactcagaatgggctctgcccagatgctgctgtgcgactagagtaacgtgaatgtgtttagatgagatcaggtcgtttttaatagcagcgcgttccctctgaaacagtcgtcaagtttaagcatcatctcaaaatggaaattcggggattgacattatagaaaattttatcaacaacccatcatgaaaattttaggctttcaagacatcaattcccaaaacaccagaaatacagagacccagcacacactgcttactagtcaacttgatcatagtcctgttgtgctactttcacatcagctcaagacttccagcaatccaggtcacgtatttgctttagtttctgatggtttctgctgaaattagcacgtatgtttaaatacatacaggcataatcccaacggaagtagactttagcacttttacgtgcttgctaagtagcaggatcaatactaagtgtatctctttgcattgtgccattaaaataagaaatctattagaaatgtactatcactattttatgaatgagggaattgatgtacatcagagtcaagtagtaaaataagtgttaagtgggaggccgaggctggtggatcacgaggtcaggagatcgagaccatcctggctaacacggtgaaaccccgtctctattaaaaatacaaaaaattatccaggcgtggtggtgggcccctgtagtcccagctactcgggcggctgaggcaggagaatggcgtgaacccgggaggcagagcttgcggtgagctgagatggagccactgcactccagcctgggcgacagagccagactccgtctcaaaaaaaaaaaaaaagtgttaagaatgcaaagcaagatcagtccaattctagatgttgagctcttaaccttatattagtcgatgaactggttttcaaaaaaattgtaagaactgcagaaatattttaagattcttttaaatgtcaatttgtttggtaaagatataacttctccttatcctaacaataggaaactcaactaattaaattcccaccttcatattgatccgtatgtgacatttacgtttatttaaaaacaagttcttagaatatagaagttgaaatattaacaattgtaatgattattgaactgcttgatatgtgtattttaaaataaaataatatataattattttgctttctattaatattaattgatcaagacattttaggtagtttacctttttcttattgcttttagatattttaaattgttgcaatttatatgtatgagagctctatgtatactctcctgaattcttatattgattgtagtcgtttttcaattgactttgtggtcattcacaattatgtgttcaaaaaatctaaaaaagtgatgatttcacctccttctttccaatgtttgaatgcctagtttgtttgttttttcttttcattgatttgaattgcatttttatggaccaaggaaggcatttttatgtcaataataaatgcatttttttaacctctatggtatcttggactgggagtcaagaggatttattctacattccttcttgccactaacagctgcactatcttgggtgtatttcatctcttggactattgttacagtaatcttataatactccatactcttacacaaatctcatgtctttgctgggttccaaattctttgaaagaagctgtctatctgattcagctttttacagtgagcactttacatagtacttagtacacagtagatattcttaaatatttaatatattccttcatttattgattctatgtatactgagtagctatttggtgccacatgttaaactagaaaccatagaagacacaaataaattatcatctcaattattcttccaaaaggaaattataatacttaagtcaaagatacaatgaaaatatagcaatggggaaaattcattattattaatgcgtattatgaagctggagcagctggctccaatatagcacagggattaaagacgtttctctggggtcaaaaggccatggtttggattcaaatcccagtctgcaaatttagagacccaagatgggagcaaagggcttattcttgcgagacctcagttttgtcatatatgatatagtcatagtagttgtatgtacctcataggattaaatgagttgatggttatgaatcattaatgtatctttacgtaccacaagcataaggagaaatgaaaataatgaagaatgcaacttgaatggttaaatacatttgagctgttgttcatgtttatttttttagtaaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaagtacatgaggcttctctttttaatagaggctttaaaaagagactgcatctttttaaacagctgcactgaaaggaaagcaccgtgccagtcattgtaaattagaaatgattgtgatcccactctgtctgaccttctgttttccactgacatagaggcagaatttattaatctgtttggaaagttcacactgactcaatttatggatttctgcgcaataccaatcaaattatagcttagtgtatacaaggtcaggaactataattttacttaattaaagtagcaggacataaggtcacaaagctattcaaaaggttagtaaaggtacgtttttcttttagaaatgtttccatacagaaaaatatttggctcttccattggtagacattacagatctaatacatctcactttcatgccttcactctatatacattgattcatatgtcaattttgttttactgtctgatgatggatgccaagcaactgtctgggaaatggcttataaatgtatggtttcacttgtaacacaattatcctaattcaattacacttttctgtttttttctacctttaaccatttcctttcccaaattgcatctccagttatgattttagtgaggttcttgctaagctttctatgatagcaacaggacctttgcagagaaatcaggtcagaggaactgatgtacacacgaagtgaaacagagagagatttatgtagggcttaggctgttcaggcatggaaggatattggagaaagaaaagaaggatgtagaagatggcagaaagggaaatagagttgtttatttatcatgtattaagtgtggtgcaaaagtaattgtggcccttccattaaaagtagtaatggcaaaggccgcacttacttttgcaccaatctaatactatgtgtcagactgtgttctggatgcttttccaagttgtagattagaaaaacggtagaatcaatgaaagaaacatcacagaggggaaaaatagtagagaaaatgcagttgcctattatttattgaagatgtatattaaaatatattcaagcttgtgagtgactgtaaatcaccgtgtttgtgtgtgaatggttatgctctgacctttaatattggtttgtttttacatcttattgtgcctactatatctaactaataacaagcttacgtttttctcagattccttaaacatttaaaagccctttatgtgggaaaattgtataatccaaataattacttccctaaaactcacaaagtattcccagggatgaattgaacaccaagtgaaatgaagaactaatttcactgactttacctactcataaaagttagacttaaagatggggattggaaacttcccagtaactaaaaggttcttatgtctgaagcattggaactgacatcaagtgtccaatacaaagagaagtcagagtggtagtagtccaaacatgcaactgccatatttttaaaaacagaatttaaggcatggagttggttgctattttgatataaccaagaccataatgtgcatgtgaaatgctgatcccattcttaccaattggaagcacatgagaaaaaatattcacagaattgcctgacaagtgttacacattctagtatatatgttgcgaaatttgggcttggttgcattcgtgcttgagaaattgtttttggaggatgaaagtgctgttcatgtgattttacaggtgatgtggcatcttttctttaaactaaaaatgtaactaatgtgctgcatgtcttaaagaacatttcttcactgtcgtatgtgtcaggaatttaaaaatgtttcttactggtgtgtttgtgctctttttcaggaatccacattttcagtattccagctaactgcccccttcccgagttgacactgatttctattctataggcatgtcttgctataagtacagggaaaaaaattacaatctctttttctactagagttcaacatgatctttgaaaaaaatatatatttccaatgaggagagatacatcttgttatcagtcagcactctaaaaatgatcacttgtgcaaataggaacctactgctatgcatctttcttcttgctctgcctatatagctcatttcaaggtcatttggcatttgttcaaaaaataggatttgattgacaagtatttttctctgattgttttcactctgatttccaagtaaatcatattccataatctaagaggggaaaagatggagttaatcagaaatattatttttgtgtcattagcggtttgaataaatcacttgctttactctatttttcaaaagcttgcactacttaatgttatactaatatctctgtttttcaaggtcaaaattaattgcactctgtttcaatgacgcttaatcttgaaggctttgctcatataattggccttatttctctcatggtgtcatttttaataaaacctttttgttatttagtaactatataattaatttttattttatagtgaaaatacataatgaaatattgatctgtaacatatacccacttaaaatagcatttcataaccccttgtagtctcagtaagaaacatattttatatcattgttaacattttctgggttatgtttattatattgagttgattcccagcaaagctgtggatcacatgcaaaaatatttaagatatttggtggtaagacaagaagttaacatatttttgttcaacttgattcattttatcttctactatgagattctactattaacatattgacatattaatattttttgaaaagtattaacttctcacaccactttcaaaatgtcagtaaaaccattccattggtatgtacctgcaagcctgcatttcacgtagtttggacttctataaatttcaaatatttaatatatgaccatattttaatgctatttcatcagtgtttatggagaagaccaaagcaaaaaaaagcaatatatagttagttacgattataaggttatgtgctgtcaattataagtcaaaaggccatattcagtttcgcattaggtttgcgaaaatccaaattgcacaaaattatattgtataatttttttaagtctgtggttttgaaccattcatgtgaccaggcagatttacagtaccatttcatcttaaatggccatgcattgagttcatttcatttactcaatttcattatattaaaaaagaaagttgaaatgttgattttcttgatctcctggtaattcaaaaactatctgagaaaatatggtataagtgactttcttattcacctctaacaacaatatttttttatgtcctgtttttccatgattacaattcacatgatttaactgtgtacatttcttaggtaaaggtatcgggaagatatcaggagtaaatcttactcaaaagactcacccaatagaggtatttgagccgggagctgaacatatagttcgcctaatgactaagaattggggcgataatgatagcatttttcaagatgtaattgagacaagagggagaggtgagaaatgagattatatttggggaagtcttagtcaatctatgtcctgtagaatacttagtgttgcctgtgtcctatattaaacataaaaacactgagtgtattaattatgaaaatcgtaatttcaatttgttttgacatatttttaaattatcaaaatgaaaaatgtttcacagtagtccaccatcctttattttgtttttactagagttgttgcctaaaaatatctcctgctaattaacatatcttaataacacaaactaaaaagaaaaagcaaaacaaaacaaaaaccaccggtctccatggtcatctgcttctaaccaaggcagcttgcgcttttgtttgctccttgctgcttctgagtttaacttcatctgccttcattatccttctttggtttttcatcctcggaatcaaacacaactcgaagaagtccctttttaaataaagaaggaaagatttaccagtattctcccattaacatgtccttcaaattgcattccttctggggtcattaaaaaaactgatactatttggtatgtttaaaaatgatgtctaattttccccaatgttacagaatacaaaagactgtttctagtttacaatgctgtgacttctctttctaccacagaatatgctggtttatatgatgacatctccactcaaggctggtttattggactgatgtgtgcgattgctcttctcacactactattattaactgtttgctttgtgaagaggaatagaggtggaaagtactcaggtaaaattgtttcttaatgtgattttcaacttattaaaaagcattttctgggaagcattcttcagagacaactttttttaaaaatacacattcaagtcaaatttatattagcaagttagatgtacaatgcactgacaggaaaaacgtattgctaaattaaccaaagaaaatatgtatgttctagtttctagcacttaaaatgggctctaactgccgggcgcagtggctcacgcctgtaattccagcagtttgggaggccgaggtgggcggatcatgaggtcaggagatcgagaccatcctggccaacatgatgaaaccccgtctctactaaaaatacaaaaattagccgggcatggtggcagctgcctgtaatcccagctactcggaaggctgagacaggagaatcacttgaacccgggaggtggagtttgcagtgagctgagatcatgccactgtacttcagcttgggcgacaagagcaaaaactccatctcaaaaaaataaaaaataaaaaataggctctaacaaggttgataacacttccaagcttctattgtctatctgtaaaatatcagcgtcgttgagagacatatcactaggtcacatatatgctttagtgttttaagaagtgacccatgtatagcacgcctctctctatgcatgacatacatgactcatatttttcgcactagtgcattctaatattactggctccactggtcaattttgttggtgttaatcattactaggaatgcatttcttattaccatggcatgtagtagacacactgcctcttgaattaatgatacataagatatacatgaaaaccatcatagttggtaatatgacgtttgcctttaatttcattcaactcccgaatttgttttgtctttttcagatatacatattgtatcaagatgatgattattactagtattgcttagtattcatgatgcttttataaagggacaaagatttaggttacactgctatttgtttcatgatgttcagatatatgagaagttcattactggcttatgatttatctagcaaatatttattgggaacccgtcatctacatagaaacattgagagcataatttctaggtttttgtaaaatgacatgcataatttatggagttatgcgtttcacttttttctctgaagactgaatgattatgaattaagttcacaatgactaataaatgttctgagtaattaattggaaacgttaaagagttatagcattctccttatccccaacagataatcatttgtgtattgtggtgctatccagattccaaagatgtttcttcaaatcatgccctaaaaagaaaaaaaaaattagcatttcatattgtagagcaactaagagaatctactaggtctctgcatgtagtcgtaaaatgttccaggaagaacaatttgtatttgagggctttttttttttttttaagtaaagggaacaagagctttttggtcttatattccactaataagagaaatcagccaggcatagtggtggctgcctgaaatcctaactactcgggaggctgaggcaggagaatcccttgaacctgggaggcagaggttgcagtgagccgagatcacgcctctgcactccagcctgggcgacagagtgagactgtctcaaaaaaagtaataataaaataaaatgtcagtggagacctgaatattcagattgttgcaacaattttgagtaagagtgatgtataacaaccaaatgactgcctttttttttttttttttttgagacaaggtcttgttctgttgcccaggctggagtgcagtggttctatctcatctctttgcaacttctgcctcccaggctcaggtgatcctccaacctcagctcctcgtgtagctgggactacaggtgtatgctaccatgcctggctaatttctgtgtttttaatagagacagggtcttgctttgttgcccaggctggtttcaaactcctgatataaagtgttctgcccaccttggcctcccaaagtgccgggattacaggcatgagccaccacatccagccttgattgactttttaaattcaatttagtttaatgacacagatctaataggtgtctatgacatcttcaaaaagttcagatagtaaaataaatatttagtaatttggtcttcactgagaaatcaaactcagttgggctcttccaataagacttctcgttcacataaaattgagtagtcacgtgaaaatatgcaacatgctgcaggtgtgacgacaagtagaaccccccaaaatcccctctcttttttgtttaaacaaagaagcaactgatgggctgtaggtatagccagaaaaaaatattgcctcactggtatcaaaacatttgagcaatgctgttcttactgactattaactattccacagcactggtaaaatgtcttttaaatggtcactgtattacttttcccactttttttctcttttttagttaaagaaaaggaagatttgcatccagacccagaaattcagtcagtaaaagatgaaacctttggtgaatacaggtaaacataaggttctgttgtaaaataaaacacatattcatcatgttgaaagcttaagtgaacaaaaaggtgtttattcttaataaaaaggttacataactacaatgtaatgaccctataaagaatactttgtacaaatagggcccacttaagtgctagcaaccaaatttctgtgtgtgtgatgagggtgtataaataattaccgtctaggcagaaatgtcaggtaggacacttttcttgaagctctgtgcctaacacaaagaatatctatttggggtagctaaaacatctatagcatggccattatgaactcgggttcaatccaatttgcatccacacacgcatatctgtatacctacagcgttgcacctgcaaaggtaagtaagttacaaaccctgtcctctagatgaacctgatcagcagagaaaaatatcctatatatgcaaatgactgtaatgaattaaatagaataaaagagcacaaaagagagtaactgtttctgcccaggtaggattttggaaaaagaatcatccataagagataagctaagccttaaaggataaaaagtattgtgttactgttaaccactggacagaggatgaccaaatgagtgagggtgtgtcgggcaagggaggaatggcaagaagtctactctgagctaggtaggaatctttcggggacgtgttaaactgtctcattctccttttatctttctccaccttcccctttctgctactctctcaacttcttagttcttttttgttgtaatgtcatcatttttctcaggtctcctgtatatttcagccaacagacatattgtaagttccaggtttgtattgattttagcacatgggaaaccagagtttatattaaagaagaaatctgattgatcctgattctctcatctctggattcattactctagcaagggatatggagtattttcattagctaattggtagacatttgggcttacctgtacctccattttgtggtatacttatttttctgtattctacttagtcaataccctttttatatttttatatttcttaataaatgactttaaattctttccagaataaagaacaataaagagaaagaaagaaagagagaaaaagaaaaaggaagaaagaattttggaacttcacgaattgtgatcattactattgtattagttagcagttgcctcataacaataaccaccaatactcaacagcttaaaacaataaacatttattatttcaatgtcctcataattcaggaatccagacatggcttagatgggtacttctggctcaggacctctcatgaggttgcagcaaggttttgaccagggctatggtttcatctaaagtttcagccaaagcacaaatcattcctaggccattcgtgtggctgttggcaggatatagttccatacaggctgttgaactaagggcttctgttcttcacaggccagaggtcattcctaactccataccacgtagatatctccatggggccattcacaacatggcagctggcttccttcagaatgtgtgagccagggagcaagagagagcacccaagttggaagccacagtccttttgtaacctaatattggaagtgatatcccatcacttttgttgtattctataggaacaaatcattaagtttagctcacaactcaaaggaagaggattatacaagatacaaattccatgaggcaatgatcattaaggacctgcaacaacttttcaaaagctgaggcaggagaatttcttgaactcaggaggcggaggttgcagtaagctgagattgtgccactgcactccagcctgggcaacatagcgagactccatctcaacaacaaaacaaaaacacaaacaaacaaacaagcaaaaaaaaattttgaaagacaatattagctcaattttacaggcaagaaaacaaaaacaatgccttgtctaaaaacccatttccccacaccctgctgctcctttataaagatagctaacatcttcctgtgcattatttcctatgacatccctttatagtagctgatgtgttttccaacctctttcccccaaactacatatttatcaggataattgtctactttccacattatcccaggagacacttttataagatgctgtgcccttgcataagtcctcattcttctagcttctgataatcatcccttttgttatttttctttattctttgttcctgattcctcagccgatgcctcattgtttttcttgatttgttcttgtaactgcaatatcctaattcaagagccaattatcgtatcagtcaggggagcctgtgttatgctgctgtcaaaacaactccaaaagcattttctttctcaagttatgtgtcccacagagattgcccttttcatcttaatcacttaggagcactggctggtggacgagcatccaggctccccacagcagggaaaatagaatgtaataaactgagcactggctttaaatctttggctcggaagagacacatgtcacctttgctcactttttttttaaaccaaagaaaattccatggtggcatataacacagagtaggcaaagaagtgccatcctgctttattcctagaaacctgacatacttgatgaacagctctgacaaataccacaaattataaagtgatatgtacatccaaattatattttttccaaatgcttcattgatcaaatttgataaaatcattttatatggtgtatagcttcataatgtaatactaattggtacttaaaaaaatcttgatccaaaatttagaagatcataccatttgataagcatttcactaatggatttgcttctgttcatgaataaaacacctaccataaatatagtatacttatttatgttcttaaaataccagccatttctttctgtcttaaaatgtaacaaacttgaattgttaactatattaaagaaagttatttggtttcaaaaacagaatgtgattgatttttaaaaaagaacattttatcaggatataagagaatcaaaaggatcagaagtaaaggcagaagatcaagacttggaggccaggagctccaaaagttcatgacagcaagggaaattgcatttgttctctgtctgagtccattagggctactataacaaaataccataagctgggtggcttataaaagaacagaaacttaattcccacagttcaggattctgagaagcctaagagcaaagtgccagcattttcaatgtctggtgaacgctcactttctgggtgacagatggcaccttctctttgtgtcctcacatcgtgaaaggggtagggcagctctctggggcctcttctctaagggcactaatatcattcactagggttccacccttatggcctaatcacttcccaaagactccacctctaacaccctcacattggttatcaggttttaacataggaagcttgggaggacacagatattcagaccatagcagccactgtggacatcaacaggttgaatcccacatgtcctacagaagctaagctgctcaattttaaagagaagcacaaatgttgtgaataatgaaaaattgtttggtggaaattgcttatgactttgtagacatgtgtttacagacttcgtaaacttggtaaacatttgtggtagtatcatgtgggctttactatctgtcttcaatgctaacacaaatgtcctgaaaattataaaatcttttatcacttatgactgtgttgctttacatgaatattaatattagattttgttgagctatttttgtttgtttgttttctagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacaagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatataaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttatagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggttccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctgctcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacagagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggttccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgatttgtacatgccattgaaaattattaatcagaagaaaattaagcagggtctttgctatacaaaagtgttttccactaattttgcatgcgtatttataagaaaaatgtgaatttggtggttttattctatcggtataaaggcattgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaaaaatgtttgtattctgttctatatagttaagaagaatcagaatttacatattaatcttaactacttcagttgcctctgatcctggaatatctataaatgaagtataatttaataaagtaaaaataagataaataaaatattttgatttcaattactttataaatatacaatatcatcatctataaaaaagaatattacaataaaatttatatttataataaatataaatttaaggtgaatgtatatttatctggtcatttttaataaaaatgtagaaatgtcacttttcaagaaaatgtccgatatgctatattttcaatgaggctagtagataattttgatatggtcttttagaattgggttacccactttggctcaggggacaatctattgaaaattgttatttttaaaaacggttttattgaccggacatggagactcactgaaatcgcagctctttgagaggatgaggtgggtggatcacttaatgccaggagttcaagtccagcctgtgcaacatagtgagacctcgtctaaaaaatttaaaaaaaaattatctataccaagcactttacacagaataccacatttaatcctcgaacgatattctctggtttgttaaattaggggaccgggaggttaactaacttaatgagtgtcaccagcatgggctagaactagaaattaaaccctgggatgtttgactccaaaaccctaattcattgtaccattaatagtacattttttcatgccctcactcctccaccttttcttagaaatactaaagaaaggtgagtttcaacttcatgccgacttattgatcatgcttacaaacaccttggctttaagatatgcgatcaagacatacgataggggaaaacaatcaatgctttattgtataaacagttgaatgtgtacaacctaaaaagtagtaattcaaataagccagttatttttaaatgaatgtcacacatttcattatattccactcactctattgggaaactgaaaaagaacaaaagctttttattagaagtggcttcaaaaacaactgcgctaaacattttaaagttgatatttgtatttgctcatcaaacaccagagtctatggtaggacatctctcctcttttgctattctcatttgtttccctgtaaaatacaacacagaatttttaagccatatatctctggactcatggcatcccacttatggagaacccttatcgccaagataaatcagactttaagtcagataaacatatgtacgataacctctcaagggccttattttagtattttagcatatgttaatacaatgagggttttattatcctcacatcacttacaatgtgatgcaataatatatatatacatgagtaaagaaaggataaaatatggaaattcccacgttacctgaaagaaataatataatgcactgcaactgaaatgcataaattcttttaacaggtggaaaaaatctttcattgattggtctatttataacaaaatgaaacattaaatattttccgacgtgatcatctatataaattgttcccaaaatagttctcttgaatcgctgattctgtggaaaacattatgtttgaccaaattattttgggaatgttggcaagcataattaaatggatacatttgctgcattgaaaatccttgggagaatatggcgtcaaaacttgctggaccctggagttctttgcagactcaaccttagttcgctttcccactccaatgctttcctaaggtgtctggtccatttaagactttgattgccatgggcagacagatgacttcaagtcatttttagcccagttctctcctcagatccgaggcttttacatgtgacattttacttggcagctctctgatgtagacaatttcagactcaatgtttcaaaagtaaaagcataatttccacgtttcaaacccttttttcccccactgtgctattcagtgaatgacagcagtaatccatccaaccactcaagacaaaaacctagacattgtccttcatacttgagctttctctttcaactcctgtgctcaatccatcaaaaaattctgttgatgttttctcctaagtatctcctggatctgcccacttgtctgtactcagacctcttttatgctgagtggtctttctgtgttgactggctcccctccagtctcttatccactatgcaggcagggtgatttatgaggtgcagttctgttcgcgctgtttccttactttgaagaacaacaacaacaaatagctttccatttcttctaagataaaaacaaaaatctataattggcttccaatgtcctccatggtcagatccctacttagcttccaagtcccttaatttctggttcttttttttccctttctccattccagtcctgatgattgtattaaacaagtcttttgcatgcttcagattctgtaaggttcatctagccactgctggagtgaacagttctgcatggaccaaagctgactaactgcaagtcagcttgcaactagctgcagtgttcatgatgcacccttgcactatggcatgagatgctgtgagactgtctggtgcccattcatgctcaacctggaagcatggaagggttaacaccttgtggggcaaacatttatccaatgggagaatggagctggtcgataaatgccaaccttctctcttgtcctgtgtcccctcccttctctcttataccaaatggtcccatgggacagagcaatcattggcattcaacagtggccaactcaataacgtatcttctattggttctccctgctcccttgtctcacgctgccttcggcctcatgcctgctacctaggattgcactccctaataaatgagtagcccgtgtactgattcctgcaggctctgctgttaaggaatccagactaagatgtgtgttttatcagttccaggtattttctcattccttcctgtcctgagaaacctttaaatttcttctccttcacaaaatcactgatctgctttcaagtttaatatcatttctccagggaaaacttccataactagatgaaatcatcttattttaatgtgtcatggtgttatgtacctttgatttttagcatggaccactgctgaagttttacttttattacatggttatttgattaccatctctatttatcctattagtctaaaagttttatgagggcaggagatgcaccttcattttcactggaaataccatctgcctagcacaatgtcttgtatctgctgggcatttattaaatgtttactaaataaaagaataaaagtcacaaggagagatattcaaaataattaatacatttgagagaatgtcagtctagatgcatgaaagaagtctctatctgcaccccaaaaactgttcttaccccttgtgtttttcatcttaataaatgactccaccatccacccagtaactcaagccaaaagctttaggatcattcttgaatccactctttcctcattgtcctacaaccaacccatagtctcttacagtgctaactccaaaatacagtttaaatctattcatttttctccacagtcattgctaccatcctgggctaagccaaaggaatctttttcctgttactagccttccttcattcttgtccctttctccaacctataaaacaataccagggaaatctgtaaatataagtcagattgtattagtggtttctcagtaaatttagccacaatcccaaatgtctaaccacatggctgtatattagctagctctgcctaccttatgaccttggctcatatattcttcccccaaaagcaaagcttgtgccacgctgcccttctatgtatttccagagcccaccaaatctctttcttgcctcagggcacttgcaattgctgttccttctgcctggaatctttccccaaattttgtgtgagctcacttatcaccatttaagtctctgtttgaaggtcactacgtcagagaagacatttctaattaccaactctaaaatagccaggctctgtgatattattccttttaatttcttcatagcaatcattactacatgaatttgtattcttattttttttcttctctgttcttattacaatttaagctctatgagaatgactttgtcttgctcactgctttcatacctagaattggctccagaatataacagatgctaaatttttaggtagatgaatgaactaaagcactaaatggaaaaatacaataaatcataataagaaaaagccaaattaatcttatcaaaacctattggctcgagtttttaaaaaatactcatatatttagaatatacagttgcctccaccaaaaagccttgtatagtgcataaacacataaagctgctcacagcagaactgatcaaactgccaaaaaaaaaaaaagatttttcttttacagctgatgccaagccctttcttttttccttttagggaaagaaagtcattattaatgttttataaaacaataacatgacatgtaaatcagtaattccagttataagaatcagtacaaaaaatttctttgctaaatgtcagtatcttaaaaacaatgaagttaactgcagtacaatatgcatttgaataattataatgaattaaaatgtttataatatatgactataatttcataggaaaaatgttcatattataaaaaatgtgaattcttgcatagagtatgagaatcaactatgctttaaaataaaattttaaatttccaacactttttttgattaaacagtggataataataatagtaataataaaaagcatactgttttaataaaagatgtagttaaaatctcaaccactagatggaagtgtttcaaagtaatataaactgccttacagaaagcatcctacagtcaagatattttttcctcaaaggcagttttcaagctttagcatgtattatgtatgtattacttagtttacactccttctttcacttctaaattgtggccttattataataattattgactttctttgatgtaagtttttgtaaattatatagttttttttttcctaatttagaaggggtaagtgtttttcaaacgttaacaaagtatgataaaataatcttgttataatacttaggacttaacaaccagttttctagtttaacattttaaataccggtagaaagagagggaaataatgtctgaattatttatattacctatttctaaacaaatcgatatttcttacctttttctttaatgtataggaatacctcatttactgtgataaaatattgtctgatatagatacataaatacaatagagtactaatacctgtgaagtcatgaagataaaaatgagttcaaatatgtaaatactttagaacagtacctgtcatatgcaaaatgctaatcacacattatgacatgttaattaaacatttttataaagctgtccaactgagaaagtatagttatggtcgtgttgataattctacagtaaaggataaggctctatctgaaataagctctttatcttcccaagaaagggcaccagatgacatctgagttgacgtgtattgtaaataaagccttaatttcaaaattgagttgaactttaactttagcacataaaaattaaatacttctatgtaattggctaccacccatattaataccctcaaagcccagtgggcacccgcatcacctgaacggcttgttaagacagactggtgggccccagccccagaactgttagttttgtagatctgaggtggagcccaacactttgcgtgttaaaaaaaattgctgtcgatctaggaatcacaccttgagaaacattggcctactacggtgcatggatttgaacataatcagttaaactaaggaaaattcagaaagaatgaaaataactccaaaatataagaatgttccattaattatttgaatactctttttaaagaagtagcaaattaactttcagaatgaaaaagttatgacatacttccttcaagatttgtgaaccaaaattcacagcacagtcatgtttgccctggacattgggatagggagttacagcacacgcatggtgtatttgcatttcctgagtttgtaacatcccatggattttaatatctggcagatcaattttattttttatcccaagtaacactggtctaggaagatttgctcaacattctattgtattcaattttttaataaattgagccaacagaacaactaattttgaaaggctctaagaagccatcagcaatttccaaatagattgagtgtgagacggtaacaaaacttagcttaattctcaataaaaatatctgtggaatataaattgaagccaattttaaaattctcagtcaagggattagctgatgttcattatatctatcttttctccacaatctctatgtttacattccagacagtttgacgagactagagttatgtcttttgttgtcataatccaaataatcatcagtaaaattatttcataaatttctctgcagtggaaaatcgagattatgttttgccataattaatcaggcttagagtcagtaaatgcccataactatcctctatctgctgtcagatgtattttagtaagtgattgcaaagtccttgaactacagacacaaactttggttattggttcagttagcaataaagcatagtgtcttttcttctgtgatattttagtttttctaggtagttagggaagatactatgagattgctcattgctatagatcccatgttcatcattatctatctgagtccctttgggctcagaatattttatacagttaatagtttttcaggcttcttgagatatgttacctatctttagttattcacatgttgaaactccattcagtacactgattttcagggtactccactttatgctagagttgtgttcctaaaggctttaaataactcaaaactcacccaattcaagacttagcctgataaactaggttttatatttaccagctaaagagggtaattccacttgaaaagacatatttacaatttacacaaccagctatgagatcaaattagtatttgaatttaatttttaagatgagaatggttttgcacaaagttggagttttttatggtctatgtcacactatttcaatacaggtaaatcacatttatataaaatataaacatggtaattatacaattgtgtcataagaggttcgtggtaagccacaaagtcatagacatatgagtaaacttaagagaaagatgttgaataaattatgcaataattattgaacactagcaattattgatagaataaaagacccctttcttatgccaaactaaagaacatcctttaatgcatgaaggagcccaagcagcttgagtagaatctcacacacacacacacacacacacacacacacacacatctctttttgtttctaccattctccagacatttccatttgcaacaatgaatgatgattgggtctgcctttccccttcttttttcttcactttgcttatttttctcttcctgtttttctgccacaatgtaatatgctagacctaactattttcctaaatagctgccatttactgagaccccaagagctaccaccatgtgcagttagattgacacatacactaatgattgaactccccacaagaaatactactagctgactaagtctataaccagagtcaaaggtcatcataaagttcatttaccactgtggaaaactggaaccaatgcctggctcagacatgaatgacaacaggtaataatgtggtcatctagggataggatagcaaatggatttcaaatattgtgagaattcagattgacaaatggaatattacagactattgtcttgaagattcaaaggcagcattgataacaagtatcccaggacggctgagtgatgctgccatgggtgtagacaggggattccagggatatacaccatggagttgaaacttgaattgatgcctcatgtcacatattgggtatccttgacttaggtggtaggtagatagatgatgcctaatgcctaaacataggaatatttgtcaatgtccaggttgattgccaaatacttggagatcaacctctaatgggttaaccacagaagacatcgaatgctactgctaaaaactcagactaccaaccctaacctctataccaattagcattgtctaaatatctggtcaccgttgggtgcatgtctggagtctcacctaccctcggttcccaaaatatgggtacttttcctagaactcctaacaagcaaaatgtttactctctagaaccaatggggaggatttctttctgccaagaaagagcagagcaatgtggtgggaacagcagtggagcaagtcaggactctcagatgttggtgaggttgtggagaaaagtgaattcttatacactgttggtgagattgcacatatatagttcagcccctgtggaaagcagtttggagatttctcaaataactaaaattataattgctgtttgacccagcaatcccatactggatatataatcaaagaataataaattgttctaccaaaaagacacctgaactcatatgtttattgcagtactatttataatagcaaagacatggaataaccccaggttcttatcaatggcagattggataaagaaaatgtgtacacatacaccatggcatactacacagatgtaaaaaaaaataaaattttgtcttttgcagcaacatgggtgtagctacaggccattatcctaagcaaattaagacagaaacagaaagcccaaataccccacattctcacttataggtgtgagctaaacattgggtacacaaaacattgtgaacacaaagatgagaacaataaacacctccaaaggtggggagggaagaggtgagcaaaagttgaaaagctatctgttagacactatgttcactgcttgggaaacaggatcattaaaaaaagaagaaagacaagtgaggaaactattacagtgggaggagtaactgagaagaggagggagtactaaagtacatgatttttatggtcctgctatcaggttttggaattccagcattgtttctatgtgcattgccacataatttcccagctaaagctagcaattatgaatttctctatatttcccatcagtcgtcaacaatttgctaaaaataaagcaaactaatagtttaatttaaatttaccaaacgatatgcatacatgacatcagccgacactttccatcacatacattaccataaatttatcattctatttaaattgctatgataatagagtaggcattgatgcatatgtaagtcttctagcgttttaagaagtacagtttcttattaggggcctgtaaactacagccacagggaaagtccatcccctctgttttttaaagttttattgtcgcatagctataatcatttacatattgttgacgtttttaaccttacattattgcgtggttgtgacagaggatatggcctgtaaaaccctaaatatttattatctagtcctttacaagaaaagttttctgaccccagttctgtgctatcaatttcaataaaacagcatcagcttattgtagttcggaaatgctagaatgacttccaaggggaaataaaaggaggtctgcagtgatagaaaagtgctcatagtggtaagccataatcaatgcactgaaggaaattaaagccattgattgcagggaaaattgtaaataagcaaaatatttattaaaaacaacaacaacataactatgtttttcttttaatattaagaatagagtatatagatgtgcataaagagtttattgctttggggttctcaagtacttggctgtgggttgatgagaaaggaataactttcttttttgatctattcctatacatgaaaggaatataaattagcctataatctaaaaaaattatctaaaataaaattactcctttaaagtgatccttaaaagtgaaaacatatttgcatgacaataaaattttaaacactagttttcagtctatattattcagtggatgtgtttaattttctttacttgatgttagctagaaaaggtcggttttttgtttgtttgactttttattcagcctttcttatttgtgatgtggatgagaaggttagaggtggtctttaaaatgatgggatgtctgctaagacgtcatttatgatctaatggctctttgagttagttaacttcagttagggttgtcagcggggaaatttgattgggatattatgtttgatttctccttgtagttcacctgaggacagaatcccaatgccttctttgtcagacactaaagcaggaagaatgtgagtcgtttcctccgggttccctgatctttcactctgatgggtctctatctcaaacttgcttttgtttccttcaacgagaaggaaaataaagctactctaacctgaagttactaagtccccaaattatacacgttcttcactacctgtaggcttcttagttttctttcaagttggttcttcccccttccttgcctcttttcccattttgagttcattttaatggttttcttatgaataaaactaaccttgctcaattcttcatttgttttttgcattttagctttcatttacaattgagtgatgcatttttgagtgagctctgaaagatttgtgcaagatttgcctcccagttttacacagcagattgtttaagtgtaggagagcttttcatgcatattattttgtagtcatcattttgcttgtatcctaaaagacgtttcagcacagtggttaagaactccgaggacagtattcaaatcctgactcagggcacttgcttgctgcacaaagttacttactttctccattcctaaatattcacatctgtaaagtgaggataataacagtacctatctcatttacctattcggaggagtacctaaggtaatagttacaaaaggcttagagcaatgcctggccaagtgtaagtatttattactactaggacttactggtaagatcatggatgcacactctggtcattatttctcccaaagtcattggagcctcttttccttactggggagagggacactcatgttgggtactgatgtgggatgggaaggcaagttccttttctaatactaagattgttaccccgttctttccactgatgtgtaaggggatacaaactggatggcttttgggatcccttcacttattaaagaggaagtttaagaagaaatgctctgctctgaaccatctcctgccagatgcctttgaatgtaatggacaccgtgatgattgaagctgctgcagccatcttgtgacaaacaggggaagtaaaaaataatcgcagacatgccagttactgtcattttggaactgaaacaacccagcaaatactgtcttgtaggcttcttgtcatgtgaggaaataacttcctatttgtttaggtcaattttagtcacaattttctcttcatgatagataaaaatatttccattgtacagaatcatctcttctacgtaacgacatctgctttttgaatgcatagatctctccaggggtgcattcaaccactctatgataaatatttgagttggcatttctgaaatacatatccaatgataaagattctcaccagtggtttctaagtctcacttcaaaataacatataatatgatattttaaaaaataaattcaagtgtttcagtaactggataagaaaatatcgcaaagaaaagtcagtgtccttctcaagggtgggtcttggaacaagtatacgtgtatccagaggttggctctactgatcaagaaatactcatgcaccaggttagtgtgggtccacctgggtgcccttgtttgcactgtaataaaatccaaatgaaatctttaaccaatttgcatatgttcctaaaacattttttcagccgggagtggtggctcacacctgtaatcccagcactttgggaggcgaggcaagcagatcacttgagctccggagtttgagattagcctgggcaacgtggcaaaaccccatctccacaaacaaagaaacaaaaaaaaaaaagcaaaaaaattagcaaggtacagtggcatgtgcctgtggtctcagctacttgggaggctgtggcaggagaattgcttgagcccaggaggcggaggttgcagtgagccgagatcacgccgttgcactacagcttgggtaacagaagtgaaactgtctcaaagaaaaaaaaatattttaaataaaacaagaaagttaacatttttttaactggtaacatttacggactacattgaacatcgcagacattaaaaaaaaagatgagatgtttattaataaggttgtaattgaagaaaaaataaacatcttctagttttccagttttcctgaagggccagaaacaagatgcaccacataaaagatatgtctgcaaattatgcataatttttcctcatctgagtaaggacctggaaaagaatcagacatattcctcaatttcttccatgggattttaataagtcctactattaattaaattttaaggagtctgcatttagaagataactgggttaaacaaagttaattacattctttaaaattatacaaataacatatgaatattatcttattacaaaaaagacaaaaaataacactttaaaaagttcttcttgggccaggcttagtggctcatacctgtaattctagcagttttggaggcctaggcgagatcacttgagccccggagtttgagaccaccctaagcaacattgcgagacctgtctctatattaaaaaaaaagtccttctcatctctttccactctcagttccactctagtctacaaaatagcaatgtttgctaccatattaatgagtaggcatcagattttttttcctatgatggtacgtattcacatgtgtactgcataggaaaaatgtatatgggcatgcatgtgtgtgtgtgtattaagtggctgtttacataaataacccccatattctgtaggtattttattttataagcgtttttgtgacttttttcaagtaacaatatctcttaaatattttgtcagtgtatatagataaaattaaatcattttgaaggtcagcaccatgatgtgctgtcatatcctaatttcttgaaacattctgcattcttgcctgttacaatagttgcaatagaccaacaatttctactcatattaaattaaggacattttctcaatttcagtttagagaaccaccctctatcatcttagcacttcccctttcccctgtatcagaaatctctttttatgtgcagtagtcatgtcttggagtttctgtagtatatattttaatgctagaagttcttaatgtttttaaatccttccttctatgatttcaagtgttgccttcttctcacaaaaacatagtaggagtgaactcttcaagctttttgaacttagatatggatgtggaacttgctttggctagtcatttcttccaaaaacttcacaagccaatggtgaccttccgtgttctccgcctcgtgccagatgatcctagaagcaagtgttgagttggagccttcattaacctaggtcaccgagtgacaatgataaacaaagtactagcaaacctttattagttttatagcctgataaataaataaatgtttgttgtgctaaacgactgtcaggattatttgttatttcagcataacctagttaagcttaactgacgccactacacattctttggcttccaacttcacttactttcataagaaaacttcttggtataactgtctatactgtatttactttctcaactttatctttttcccatgacagtcattcttcaattaccatcactactctaaaattgcttccaatagccctaataccattcatgtttccagattcaagggttagttctcagtctctagcttgacgtctcacaagtattcaccatggtgaaaattattttctttttttgccttccagaataccacattctgatagttttcctcttatccactaaccaaaccatctgagtcctcttggtttatctcatacaatagccccgagtgaactttaaaaaacattaactttaccatattactttcctgctcaaaatcttcccaaggatctatagcatattaacatccatgctctttatcctggcctaaaaaccctgcaagatttggcatccacccactaatatgtcctcattgcattccactcccctccctaaactccagccacacacacctctcttctagttcaaatatgccaagatagcaaccaaattagagtctttgtactaattggtccctctgcttggaatgattttaatgcgtatacttccattgctgatgtgctatgcagtttttaaagaaggcttcacctcttgctattttcataccttagtataatccactcctttgagtatgacctggaattagtgatttgcttctaataaacataatacagcaaaaaatgagcagatgtcacttccgagattaggttacaaaattccatgacttctattttgctagctgaatttctccattgtcttcttggcttataagatctgatgaagctagctaccatattggaaaggcccacatggctaggatctggctgaccgccagtgaagaatcaaggccttcaatccagtaacttgccagcaactgaactctgctaacagccacataagcttggaagtagatccttcctcagttgatcctgaggatgagattacagccttggccaatgtcttaattctaacctgtcatagaccatgaagcagagaacacagacagatcatgcctgcatttctgatccacacaaacattgaggaaatacatatatgttgttttaagcttctaagttttaccttaaacttattgagaccaaactcagatttataattcagattagataaataatatcattggcttcttctcatgcaggtattgacctaaatgtcaaataattagaatgctctcctctacaacttaacctaaaattgctgcttcatcctcactaacaaatatctcaatttgctttctttatagcttgttgctgtcttatgacaaaaactgctagtggtaaccaaagagttcttctctcctacttcctcattaatagggctgctggacacatgatttaaacacctaaataaaatgaaaataatattaatattaaactcacaaatttattatgaagacaaataagagaaggcatgcaaggttcctggtacacagtaaagtacctgataaatgtttgctattgtttgtgtattttttccattatttatactgtagcactgccagtttcatttgttttgggacaaataattttgagtttctcctgttgccagatgactatctttgtggacagaattcatttatgataccataatgtcatagacttttagatctagaggggacatgtaacaatcaactaaaattaatattcaacaaccatttattgagtagctattcaggacttggctaggagttagataaagactccaaatggaagaggatgtaagttacaaagatacgttattctgcttttaaaatactataaatggacttaaaagacttggcaagtgcagccttacctccccacctccacaacccttagacccaattgccgacagtagactatgtgcttctcatgcttagatgtgccaggccatttgacaatggccactctgtggatgtccactgctcatgttccctgtggatgtgggccaggagcatcaaatactgtctttatggatgctgagcccctcagacaggaggtgatgccagcttgcacagaaaaagttctggctaggccttgcaaccagatggttggctgcaggcccagctacatttttttctccatttaatttctggtctgaaagttactgtttccagtggtaacctggggaccgtaaattatgaggcttgttgatgagttctgaaaagtactttgtaagtagatcttatgaaatgcattgagcacttaagtcccagacacagcagtgttttcaaacgttatctcatttaatccttataccaaatttctgatataggtgttattgttatatctactttacagataagaaaactgaggtttggggacataaagaaaaaaattaaaaatagtcccttgaaggaaagctatgagaatgttgtgaatatttaatattttctttcttaataaagtctaatttaatatgtagatttttttgtcccttagagcctagttggtaaaatataagttagaaaacaaatctgacaaaattggcactagtatttgaccgatcacataaaaatgttatgtaacatgcagtagcatatagtagatacgcatcaacactgtacacagaatataaagttcttttattatttaatcacataatgcaaaggcaatacttttgattaattaagggtgggtccacagactgaagtttctttttgctctttagtcattaaaaatactcatgttgcatcatctaagatttctactttccttacagaagcaaaggtcttcatttacggctttagttaccttacagaagcaaagtcttttttacattcttataattgccttctccaattatttaaaactttcatatacctaaagctacaataatttgagccaaatgccttttatgacttgtttcctggaacatacacatgacttcagtttctcaatgtttgaaaagaagaaagcttaaagtttaacatctaattgtaataaatgggtttgggaacaaatgcaacttactcttaggaatggcacagatggtgactaatctgcaacgtctcttaaaggagactggagcagagggcacaccttggccactgtttacttatctttaagatcacatttctttctattgacatcagcatcacatgaaccaatgttttggatttttcttcatcattatattcctagaatattcccttactaataattcctatgtcccactggcttgcagaaatgagtagggatacttttacaattgagaagaaaacacaaagtatacttaaaaaagtcattcactgccaaagaaaattccacatatgtggcttgatttcattgggaattattaaaaaatgcaaggtatgctttccctgtattaggactgttaaatggaacactctgtgataatggaaaagttcactataggccttttctccctgttgggttgtttctaatcttatcaatttgtaagatggttttatatattctgtagctacactgttcaatatgtcctcattcattacatgtggctattgagcactttaaatacggctagtaaaactgaagaactgaatttttcattttatttaattttaattcaatttaaatagccatgcataacttgtggctatgatattgtctaaggcagatctacatctattattccggctgacttaaatacagggcttctcaaatacaaggccaacttatttgattgcatatatgacaatgtaatgtaagttaccagagtgatttcatgtaacgatagaatatttcttcttaggtttagtaaaagagggtgtgtgagataagtacatgtctgcacacaaatatatgctagctatgtaataaattattcaccacatctctagataaattattttcattttggtttaggggagtttgagccttgtttatgtgtgagaaaagtcagaaggcaaatactttgccatcaggatacagacagacaaattcttgcttggaataacataaaaatgtacgtaaatattcacattcttaccaatgctcgtgaaatgaactgatgagaaaacagaaatatgcaaaataatgcaaatatgaaagcagatcaactggcaagtcctgctgtttgacatctaatgatcattgcataactacctggatacaggaatgctatttaaatcatgtctgctaagtctacctagtcagcttcccggtatattcaggagttggaatccttactagcccatgaattgcctcaccccccaacttggaaatcatgttttgaagcctaatttacatcagaatctcccaatcagcacaagtaaagtggactgaacgttttcatgtagaaataatctactgatatctgtaatgttgcaaaaatacatatgtgaccaagcaagatataatcaaaatatgtgtttgcattattttactgctactttgatattttagtgttttttgggggggcatttaaaatgtcttcttttaacaaaaatattttaaatgtacaataattgtggaatatctttcataacatgaactggccatgttttctgcaaaacttaaatgaatgcaacttttgcatctggattgattttaattatatgaaagaacaacccccagatactatttggacacggaggagagataagtataaggtatataacgagagtcagcaaacccttttcaatgtaaatcatagcattatgtattgtcaacactagtaatttgtctgagggtagaggggatgagtctaatgaatacaaagattaaatatgtgtttaaagctataatatactaaaaattttgtagtattgcacagttttgcatcctgtgaaaaatccttattggagaatcacacattgaaattttttcaaatgctcttgtttctctgctcactggctactcaatttgatggatgttattaagttatgttcagccaattaatatcacacaagagaataaaccgattacatttggatcttccctcttgtggaatcttcaaagaataagtgtttttcatcgaaagagccaggaatggtagtttctgcatgatggtaaagatgttctgtgcattaaagggaaatgaaataaaatgctttaacgaagaaacactgaacgttgtggtctgtgagactgataaacatgctgaagtcggaattgcgatttagatttatgaatcaacagctcccagagcaagtggcttgtgacccactttcctcaagagacatcaacatgtgttttgcattaatttgtcttgatagcctcttgttgctagcaacttttgtgggagtagaaaacacttcgcctttgccaaccatgtgtgtctctctcctgcacccctacccttttttaggcaaagcaaaatgagatagcttcagttttacagtgactactagacacccaacaattgaggaacttaaaaaaagttcataattggcttgttttaaatagagcatctttaaggctcttgaagtctttattgataaattttagcaaccttttggcagttattttcgtttaaattacattgttgaaatgcgcatttcacagattgcaaaatatgtctcgtggttgggacatgaacacaaagaggtattatgaatattggattatcttagagatagttttcttggcctttattttaaagcctattcacgaatatttgtctaagtgataatattgtagatatatgatgaacacatgattttgactgctttttagccaacagttactaaattgtaatcaccaatatatagtacagttctatattcatataaaagctcattagaagggtatagaaacttctaaactagctgggtcaaatttcaactcttccctaaagtcagtgttagaaagtattaccaatggacagggacataaccaaagaacaacaaaaacaagaaagttgggaaaggctaaaatctggagtttcaatacattctacaatgaaccagtgaaaactctataattaactttatatttgatcctggcaaataagctatgtaccacattaaaacaaaacaaaacacaaagtgaattaaaacaacagtcaaagacctcacaatattatttttcaagtggttgaaaaccaccactcaaatagcttaagcaataagtggatgcattattataaaactatgcccttatccaagtgcttatgtagggtatattccatgaatattgcaccaactttttcttttaagaggtagtaattccttgaatctattctccttcctattttgggttcatcttcaggctagtagcaagatggttgtagaaatttcagacattatttccaaggagaaacccattaaaaagcaggaagagatgtgggtttttgcatatgttcctttatgtgggtgaggaggcattatacaggagcccccagcagacttctttcttatttcattgatgagaattaggccacagttcctttatgtgggtgaggaggcattatacaggagcccccagcagacttctttcttatttcattgatgagaattaggccacatgttcactctttaatcagttgttgacaggagaaactgggttccaaaaattgccttagacaaatcaggagtgacctttgacctaaagacgttgctatattcacatggaggggaaaaacatgcagggagtgggtgaacatgcaaaaaataatgtgaacctgtggataactgagggcccactttgttataccatttcatataagtgacttgagcttcaatgtattgttggtatctatgaggggttctgaaacaaatctctggtgaatacacagggtctattataagtcttatgtattattgaagtgatttaattgttggctttccagcttccttttgcagtctgaagtcttctttatgcatctgggaatattaaaacggttggattagaacagactccagtccacaggaactacagtataagcgatgaactggtttttcacaattctattgcctaacaggagaagctggacgcactatattagtttatcttattcatgatctgcaggatttcttcagaagtgctctcttaaagtcctaactaactggctgtgaaggtaacgacttcatcctcaaacactatcatcaattactgacttttaaaggctctcttcaacaatttagctatcaatagaaaccacacaccaatgcgtagattttagtgacaggtatttctatggaatggagaaagcattgtgtacagggtggttcaacaagtttggcgaggatttaaaccttctcgtaaagaatgtttacatattaatattacatattataggttggaactaggtttcctgagacaaaacttgtctgggttagtgtttttattttgtgatatagttacattaatattagaaaacattatatgcattcactaatgctaaaatttcatagtgcaggtttgaacttaacgtcaccatcctagaccacattatgagatgctatacaatggtaggcatttggtccacttttgttgtagatattcattctcattcagcaaataccaattgaaatagattaaactttttatgataataaatcaatcatcaaatatttaaaaataataagacatcactatatgtgccagtcaaaatagacttctgataacagttggttatatttctgttttacttgaaagtaatgaaacatagctacatttggatttccttttgtgtcttactaccaattccattttccctccatttctagaagaaatcactcttaagactttggtgtgaaacctttctggtcatttaccatatatttcattaaaaatatttcccacaaatttctcgatgaaaaatttatggcctgcgtttgtttgcttgttttaatgacagtgcagctgtcatgagattgtgcctcatagacctcctccaacaaggggagtaattgaccaagaggctcaagtgctgccctttgaaattcattgtggtggttatgctaaggccaagccttctatcagatgcttcctgccaatgaatgagtgctaagaagatactaaagcagccttgctcttgagacatgtctgtgaactttgtctcaaggacttcccattgactttcttgaacatttcttagacaagcaggggctatacgtgtcttccacccaaacttctctccctcctgcacagtgtcagactagcattacagtttgatgactttcccagtttttgtcagctccctttttatttcccttcatatggacatttcctcttataaaatctttggatgttttattctctcttggtgactgcttcttgcatagccaggactaacagagatggcctcatacaaggggaagacttctccaattaaatgacttaataatatattaattttttggctctctagtaaattctatatagatctactgtattttttaaaaattgacctacaggattcagttttatgaatctattacagctgacttatctattcccttattgatgggtatttatcttgttttgattttcttgctattatgcaatatgcttcaatgaacacactcgtgcatgtcatattgtgcacatgagcaagagtaattctagttacaaacctagaatttaaattattggatcagaaagtataatacatgatcaattttcctatgtacaactgtatttcttaatataagaaaaatagatagaactaatttatatttccactggtagagtgtgaattattcttcctctctattcttgccaacacctaatattgtgagattgtttaatttcctgaggctctcatttaacgctttagtatacatttctcttattctaatgaactgaacatcttttcatatgtttactgaaatttctcagttcctatgatgtcccatgcactatgttatttatgaagacattttaaaatcagaatttataaacttaaattgtaatatgattcagtgtattgtacagaatgaaattaattttgcataaccacaggggaaccatcagccaccatctatttaaatacctccaattaaataatttttactaataccccatgtcttttaatattgaagaattctaagctctaacaaatagccctgtaaagtgcttctctatttagtaatcctcaaggtttaaaatccctatattcatgtttataatcacagactggtaagctctttcaagaatttgttttcttcttatagttcaaatattttttcaatgtgctttaaatttatgtatttaatattcctgttctaaatttgaggtcaccaaggagacatgtctagaagtttccatttgttcaaagacaggattgctacagagatagcttctttatatttttattatttctcagctgtttttgttgtgtcacttccaaataacatattaacgaagaaactagtttgatgctttattacaactggaccacatcccagatatattgatgcttcagtgagggcactttaatataaccaaacccacttgaaccaacttaaagaaagtagggggaaatatgatatatgctttatgtgtcacataaaagataggaatgcattgggaacttcaaaataaactgaaagaatcaaatgggaaaggaacactcattctgcctttcatgtctgttcgtttccttgaatctatctcatttttcatcctggttgaatgttctggaatgttcaacaagaatattcttcttcagagaccacatgttggaaatgtagcttctataacatcctgagtttttctattactggcccacccacctggaggacaaccggattgactctttccatctttcagtttccagggaagagatttaaagagctcattttgggttagctgcccaatcccaagtcagtagactgcatttagtatgatagagatgtttaatatagacatggctgcttcgtatgtaccaacacggtatgaagaataccagtcacaaactagagtggaaactgttctcagacataaagttgggcttgataatcagtgtaatcgatgttcattgtagctggtgaatgtgggataataagaatttactaaactcctactttgctttcagcttttagcttggtctttgagtgagaggactgaaacttgaggctattgatacttccagcagttaacatgaaagtatcatgtaatttctaccatgtgtcaggcaatatggcagactgtttacatgttacctcattaaatacaataaaccaaagggtggctttctgatactctgtggcagccctggacatgcactgctcagattgcccttccagagaaccagctgcaggtagcattgttgattgacaacttctagttgccactcctttgaattcactcctttgttcatatcagaccatctttcccctgcaagatatggctgcttgctcccagccacagactaagtctagcagggacactggaattggctggttcctgctggacaagtttggctcagggattccccatcagccataagactttttttttttctttagtattgtgctgtggtctaagctcttcatatccaattcttctttgtgtttcttctttcacagatgccagacctctattgcagtctgaagtttctacttacttttgctctgtctccctttatctttcacaggtgtctttttcttccttttcttttcttctttctttccttccttccttccttctttctttctttctttcttttttattctttctttccctttcctttccctcccttccttccttccttccttccttccttccttccttccttccttcctttcttctccgtcacccaggctggagtgcattggtgtgatcttgcctcactgcaacctctgtctcctgggttcaagtgattctcctgcctcagcctccatagtagctgggactacaggcacatgacaccacatgctgcttatttttgtatttttggtagagacgaggtttcatcatgttggccaggctggccttgaactcctgaccgcagatgttctgcctctctcggcctcccaaagtgttgggattacaggcctgagccactgcaccccaccaaaaggtgtttttcttcataagccttttgcatatttagttctgtcttggcatctgcttcttggaagacccaaactgacatacacccattttatagattatttgttgagaaaataaataagttttccaaggtcatatacatattgttagtaaatcctaagtgccaaaactaaacatagatctttctgacatgaaagctcatattctttcttctatatcatgatgctttccactacagactccaagtgttatgataatgtaatcattaatttaatgtgcaaggatttagaataatgtatggtacataaaaagcaatatgtaactgttattattctgttgatttttgccattgttcacatgttgtagaaaatgtagaaagcagttcagcacagcaacttatggtaaacctatatgggagatgttaaaactggccattcattctttctctcttgcatctacccctttgcaatgtgacagtgcatgcctttttattttacacccctggaatcaggattggacatgtgactttatttggccaaggagacattcataaacatgatacaaacaaagttcttaaaagcacttatacttggggattgtttttcagtggccctggggatctttctatcaccttgtgtaaaagtccaagctaccctgcttcaggataaaagggcctatgaaatacagcaaaattactaatgctaaagacctctcctagatcaaacagctcctagatcacctggtagattattaaagatgcatgtgtcagaatagccaagatgagcagaaaaatgatccacttgagcccagcccatatgactgaacacagaattaggggataaacaaatggtcttgtttgaagctgtaagttttgaagtggtttgttatccagcaaaatttaactgtgaccataggtgaggaaagacaaatatttgtagtggtcactcttggttgccttttcagtggctattccttctctctttcttattaccgttacagtaatggtctttaggaatcggacctatagcttcatgaagctctccccagttgcagctaggtaaatgttgattagcataaaggtaagcatagtaatgttatttattttgctaatgactaaacagcaggtataatgctgacaaatgactcacatggaaattatcctggagaggcttctggaattgccctcactcttaaaaaggacataccacatcctgcctttggacatttttgtatgataatatgatgcttggatctctggcagccacctttaaggtatgaggtaaaagatgagagaatcacaaagaagatcacaaagaagttgagaaggataactgatatcactgacccaaagaattaaccaaccgtttaaccacctacccaataccttctgttatgtgggataatgtattttctactatataagatgtacaaattaggtttttctataacttgtagccgagggtatcattttagacatagtggttaattttaagcttcttagaatttcaacaaacttttgaaatgagtacatgaatattcatgcaaaaagatgaagtgtaaccactaataaacttcacctttcaaattttctcttctcttctctcctcctcttctccaaacctacacagagctttataaaaatactaagttagaaaagcaacactttggtttcataccaagataatattctctaacttttccaagtattatcatatatttcaattctaaaaacacagcttattcctttaaaataaatttatttaaactggaggcttatatgacacaaaatcaaattattagaagagaatctcacataatagctttgatttattttgagaggaggatttgaacccttcaggcaaaaccagaaaccatggactaaaaatgccattttcaaaatttctcatgatgttagccatctaggtagggaaataaaatgtattttttatttttagagcaaaactgtatccactaggatgcactgttgcctcatagctttccaataaaatcccttatttctaaagcgtgttcatgaattgcccctgccaaatcaggaatgcctcatcacacttccttcaagcaagcatgcatgttgctgtttctttatttcactgcaatccagaaagtgtcatgctgtaagatagaaaagaatgatgctggaaagcagctgacatgcaataggtttgattactggcaacactctaatgtctgatgagaacactgcagccgagtcctgccaattatttacatctccaaaggataaatgatttcccaaatggtatccaaccaccaaggcacccagagtgttgcagaaatgtttctaaattgtgaatttgaaggataactatatgaaagcgatgttcatggagtttgtgccctagcaaagattgacacgaggcatctagacaacctgagtctctcccatggtatgacagggttaattataaactcttcaggtaatctcatttggcaggagagatgcaaccagtggtagagggtgctgactcggaagggagaaagttatcagtctatgagcaaataatcactgagcgctcaaagcatgccaggtctcggtctttatgatcagaacttctgccaaagatgagtgggccacatagggcaaaggctttaatggggaaagacggaggtctctttatcacagccactggtatctgtggtgttgatgaatacctgtaaggacatggagttacattttgatatatttcttctttaatttagtacattaaattaaactaggtgttgatgagacaatgatgaaaatgctagcatgagctcaaccctcaagaaaattagaaaatctgaggaatgatcctcatggcccaaatcacagattcctgctggtcagaatcttcgcaacagttagtatattttaccatctgcttccatactgtcttcccagccacagcttccaggatcaactccatgatatatttttggctttatgcctcatcccttaaacacacacccaaacagatacgtacatacctctttcatccaagcttcttcctgaactcctgtaatttggcactggtctgctattctctcagattgtaataaacttagcttcttctcccctctctacttacctttcatctttttatttccacaataaccgtgacttcatctacaaagcctgtatgtatttttctgaattacttttttgtttcctaggatttagtaagacacatactgatatagacctttcattaggaacaaaacagatattagctacataaatactagctattttggttggttttatcttttcttttatgttttgtaccacacatccttggttacatagaacatctatacgctatggtagattgtctacaaaaatggccaccaacacttcttcttatccctgaatatccatatactccttccatcaagtggtgaggtctatttcctctccccttcatcccacaacttgcttaggcccatagaatgtacccttagtagtgttttaaaactcccagaacaaggtgttaagggaactggaggttttggtttgtaccctgttgggatccagctgccatgtgaaaggcttagagaattattacagacataaagatgaatggagagagagaaaaaaaaaaaaagaaaaaacaagagggagaggacagccagcactgcctttccagctgctccagctaacatacctgggagtgagtaaaccatcttggatgttccagtcccagacaagcttccagctaaatacagctgcataaattactcaaatacaatccatgtgcagtagacatgatccatcaccgtgaagcctggcaaaattttggacttgtggggtaacaaatggcaattgacttaaaaccactgagttctggagtggctatgtatacaacagataattgaacatctacaaggtacagcatgcaagctctttgcagtggctacatatacaacagataattgaaacgtctacaaggtacagcatgcaaactctttgcaggagagaagtatgccttacccatttataaatctcctaatgcctggatcagtttcatgacaatttaatttaatgtcaatgatggcattaaattaacatctcaaagtgaaacaaatatgctcactggctgcctacagctcctgttcaccttgcatcatttgaatgagctctttaaacctgaatgattgctgcagatattgttggcacttctgcttagctggcatctcacattgtgtacttttaaaatttgctctgaaatgcggactttccagcctgattgcaagcccagggtttatcattctgtcccaagggcattgtcctaaatatcctcttgcactgatccgttaatgtggcctgatctaccacagtcttttaagtttcaaaggaaatctgaaatcatttgtagctatgaacaaatagtctttcaataataagaaataaaaagagatatggaaatcactgtctctacatatccactgcccacataatatcataagttccagcttatgtggcactatttccatctaatgttgagttgtgttccagatttgtgatatcttcccaagtactaccagctcttcttgacctccacaatgctgtgaaatgtcgaattgttgaaacttatgcttcatggtttagtgttgtctttttctggactccacacctcctgtgcaaacatctctcacatttgactgccaacaaatcttgagcctggcttcagaccttgcattaaaatatcaataggaaccagtcagaatggtgattattgaaaagccaaaaaagaacaaatactagcgaggttgtgaagaaaaaggaaagcttttacactgttggtgggagtgtaaatcagttcaaccattgtggaagacagtgtgaagcttcctcaaagacctagagacagaaatattattcgacccagcaatctcattactgagtacatatgcaaaggaccgtaaatcattttattataaagacacattcaagcctatgttcattgcagcactattcacaataccaaagacatggaatcaacctaaatgcccatcagtcatagactgaataaagaaaatgtggtacttatgcaccatggaatattatgcagccatacaaaggaacaaaatcctgtcctttgcagggacgtggacgaagctggaagccattacccttagcaaactaacgcaggaatagaaaaccaaatactgcatattctcacttataagtgggagcgaaatgatgaggacacacggacacctcacagggagcaacacacactgggacctgctggagggtgcagagggaggagggggaggatcagtaagaacagacagtggttgctgggcttaatacctaggtgatggggtgttctgtgcggcaaaccaccatggcacacatttacctaggtaacaaacctgcacatctggcacacgtacccctgaacttaaaataaaagttgggaaaaaagaagacaaataaataagcaaataaaagtgtgtgtcacctccaaagaaacagaagagagaagaaatgtcagtgggagaggctaacattagctttgacacatgctatttatcttgttcaagtagaaatgtgacgccatgcttagtttataatatggaagagatcatttcctgtcaaggtaacaccatttatgaaacctgcctttccagtgtactggactacacttttacttccaatgttcattttattgaaactgcaaagtatacattcaccataggcttctttgcaataattttgtcttgtgtcttgtaatagagttctctagagggacagaacgaatggaatatatatatatatatatagacatacatatatatatacatatatatatatacatacatatatatatacatatatatatatacatacatatatatatacatatatatatacacacacacacacacacacacacgtatatatatatatacacacacacatacgcttggcagaagcactgcaggcaagataggcgaacccatatctggagtaagtgtcttttccagtgaggacaaacctctgccctttccatgatggaagaggtccaatattatatatattatatatctctatatgtaatatatatgatatatattgtatatatacaatataatatattgtatatatttatctaatatatagtacatatactatataatgtatatataatatatattatatacatagaattttattaagtattaactcacctgatcacaaggtcccgcaataggccatctgcaggctgaggagcaaggagagccagtccaaaactgaagaacttggattctgatattcatggggaagaaacatctatcaccaccgtgggagaaagatgcaggctgggaggctaggccagtctctcttttcacatttttctccctgcttttattctagctgcactggcagctgattagattgtgctcacccagattaggggtgggtctgcctttaccagcccactgactcaaatgttaatctcctttggcaacaccctcacagacacacccaggaacaatgttttatatctttcaatcagttgacactcagtattaaccatcacaagtccaccccttgtcaacttgaacgcatacacatctcctgagatcatacataatctttaaataaagacaataataaagtcatactaacgcctaacataactatccttcgtataaccagaaatgcagctatccccaatccaaatactattacgtaaagttaataatacttgaatgctgatgtgaagtcaataagtcttatgtcacatgataaaggagaaaggaaataaaatgaagatattttcttagtagaagtgtacacatgcacaaacatgtctttaagaacagaaggaggaaatactcatgacaattacagtcctcgtttctgcagctggtcatgtggtcatagctggtattgatgactaacttcttctcctacccattctgtattccctttgccttcagcaagcatctcagcaggtcgtgtttttttttttcctggtggagagacccaaactttcattcctgaaagtctgggtcatttgtagtcctgcctggattgggcttttgtagcttcccattgaccttaatcacagggcatggtaatactaagagatgccctaatggatctcctgtattccatgcatactcttccttacctccattgtggagtagtagactgatttcattgtgatagtccgggtcaatcaccccagccaacactgtaactcccttcttagcctgttgacttaaaagtaagaggagtccaaagtgtccaggtggcaatcttaacttccagtttaatggaatcgttattgtctcttctggtggcagcgttcctccctctggaactaagacctctggccagcagaatgtaatgtcgcaggaataggaagcaacaattttgctagtggatcactaggggtgatggtgagtggtgacacttccacttccaccctttgattcctggaccagtgaatcctggaccagtgaatcctggctatggaagaaacagtatcatatattggacactgattcagagcatacatggccttctggaaaactttggcccagccccacgaagtattgttacctagttggtgttgtaattgtgacttcaaaaggccattcattccaccgttctatcaatccagctacttcaggatgatggggaacatggtaagaccagtgaattccatgagcatgagcccactgccgcacttctttagccataaggtgagtgccttggtcagaggcaatgctgtgtggaataccatgatggtggatgaggaattccatgagtccatggatggtagtcttggtagaagcatggcatgcgggataggcaaactcatatctggaataagtgtctattccagtgaggacaaacctctgccatttctatgatggaagaggtccaatataatcaacctgccgccaagtagctggctgatcaccccaaggaatggtgccatatcgagggctcagtattggtctctgctgctggaaaatttggcactcagcagtggtcatagataggtcacccttggtgagtggaagtccatgttgctgagtccatgagtaaccgctatctctgccaccatggccactttgtccatggacccactgggcaatgacaagggtggctggggaaagaggctgagtggtctccatggaatgggtcattcttcatccttcattattaaaatcctcctctgctaaggtcacctgttggtaagcattcacatgggatacaaatgtcttcacagtttttgaccactcagagatgtccatccacataactcttccccaaatttctttgtcaccaattttccaatcatgcttcttccaagtccatgaccaaccagccaaaccattggctatggcccatgaattggtatataatcacccatctggccatttctctgttcattcaaagatcacaaacaggtgcactgcttgaagttctgcccactgggaaaatgcactggacttattgatttgtgaggcatttgtgtactctccactgccgtccttcatggatgtcctagaaaggggctgtagtgctgcagctgtccactttcgggtggtgtctgcacatcatgcagaaccatctgtgaaccatgcccttgtcttctcttcttctgtcaactgatcataggaaataccccatgaggccaccagtgcaggctggggagagaaggtagggtgtcaggagtgcagaccatgggtgtttgagccacttcctaatgtaacttacttgtgccttcaggacctgctagagtcagatcacgtatatactacttccatttgatgatggaatactgatgtgcataacccactttatggctagatgggtctgaaagcacccagttcatgataggcagttcaggttgcatggtgagttgatgacccgtaggcaaacattcagtttccaccaaagcccagtaacaggcaaagaactgtctctcaaaaggagaatagttatctgcagaagatggcagggccttgctccaaaatcctagaggcttctgctgtaattcacctatgggggcctgccaaaggctccaaccagcacacctatcagccattgacacctcaagcaccattggatctgctaggtcttatggtccaagtggcagagcagcttgcacagaaggctggatctgttgcagagccttctcctattctggaccccactcaaaactggcagccttttgggtcactcgataaatgggccacagtaacccacccaaatgaggaatgtgttgtctccaaaatccaaatagacccactaggcattgtgcatctttcctggttgtaagaggggccaaatgcagcacttatccttcaccttagaaagaatatctcaacaggtcccacaccactggactcctagaaattttactgaggtagaaggtccctgaattttagtctaatttgtttcccattctgtgacacacaaatgcctcatcaataagtccagtgtgttttctacttcttgctcactggatccaatcagcataatgtcatcagtgtaatggaccagtgtgataccttgcgaaagcaaaaagtgatcaaggtccctccaaataagattatgacacaaagccagagagttgatatgcccctgaggtaggacagtaaaggcatattgctggccttgccagctgccgacaaattgcttctggtgagccttataaacagaaatggagaaaaaggcatttgccaagtcaatggctgcatggcaggtaccaggagatatgttaatttgctcaagcaatgaaatcacatctggtaagcagccgcaattggagttaccgcttagttaagcttatgataatccactgtcattctccaagatccatctgtcttctgcacaggccaaatgggaaagttgaatggggatgtggtgggaatcaccacccctgcatctttcaagtcctgatggtggcaataatcttcacaatccctccaggaatgtgatattggttttgatttactatttttctaggtagaggcagctgtaatggcttccatttggccctttgtcaccataataaccctcaccctaccagccagggatccaatgtgggggttctgccagctgctaagtatgtctatgccaaatctgcattctggcactggggaaatgaccacagcatgagtccggtaacccactggactcactgtaagtcagacctgagctaaaactccattaattacctgacctccataagcccctactttaactggaggacgacagtgatgttttcggcctcctggaatcaacatcagccaaaagccagtgtccagtagtccctgaaatgtcttattatttccctttccccaatgcacagttaccctggtaaaaggtcagaagtcttcttggggaagaatgggaaaaagattcactgcataaattgtcggtaatatactggggtctttcctcaaggggatccggcctctccttcattcaaggggttccagatctgtaaactggctcaagtctggaaattgattgatggacgatgattttctgtttttataattcaaagtagtcttttgtgcatttgacctagaaattttctgcttgtattaattaagtagaaatacagtagtcttcctatcattttcacttctagcaacaccgtgattaattagccaataccagagctctacactagtcagactattctgattgctgccttgcctctgctgtccatgacagtagctatgcccaccttgcctttgatgattgagtgccgccacttggcctgtgccacctcaggatccagttattcctactctatttaaattttgtagttgagtgactgcgggtcccactgttagatctgacatacagagaagagcaaccacagggctcttcaaagatgcaggtgctgccctcacaaatgtattttgcaaggcattagtcaagggtatatcttctggaccctcacagctgggatgagtaggtctaaagggagtaatccactccaccatccgaatctccttaagcttttggatcccttcatctacattaaaccaagtgagatcaggcatttccagcttactcacagtgggccatcttttaatccatatttcagctaaccaagcaaataaactattagaatctttttaactccctgagctgcaacatgaaatgcagagtccctacttagtgggcccaaatcaataaattcagcctgatccaactctatgttccttccaccattatcccacagccttaatatccattcccatgtctgttctccagatttctgtttatatgaattagtaaactcaagcagttcttttcgagtgtaatgcacctcctcttgggacacactgtgaaccccacctctagggacccactgggactttagttatatgtctagaagtaaacaggggtgttgggggttgctcctaaggagaatcaacattatcttgcctggcaactgcctcaggggaggcctcaggcagcacagggtatatctcctcagacaaaggtagaaaggctcatgacagcatgggtcgaggaggggatattgccactactggggatggggaagctgtttcttctggcaaaaaaaaaaaaaaaaaaaaaattcatcagcagtgtccccagcttcatcaggatcctctcacacattcccattccaagttgcaaggtcccattcttttccaatcaatgccctcactttaacagtagatacctggtgaggcggttcatgcaccttttcttgcagtcagccacttgcatggtaagagcttgggtctgttttcccaaatttcagctctttctctacaggaggtaagactctcactcagggcaatctaatcagatttgaagctcagtatctgcttctgaagctgggagatagaatcgctgagttcagcattttctttcattattttatctgctgaacttaggagcaaccaaccagtttcattacattcttgcttctccacaaatggtcaaaggtattatgtgtagagtcactaaactccttgccactcatgagcaatgaatcaggagtgtaaagtgcatttactttgcataactctgtaaacagttcatgtcgatgactatcagggtttgccatgctattagaagtagagtccttagcatttttgagtctaatcatattaagcagccaactccagaaaccccaaaaccaagaaaagaactccatccttaacattctgttcctctagaaccactcctgataccaaaatctgttattaatcagggttctctagagggacagaactaatatatatgtattttattaactattaacttacatgatcacaaggtcccacagtaggccatctgcaggctgaggagtgaggagagccagtctgagttccaaaactgaagaacttggagtccgatgttccagggcaggaagcatccagcaagggagaaagatgtaggctggaagactaggccagtctctctcttcacatttttctgcctgcttttattctagctgcactggcagctgattatattgtgcccacccaaattaaggtgggtctgcctttcccagcccactgactcaacttttagtttcctttggcaacaccctcacagacatacccaggatcaatactttgtatccttcaatccaatcaaattgacactcattattaactatcacatttctattctgttcctaaagccacactgtctcaacttcttttaaagcacctttttggcctgggcccgaaggctagacaaatcaatttagtccagtatcaagaacaaggcaaaacaagacaaaacaaaaaaattccacttttctctgcattaagttgtcaataaccctaaagcatcttccatgtgtaaacactgtaaacttgacttctttctagaagattaaagttctggattagtagttgtacataaacaaagtatgcaggctaaattatttttacccattattatgtccaatgtctgcttattatcagggaggactttgccagaacccaactttgaatttgttcattcaaataattagtacactaaggcttatatacgtgaaacaagtaaaaagtaatcatggtgttatgtaaccaagtattagaaatgtcagatgggatatttgtcagcattcagtgatttaaagcttttgatatctgtaaaaaaatgtattttctctcttttattagtttcctgtcatgagacgtttgtgcttctttagtcattgtcacttgattcaaacagtaaagtctgtgctggatgaacattttcatttatataataagaatggctttaataaacacttcactcaggggagatatttaaagtaagttctttaaggcctggcactgtggtttacacctgtaatcccagcactttgggaggccaaggagggaggatcgtttgagcttactagctcaagaccagcctgggcaacatgccgaaattcattctcttcaaaaaaaaaaaaaaaaatacaaaaattagccgggtgtagtggtgggcacctgtagtcccatctactcaggaggctgagatgggaggatgatttgcgcctgggaggcagaggttgcagtgaggctgtactccagtctgggcgactaaacttttctgagaaaaagtgagagggcttggaaggatggtttatgacaatgaaccaaagagctctagctttatttgcataataagggagttccaaagagattagagggatttggaagcttgcctgtatactaggcaaatgatccagcgtattcttgtacatgctcatccataacctttttgagtaggtagcagtctgcacaacctgcttccatggcacggataattggaacagtggttgtctttctccagaatatttgactgagaatcccagagcaaagttgattatgaacttggaaggtcatataaatgcaggtgttagggctggaaggtcatatcaacacaggtgttgggtctgccattttagagaataatgggtggtggaagaagccataaaaagattagaggaagaaaaaaggggaaaaatgagtaaatgtctgaagggcagacatgtagtatctcatggcagaggcaaaggcatgactgattctcaaagctgcctgccttcctgcccttcatatgaatggctgcccagatactcttaagccctatatttgtatgtcctttcaaaacttccctttttttttaggttccttgagcaagccattgtttcttgaaaccaaaattacctaatgggtgcagtatttggggggaaaaatgaagcctaagggagaatactacaaaggaaaacttatgaactgataagagaagccaaccaggaaggacatacaagtatgaatgagtaagtcacaaaaggaagatggagataggaagaactttgtttggaggctgaaatcagcaaaatcgagtcaaaacaaagtgtggacatactttaagggaaacgagaaaggttaatatcatgggtcaagacaatttaggatgaagtgaaagcattgtaaaggcagtgccaaaaaaaggttaagttttcatatatcttctctctgacagattattcaattctgacatttttatacctcctttcttcactgaaaatagtcgaaaacattgctttgttttttttacaacatacttcatattaacctgtcctaattaaaatgtgaacttttgttttatttgtaagagatacttaaaatgttattgctacagtgtacactattttccctctttaataatttgcaagtaacataattccttaacaatatttttatggaaaggtcagtgaggccacaaaacacatttagctgacagcacttggagtttctgcctttgaaaacatgttcagcagtttccaagtccatctatttcttattttgaactttctcttgcaaactacaaatgccgtgtgtatatatatatatatgaatatatattatatataatacatatgtgtgtatatatgtacttatatactatatatatatatatatatatatatatatatatatatatacacacaacatagtgaggccccatctctacaaaaaataaaataaggttaaaaaaataaaaattaaatcaaatttaaaaagtcagctggatgtggtgacatgtgcctgtagtcttagctacttgggaggctgaggctggaggattacttcaaccaaggagatcgaggctttagtacgtcatgttcatacccctgcactccagccagagtgatagagtaagaccctgtcctctgccaagaataaaaattaacgaaaaatgaaaaacatgaaaaatgaaacctatacagtcatatgttacttaacaatggggattcattctgagaaaggtgattttgtcattggtgcaaacatcagagtgtacttacacaaatgttgatgttataactggctgcacacctaggctatgtggtatagcttatggctcctaggctacaaacctatacagcatgttactttcctgaatactgaagacaattgtaacacaaagttaagtttttgtgtatctaaacatacctaaacatagaaaaagtacagtcaaaatgtggtattataatcttatgggaccacattgtataagcagtctgtcattgactgaaatgtcattatgcagagcatggctctgtttcatcaatagaaaacagcaccaagcagtcctccaacaacagcaccatgcctacagtgtgggccaacaggctggacgcactcatgcacaagcagggcagatgccaggtgtacagatttcttccccccagcagttctcagtgtgttccaaaccaatgctgcttgtagagccatttcaaattccgcatgatgcgtatctatgtgtgtcagtgcaacattcatctttccacacccatatacacagattcactttcaagcaaagaatgcttcgatacattgtgctggtcaaatgtcccactgttctcatgtccactccttataatggaggacaggggaatggagaaagctggtatgcctgctcaccctctccctcttcttcttatggcagatctagccattatcacttaagttcctgctgcccctgaatagcttttttcacatggtccctggtccaaagggacagcctcactgtggctctggcgatggcatggcagcctgaaattctttgacctgcctcaggaagccatttctgtttcctgaacagcctaaagtgatctatgcttatatcacaatcttgggcacatccaaacactctcatgtgtgcatacatattcaaccttattattattgttgttacgttattgttatcagaattgtaataaacacttacatagtgcttcctatgtgtgagacagtctcctaagctattaagtcatttaatcttcatcacaaccctgtgaagtaaattctagtataatcatttccttgttgcagaggaggaaaaccgacacctgaagggattaaggtgggatgcacaacttgcactggcaatccagttccagagcccatactctcgttccctacacacactttctttctatacctgcatgcacatgctcacacgtgcagacacacatgcatctgcctgctcgtccatataaaaatctaaacgtagctctagcactctagaccctcacttcatgcattgaaccagcatatgggacgtggctcaaataagcatattataaaatcttccacatgatttagattaatgattctatttagaaaccattgctttaatccatgtcttctgtggttcttgtctaattgtgaggcagaattgggaaaggcttcacagaggggagagtattttctaaatccatcttctctctttttacctcttttagccaggagccagcatgatgtagaactacatttaataccaaagggtctttccagattcccatagctctcctcattatggtcttttattatggaaaacattctctcacatctcgcattcttgcctcatctatctactccaagtgagtttggtagttagagactggaaatttttcctctttaaatactatacatttttaaaatctgtattaatttaggattgattaaatgggttaattccagactttccaaggctaacaccgtatcatgtggtatcttgaaagcctggaggttttgagatatctgctatttttataacctaaagagtgaagaagtggctcaggagaagaaaattaatctcagtgttttcatgggatagggatcgttctgggagtatagggagaaccatgagaggaaatgtaggaaaagtatgtactctacatatttagggagattcctagtgcatgacatttgggacataaaaccttttatattttttgtgagacaaacagacttgattcaggcttctctatgctatttatgagccccaagaaggcttagctacaaggtaggggacttgtgacttggagtttgttataatgataggaaatcttatgttaacaaaacaatatcaaagtaaaccatttcaatgaagttgttaactaaattctcttactttcctctccaatctggcatagttttcacaactccaaaactgagataacaatagtgccaccttcctcagttgttagacggaataaatgagtagtaccagcccacaaaatgctgaataagtgtcagcttttagtaatagaattctaattggtattgaataatataatttctgatataagggatcattcaaaagaattgagttttaaattttctactatatacagctagcttaagagtttaatataacactttgacatccatttttttctttccaaaactagcaattacatccagtttccaacatagcataatgaaatgtttagatacaattgtaatgttttatatttgagaaatcaaagctagagactggttcaaggagacatagctaccaaaggcagagtcagggctccaacgcaggtcttctgatgaatagtgagaaaataagacaaactatgataagtcttaaaatatggcataagttctattgtggttcagatgaagaaaggggaacatcttaatgggaactgatggatagagggtgcctgtttgaaattctgttcaattgcttacgttttgcctggatgtttctgtagattccactgaattagtcagccttactgatttgaggttctgaccatgaaagttggcttcagagtcatttcatcctaatccagttagaatcagcttcacccttttcacttacatgataaatcaggctcaagccttgcactctgcttgagaggaggttggaaatgagttcccaatttagaataagaccatctgcaccatatgtgggccatccaactgggactggctctgccctggctaccaaactaattatggatatatttcagggtgtaagttactaggcttaaaatccttaattggcaaagttttattttgttaaaatccctttgctttcgctttggaaaaaaagctcagtaatcaagataaaatatgtaatggactattaattcaaatcaaatttaattttaaaaaatccatgatgaatataacattaaaattttaaatgaagacaagattgaatacttcagagcccttcctctgtatcctcatcctaatctggccctctttccaataaaagtttttaaaagtaggcagccagcgtacaggccatagtttacccatttgatctaaatttaatttaaatctaaatatatatgtatatatttaaatctaaatatatatgtatatacttaaatctaaatacatacatatatatatagcatgaaattatcttgattatggagtttgggggtgactatttaaatattgcttctaaggcaagtgcctttctaaccccaccttggtcccaaattaggttcccagtagctttacagttgagatgcttagttaacccactgtctatcacacttaacttgcttatataccaacacatttttgcataatatctcaacacctgtgttccagaaaagtcctggtgtggaaaatcccagagaataaagattaatagcgcctattcatttcatgctcacagtaaccatgtgaagtagatgcctttatgatgaccctcattaaggaatgagaaagatgaagcaataatgattaaatagcttacccagggcaacatagcaagtaagggatgaggctgagctttagactcagccgggctgactcaagagtccatctcctaggctgctacaccaagttgcctgtgttcagcaggaagtaggaagcaggaaagagagcccaggtagtgcagagcaaaagatataggatggggaaagagtgttttccgtgggcattctggtccctagtttgatgctatgtgatgccatctgcatttccgcctttgggtcgtgcgattcgtcctgtatccttggagaaactctcatcattaacttgcactagcacaagtagatttctgctggtcctcaaaagatcttcaatacaaaaacaatcatggatcaaggctgattgttccaaaactccaccctgataacacccacattgctttcttactttgacatctgtactagtttttatcaactcaacaatcatttcatttgtattaaatgtttatagttttgtctacaggctattttaccactattgttattcttttcaaaaatagtgatatatgagcaaatatatatacagttgatcctccatatttgtggattccacatctgcagatttaaccagtcgcagattgaaaataatttttaaaaaattatagctgcaattgtacttaatatgtacaaacttttttctcttttcattattttttaaacaatacagtacaaccaccatttttaaacatttacctcgtattgggaattataagtattctagagatgatttaaagtatacaagaggatgtttgtacgttatatgcaaatagtaggctattttatatcagggacttgagcatctgtggattttggtgttttagggtcctggaacgaatccctcagggacagcaagggacaattgttcttttcttttcttttgaaatggggtcttgctttgtcgcccagactggagagcagtggtataatctcagctcactgcaatgtctggctcccaggttcaagcaattctctagcctcagcctcccgagtagctgaaactacaggtgtgcaccaccacgcccggatagttttgtacttttagtagagatggggtttcaccatgttggccaggctggtctcgaactcctgacctcaagtgatctgcctgcctcagcctcccagagtgctgggattataggtgtgagccaccgcacctggccaattgtacttaccttccacctgtactgtctccatgttgcacaagctttctgctcccattgtatctaattgtgttgtactcatagttgtcacacagtaactattttagaataagtaaaacccatttaataaccgtttctatttttacccagatacgagaacaaacatcatctccaacgcttttaatatgcaaccacatattttaagtgtaaaaagatgtttgctttctgtgcggttcacattggaataaacaagtctgaattatgagatgctgtaattccttagagagacactgatgacagtataaaacctgagtgcaaagctcaaatggtttgtgtgttcaccaaaaactcaattcaaaattatggctcaataattcaactttctctatgaggttgtcttatttttaatgttataaccttcctagattagagaaccaagcacataatatccacagacaaaatcaaacaaagcctagaaaaaaaatcaactattttttaagtccattacaactgagtagtatgagtaattattttattttcatagccagtgcaatggaatgtgagtctgcaccagttttggagggtattacctaaagttagctttgaaagaaatggtggaaatgtactagaaatacaatgcatgtttccgagcttactttgtgaattcttgtatcctcaaggttattcaaatccaaaataagcatattgaattccagatggcaaaacccacgatcctagaaagaagtgctggtaattctaatgcagattctaacagctagaaattattgaatagccattgtttgaaataataagagttgaaattactgcagtaagacagacttaaagcctatgaaaaattctgttctctctctattaattgcaaaagtcctttgggaaggcttagctgtccctctctgatagcacccttagagggtcagaaatacatccttctgaagtcttacatacttcagttaaatttctgggcttgattttctcatttgtaaattggcaatgatagtacttatatcaaaatattagtcaggatttaatctattaatggataaagtgtgtatcggctatgttataaatatacaacattgctgtttttatttgttattattttactcatagtgtttatctctctggtattaatttaactaaattttctttgagactatattataaaactataactataagactgcagtgagccgagattgtgccactgcactccagtctgggcgacagagtgagactctggggttaatcaaaacatcctcaggtttacaacttgctagataagaaggactaagttcaaaattggcctttcgaatttcagaaggtacatttaactgtttgtgtattactgtctggctaaagatgaacctcggtcaccaatcagggttttgtcaagatggaaatttcctcaatcatggtacagttgtgtgtctcatttcctctggaaaggctttttctttggcttgactactgcagctcacacttttgatttgactctgtctttcttttcaagattgaatgcaagaaacacatttttggaaagatatcttggaacctcttaccatgtaacaaagatgcctgtcctttctaatttttactttgcacttatctgaccttacaactagactgtgaactcttggaatcacggcactattttatacaattttgtatctcttacgtctaaaccaatgtttagataatcttagacattaaatacactttgaatgaatgaaaaacagtgtaaggtatgcaaaatattttttaaaacatggggcttagttttcacaaccagctggctactctcttctttaaaataaatcattttagaagacatcatcatacaggcatttatcacttactggctctgtttaccaagcaggacactgattgcctgaaagaatgaacctaagacccagagttgccagtggaagtcttctaggcactaggagaacccaagttagctttgttattaataacaacagcaactatgggaatgagcataaaggaaattatataatactgtccattattttatattgttaaaaataagcagaagacaaaatccatctaggtatttattgacacttgctctaaagaattcagatattcaagtaaatatgttcagcaattttgtgtattggctaaacgttctaatgacagatagcatgtgaatgggtttgatacacattcttatttcaagctgtaactgttcttatagaaatttttcatctgtgttgagaaactataaaagtgaaaagatagcattcagtttcagagtttgtgatgcacaaatatttctctggagtctctttaaccaacttttcttatatatagattattttgtctaaaacaaattaaaaacacaaagactatattcattggaaatcctgcttttatgtgcaatgaaaaatatgttagacattaatgagctggctggagcagcctcatatttatttttaatctaatgggttatatttgtgtggacataacctatgcaaaaaatcagatatttaagtgctaaaattgtggctatattgaattctaaggttattaaagatgaatacttcacgatcaaatatgagagttagtttaccaaaatataaaaagagctaatgacagcatcttctttcttgatgtactttggacatgtatttataatatgaattacatataatatgaatatatgtctcataaatgattatgtcaaatttataaagatttgaaaaataaaattgttagagcataaggagaaagcataatttgtaagtgtctgcatctagttgtggtttttactaatttctcatattatctaatattacaccaatgacaatcagaagtcatctgacctaaatttttaatatctgatacttataatctaccttagaatatgtggaggtcacttctggatagtcatatctactcactgagttaaattgaggaatcctttgtttttctgcttacataacgaattatcttagcaattctagagaaaagtttatgtacttgaaattaggaagtggtcaagcccttattatagaatttttattacttataatattttacaaatgttaaaaatcggcacagtggttcatgcctgtaatcctagcagtttggaaggcagaggtgggaggatcgcttgagagcagcagtttgagaccagcctgggcaacaaagtgagactccatttctaccaaaaacaattaaaaattcactgagcatggtggtgcatatcagcagtcctgtagccccagctactgggaaagctgagcttggagcagtgcttgagcccaggagtttgaggctgcagttagctatgattgcaccactgcactccagcctgggcgatagtgtgaaaccctgtacatatatatacacacacattatggaccacatatgctcaaaaggccactcaaaaagcagagtatcgaatctagaataagggggtttgtgcgtctttatcgatcataatcataattatttcactagcctgggagatcaggaattaaatttagaagcttggaagtaagctttgagtcttttccaaacatccccatgaacataggtttgtggaatgaaaatattattcttcttcctgaaaagaattccccagccattaattagtcccagtgttgtttctctttgagaaaaaattatctcagtcatttataaccaaaaacaatacccagagagaaattcaataacagtatacattaaatcagtgattccctagtcacaaataaataattctggttccgtatctagaaagtgaaaccattgcccagaacatttcacctcccattgtccatttgcggtctgcatcctgccaaagttacaggatttgggtgtgagaatttttagaatccaaagaggtatttacatattctgtagctcattgtagcagaacatttttctatctctctaaagattatgtacacaatctttaagagcattttggaaagagcagggacctcaagctcacatgtatttttcattaccttccagctgctagttcttagattgtcagaattgggataataacccgaagactatcactttgtgttttactaaaagggaagattgggttgccaccataatccctaattgaggccgaattagaataaacggctgttaagctctccagcataattgtgaatggtgtgtgtttgacattctctaagatataaattagaataaaaagaacattttcagagtcatggagtagctttgcattaatgatggcctccctcgcactgctgacagtctgcattattcatagtgtcattatcaggactattcagtgctgaatgatttgttcgcccagaaattgtatgacctgaccagatgagtaatatctgtagtttgtatttatccttatgactgcttacttgggtatggcttcttttatctctgttgtgagcttacttactgctgctcagcgggatgtaccatcagtgacagaagctttattcatttacagatccacagtgcggcatcacagtattaaatcctgcaaatgtggggaaaactcaaaggctttaatcatcggactggcaattgtcattgtactgctgccatatgtcagcgctgaagttaagtttcatgtctgtgcgctgtaaggaaggcatgtggccatgtgttgcctgcttgtttgtttaagatagagtcttccccgccactggaataactttgccattcaaatccctttcatctgcacagaatgaactaaccagagtcctacaatgaaatgtgaatgtgtcctttcagaactgattggtccatttcataactcctttcttattctaattaaaccagctcaggagagaactgtgttttagcatcttgggcttcggaatgacagggaatggcaggaaagaatcagaggatgtagaaagctctctgctgtgaaagcaaggtttcaaggtctagaggatttttcctcccagcaaagagatcatcttttgaaatcgtcgccatccgttcccctctacacacaccaatttcggttttataacaccccttgctgtgcatctcttggcaggaaagttgcccatcttgcagagtcttgcatgaataattcatttatatgtcatgctgactcttgaaagcctggattacagctttggaggaaatgcttaataggattcttccaaacaatccaaaatatagctcagagttctatgagttctatctcttagaaagcctcggtgcaataaaagaattaatgtgctggaagcccaaacacactcgaggccattcaacctgcgttgagctaaagtgtaacctaataatgaaggttagtattttagattagggtttctgtttctcagagacaggattcttaagtacaggccttgagttcaatacactggcacaattactttttgttagatcttgaggttttggatttttttttttttaacatcaaaggaccttggagaaccaggcagacaagcagctgagagaagtattgagttagatgagggcaaacaaactctgcatatatcaggtcgcatgatcgcctgccgttactcaatgatgctgttctttaaacagtggtcctgctatcagtcaagctggaaaatttaaagatcttctgtagactcagtatctcacctcttttagtccctgtctcagtaattttattgtatctactcacctttacttcctcttccgttttccacaaagccttttttgtcctcccttcaacacttgcctgtaacaaagtctttaaaatatatttacattacccatttaaggatcgattgcctaaattctaacccactttcactctcccaggatggtttgcgtcttaagccaagaagaaagtcatagattaaaagagtctattgattctactgaggcttattctttgcttgtttaataactttgaaaatgacaaaaataatgtgcttgttgtacataacaaaatagttaaactaaaagaaagaaaattttaaaaataataataaccaataacaacttgacattgtggcatattaatccatattcatgtttatatctagatgtggatccatctgtatgtctatagattcatatatccatgtatgtaactttacaaaggtaggacaatctatagcagaattttaaatagcagttgaattccagcagaggatctattcctttggtttgctctatctaggttgctgggttttaaactttttcagagtcttttgcattagtggaaggaatttggattggatatcttccttttttgccctcgagatctataattaccttttaaaattccgctctgtgccttgtcaggctaactttttagggttgtatctgtgggctttcttaccctctggcccccgattgagttcagccaatgagagaatcaacaggagcccatcaggaaggtagagtgagattagggtatttattcacccagtttcctttcttgggaaagggagttaatagcacacaactctttctcctgctgagttttagtagccaacccctcccctctctacttcaggcctggggtagtaacttcttattttagttattattgctgcaaagcaaactatcccaaaacttagtaacttacaactacaattgtttatttgccacagaactggcaatttttgcttggtcaggaaggtttatttttgcttttcactgcttcagctggagtggattaacttggggatataagatctatttccaggaaggttccctcacatgctggcaagttagtgctgactgttggcttggagttcaacttggactgaggaccaggggcttaggttcttcttcacatgagcttctctaaagcttcttggacttcctcacagtacagtgtctaggttccaacaacaatcttccgaaagaaaaccaggcgtatacactgcatcacttttatgatacaaccatggatcattctgcatcattttctactgtaatcacaaatgctcatagattcaaaggaatgaaatagagacatcacctttcaatggcagaataccaagtgaaactaaaaagagcatgtgggatgagaaatattagaaataaggcaatttatctgatggcttcttacttattagccacagagtactgtactacctttgggtagtttacttttgtaaacaatctctgtgttcaattatactcaaactaccaaatatgagtatgccatatttttttgctgggaccctgcttaatacaaaattgagagtaaataatagcagggaaggtaaaggaggagggtgccatttagcaaggtgtcaggaactagcctaaatatctactacagcaccatctttatctttaatacaaatattttgatatcacataagttttcattggaagaaagtctctttctgttaaaagaatattttaaaataccactgtttatgtccttgagcatcatgatatcagttttaaaagttgtttcctgcctactgtactaactcctaatcaaaactcttacaagtttgtgcttcttgccagggaaattcattttttcttcttggttaattacaagatatgtacaaagaacatacaatgttcagtgcaccttcagatgtgttaacgacacattatcaacactagatcatctgactcatccatattgacagtcaaggtatcattaacctcaaacttgaatgatctattcaaacagtggcttcatgcaaaaatagtttttaaaaaaatatttctataagtttttttcttccctttctctactgcacatctcttctcagatgaagccctttaggtacttattgaacctacagaaggaaataagatggcaggagttagtatatattctatttgtcagtacaagtgaaatagaatggggctatgtacttttcagaggatggaactgaattcccttggaaaataaaaagagaaaatttcagtattttggctagaggaatataagttaaagataatacctcttttctactttccttgtgacctgtaggaggttttccctatgtgaaactgaaagtggtagaattggtaaagatactgcagcagaaataaatgaagagatgcaggaataagtcaccgaaaaatttaaacctcaagtaatggtgcgtgcctttgtctaactattttaaatcagactcttgaaaaagagtcataataaattataataaagaagaacaatctacataatactcccattttacaaaaacaattttatcacaactataaatattctggcttgaaatatctggtactttccccacattgtcccttgtgatgttagagctgccccttaggtcattagatcagtcagggaccaagcaaaagacagaaatcacacacagttttattaacagagaatgtcctatgaaaaattgtaaactacgtgtaaagttgttaacttggcaatcgaaaaggcaaaaggggaaactaaggtatcatagacagatgacaaatgtgagaagcaacggacactcctagggctggggaaacagagggaataggttggaattttcagaaccttgaagcttggaagaggaggcctatagaacgaacagacaaagttctgagccaggactctgcttagctggcctagtgtctcagctcaccagaggagcctgccaaggtctggatatagacttctgacagggggatcctaaacagctggtgctaatatttccaagaaggacattacgaggttcgttctgcaggcactgagacacctgtacaacagcaacacagctgctttgagggtgaatatagtaatgtaggttagtacctcatagatacatttttaatatatattcagtacaaactttatatgtattttttatcatctgttatctatctgtctaccaacctatctattaacctatcttcctacctatataatcaatttgtcccattttcgtgatgctgaccagtaaatagttcaggagtttctgctgtgctttttctttaggttccgctcctagtgattgctataataggaaacattatgagttttgactcatttggcaagcttgcagtttcttccataaacagcctttttattctgcctaaatcaagcagatgcaaaggagatggaaaagctgcatgtattgatcatctatggtgtactagccaactgagctcggtgcttttcaaaaattatctcatatggttcttgccataatccaattatgcagatatttttgttctcacttctcattttactagtgagaaaactgaagttataaaacgtatcagaagatacacataaaacatatgaagtgggcaggatttgaagctagaactacctccttcaaaaagatttaaatcctcctgcccccaccaactttgaaaccactgctagcccatatggtgtcttgtgctaattttaaaaaaaatgtgcttactaatttaaaaaaaaatgccttctccaaggctgacaaaaccccatgggtacacaacctggcaagaggattaaatgtttgtgtgttagaaaaaggcatttctacttctgggtagatgcaactctgagtcaggtcacacagcttggagacctgagcgggggtttgatttgcatcttctttcacatcctgggtcgggcacccttgtgaacagcacagtctatacaactgaataccatggtctttttcaacatcactttcgtcaaaatattgttcctgtttaagatctctctttcattcagatttcagcattaagaggacaacatgcctttctgccctaaaatgctttgttgttctcacttcacttttatataataatgctaattatgtagtaaattagtgaccttttgctgcaaaacaaatgatctcaaaacttagcagccgaataagaacaaatatttgttatctcacataaattcttagggtcagaaatccaggagtcactttgctgggtggttctgctttgggacctctcatgagatggcaatcaagctgtcagcccggcatcagccatttgaagttttccgcagctgtggaatcttcctttaagctcattcacagggctactggaaggaggcttcagttcctcaccacactggcatctccacagagctgcttatcacatggcttcccccagaaagagtggctgaagagaagaagaaaaataccagtcacagtggaagctgaagggacttttgtaacttcacctcagaaatgaagtatcatttttttctgtggtaatttttttctttttctttttttgagatggagtctcactctgtcacccaggctggagtgcagtggcacaatcttggctcacggcaacctctgcctcctgggttcaagcgattctcctgcctcagcctcttgagtagctggtactacaggcgtgcacaaccatgcccagctttttgtttgtttgttttgtatttctactagagatggggtttcaccatattggccaggctggtctcgaacttctgaccttgtgatccacctgcctcagcctcccaaagtgctgggattataggcgtgagccaacgcgccgggcctttatctgctgtattttattggtcccacagaacaacattgtacaacgtacaaatgattgggagtcatcttagagggtagcaaatatagttaagactatggtctcattatatgtgccaacatcctgaggagataaaatggctgatactcaggtgatcctcagtggtacaactgttggctggcatttattttggtcaaatgagtgtttttcctgatttttctatgctcatgcccaatcagttgttaaatattttaataattattcctggagatagatatggttgttatcatcagcttgcagacgttgaatgtgaggtttctagacttcaatttcctccacaaataaatgctagaaccgaccttggaacccccaatcttttaattactatgttattaccttctttagtatattcaattttaacttcaattcatcacttctagaagtaagctggcaccacactaataccaaacatgtttctacatgaataaatttccataacatattaaatataaaagcctcttttaaagctagcttgatgttaaaaatcaaaggaagagattttatcattaggcaggtcagagactcatttcaccctgtgttcaaagagcagagcccatgtctcagataaagagcttatctaattttgaggaagacattctatattactgttttctttctagctaatataacatttggatttgagttttaaggggataaccctctccccaaatatttaagcatgtcagttccataggagtgcatttagggagaccaagtgggagatcctattatttgcatactccgccaacaacagaaagactgagttctgtaattatgaaaattatcggttaaaaccggttgacaggaaaaaatgacaacttggctgattttttaaaatttttaaatagatactgggcatgttatataagtgctgcctgaaggctgggtttgggtattttatcaaaaagtagcaaataataacaaatgtactttgtgaaaaaataattagtggatgtgattattttattttcgaaatataaatttatgcataagaagaataaatgcaaggtattagtagcaaccaatttacttcttatacaatccttatttcaggcaacatttataaaggccaactgaaattgaagctaaggcaaatgcccagatataagctcaggccaaaatccccaaatttgcagttatcaatatatcctcaatatatcaatggctccttggctacagggtaatgtaaactaagacaaaataaatctggtttgcacaagctttggatattttattagccatgtggcatcttccaacctatggaaattaagctatggccaaggccaagtctggctaaaaaaaaaaacaggcaatcacacaattttaacaagctcacatgttttaacgtaacctcaaatctattttcatttttttccatttcctgcccaataacagctcccatactgaaatgcagggactgaagccttctttttttccccccactggagaaatcttatctaactctattaggccataaataaacactaagacccatgctaaacctcaaaaatcctaaacaaatatgcaatatattcttcatatgctcacctatttcattcttataatggctttccctggatccatcgtccagatgcttactttgtgacaaaagtattttgattcaattatctgtgaagggaaatatcaaagaaaaaccatcataaagatatctggcctcttaaaactatgttgcctttaggagctcatgttagaagcgtaagagctgaagttttctgtctgaattcaatttcaattagattttaatatcagacctccctctgattattaatattctaccacccaattttcaaaaatgtaatttgtcatgcaataaccttgctggctctgtatttccatcatcacatttgccctcactccacattctatatggtctgtgtgaataagctcttaatcaaaattttattctattcttgagagtgtaactttcccaaactaagtttgtaaaagtgaaatctttttcactcaagctttgtaaattacaatcttcttaacatcaatggtttaatgtgttctgagaatgaggaaaaaatagggagggaagtttgcgtgttttaataattctccctttgcttcttctaatgaagattaaagtttatatgaaatttaatgagacatttgtctatcagaggtaaaatctatgcagtatctcctggacaacacataaaatgggcctctttaaaggaaaaaaggagttcttcatatttaaagtatcatataatagtaagaaaaaaataaatctactaatcactgatggaatagctatggtatggtatgttaccacttcataaattttgactatccttaaagcagttgaattaacccagtctaaatgcaaataggttttatttatttatttatttacttattcatgcatttatttatttaaggccaacttcagtttctagtagacactaataatgctgtaatgaggattgtgagactatgtgaagtcattggggaagattatcatgatcaattaatgatgtctgtcatgagtttgccaaagggaagttgtaggttatacatatatgcaagatattttgcatccctggtctatgtgaagtagaacaagactgatggtattagtccattcttcactgcaataaagacatacctgagactgggtaatttatggagaaaagacgtttaattggctcacagttccacatgctgtacaggaagcatggctggggaggcctcaggaaaattacaatcatggcagaaggcaaaggggaaacaggagtgttttacatggctggaacaggaggaagagagtgaagggggaagtgttacacacttttaaacaaccacatcacttgagaactcactcactaccatgagaatagcaagggaaaaatctgcccccattatccaatcacctctcaagtctctcccccaacattgggaattacaattcaacacaaaatttgggtggggacagagagctaagccacatccctgataaaagttttctattatttacctgttatactttaggaaaattttcgcatacttttggaattagagcttcaagggctgaggtttgggaatgcaaactttcaaaaatttcgccaattgattctaacaaggagccaagcttaggagccattgttttaaggatcagatttatatcaagcttattttttaatatttaaaaaagtcttctggatacatagaagttttatatacttacggggtacatgagatgttttaatgcaagcatgcaatgtgtaataatcacatcatggagaatgaggaattcatcccctgaagcattttcaaacatatttttcagttcagagctaagtggtaagcaatgagtgagtgtgtgcttgcgtgtggcaggcaggagggggcagtataggaaagaaacaatcgaattcttgtggaaaaaggactgctttatttctttgcaatcgttttgcatgtgggtttttattattacggagaccaacttcaaaggggaataaaaaatagatatagactagtccaggagaataagaaagaaaaaggaaggagagtataatattcatgtagggtcataggtctttctgtttctctgaaatttacattacagggttgcaatggttcacttgccttaggtacacatcagttaagtctcagaggaggtagagaactggggcaattatttgcaaattcattgacttagttgatcattgcttcaagtttctatttcaatcacaccatggagattgaactagaattaatttcctggttaagtgaccctaagaagtcatgccctgctctcttctaattccacaccattttactgcagatcatggcagctcatacatacaaagatacataaatgaatatctaatctttttagagacagggtctcactatgttgcccagggtggacttgaactcctggcctcaagtgatcttcttgcttcagcttcccaagtgctgagattataggtgtgagccacctgggccagcccgaaatttttcacaaacatgtttgtgtatgtgtgtatgtgtgtgtgtgtgtgtgtgtgtgtgtgtatgggtgaattggtgtgggtgtatgtatatacttatctactgaattctcttccccgtcccccttctccttttcctcctttccatctctctccctctttcacacacatacacacagacacacacacacgtgccctatgtagctatttatgtgaaggcattctaacaaaggaaaaacttttcaaaagtccacagaaattaaagcttctcaagatgcatcacgatctaacgaataaaaataacaatgttttgcaacatgcaaaatcacaacatattgcaaaagataattgaaattcctacatatgcctaggatattaatatttttccctgcttttttgtaattagattgatgtgcgtaattaaaaatctgctccccacatgtgcttaagaatgccaggtttttcctgagtcatattgtcaactccaatactaggtttgaatgtgtcttctatcccggtggtatatacacgtgtgatattttagcacccctgcaaggtgctggtgtgctgagaatatcagcacagatgttataggatgctgttattcagaaataaattattcatttcctgggcactttcagttttatgttgacaatagtagccattacaatccaatctgatttacattctcagcatttacctttcaaactgataggcctctgaaacaataaacgttttggaagtttagacattattttcagtctggttttctagatgcagaaactgagatacggatttgaatgtacttgatgtatcagggagtgtgctgaagagataaggactgaggaaagacaagcaagagttggtccactttgaggcaagggggtcaatatttatacccccaaggtattagtttgatggggttgtgatatggtttggatctgtgttctgcccaaatctcatgttgatatgtaatccccaatgctggggttgggtcctggtgggaggtaattggatcaagggggccatttcctattaatggtttagcaccattctgcaagtgctgttctcatgatagagttgtcatgagatctacttattttaaaatgtgaagcacctcccccgaccccttgttacatttctggtcatgtaagacatgcttgcttctccttcatcttctgcggtgattgtaagtttcctgaggcctccacagagactgatgctgccaagcttcctgtacagcctgcagaactgtgagccaattaaacctcttttctttataaattacccaatttcaggtgtttctttagaaaaatgtgagaataaactgatacggaatattggtaccaagaagcagggcactgctataaggatacctgaaaatgtggaagcagctttggaattgagaaagcagcagaagttggaagagtgtggagggttcagaagaagagagaatggtaaggaaaatgttggaacttcctagaggcttgttgaatgatcgtgaccaaaatgctgatagtaatatggacaatgaagtccaagttgatgaagtgtcagatggaaatgagttacttattgggaactgaagtaaaggtcacttttgttatgcattagcaaagaggttggctgcattgtccagcctggtcatgtgattgaagagaaaagccccttttcaggagagaaattcaagcaggctgcagaaatttgcataagtaaaaaggagccaagtgctaatatccaagacatggggaaaagactccaaaggcatttcagacacctttgcagcagcccttccaatcacaggcccagaggtctaggagggaaaaatggttttctgggtgaggcccagggccctgccaccctgcgcagccttgggacactgcctcctacctcccagctgctccagctccagccatggttcaagggggcccaattatagcttcagtgggtataagccataagccttggcagcttcctatggtgttaagctcatgggtgcacagagtgcaagagttcaggctcaggagcctctgcctagatttcagagaacatatggaaaagcctgaatgtccaggtggaagcctgttgctggggtggagccttcatggagaacctttaatagggcagtgcaaagcagaagtgtagggttggagcccacacacagagtccccactggagcactgtctagttgagctgtgagaagaggaccaccatcctccaggccctagaattgtagattcaacaacagcttgcactgtgcacctggaaaagccacaggcattcagtgccagcttgtgaaagcagccaaaggggtttgtaacctacaaagccacaagggtggagctgcccaaggcattgttatcccactccttgtaccagtgtgccgtggatgtgagatatagaatcagaggttaatatttgggagctttaagatttaatggctgccctgctgcgtttgaggtttgcacagggcctgtagcctttcttttggttaatttctccattttgaaataggagtaactacccaatagttgtacccccattgtatcttgaagtacctaacttgtttttgattttacaagttcataggcagaagggactagccttgtctcgaataaaactttggactgtggacttttgagttaatgctggaatgagttaagactttgggggactgttggaaaggcatgattgcgttttgaaatgtgagaaggatgagatttggaagggaccggggtagaatgatataggtttggtctgtctccctgccaaaatctcatgttgaaatgtaatcctccatcccggatgtggggtgtggtaaaaggtgattggcttatgggagctctttctcattaatgatttagcaccagccgctagtgctgttctcgtgatagagttctcacgagatctggttgtttaaaagtgtgtagtaccacctccctccttcttgctcctgctccagccatgtaagaggtgcctgcttcccctttgtcttctcccatgatggtaagtttcctgaggtctcctcagaagctgatgctgctatgcttcctatatattctgcagaattgtgagccagttaaacctttttctttataaattacccagtcttaggtatttctttctttctttttttttctttgagacagcatctcacactgtcgcctgggatggagtggagtgcaatggcgtgatctcggctcactgcaacctttgcctcccgagttcaagagattcttctgcttcagcctcctgagtagctcctgagtacaggagcctgccaccacacccagctaattttttttgtatttttagtagagacggggtttcactatgttggccaggctggtctctaactgctgacctcgtgatccactcatcttggcctcccaaagtgttgggattacaggcgtgagccactgagcccagccaggtatttctttacagcagtggaagaacagactaatacaggctgtcttagcaaaatactagactgggtggcttcagtaacaaaaatttattgtctcatacttctggaggctggacatccaagatcaagatgctagtggagttttttttttctgagggccataaggaaaagaaccattatcagacctctctccttggcttgcaggtggccacctgcttgctgccccttcatttggtctttcctctgtctgcatgccctttatggctctttttgtgtgcaaatttcctcttcttagaaggacacaagacaggctggatttgggccctgctaacaacctcatcttaatgtaatcacctgtttaaatgtgctatctccaaacatagtcacattctgaggtacttggggttagggcttcagtgtatgaattttgggtgaacacaattcagcttgtaatcctcatcaatccaatctgtcagtcactggctataggcaacatctagggaagagggtgaggagtaacatttccagtgtccctgagaagtcacttggagcagtgggaggatagatagaggggttactgaataaaggtgatctggtagggcaacccacagtgccaactgcagaaattattatatgccagtggaagaatcatgaagttcataaacgtggaatggagaactttatttctcataaagggttgcagcctctgggctggccactacacaggctggaaagtatcgcctctggaagaagccaagttcaaacactttgaggcaggggcaaaaggaacagaagtttatgctgagcagttgactaagtatccatattctataaactaaaggaggagtcatgaatatttatgaaaggagaaaccatgcccatgagcaattgagcttcatgcctcttcatgaattgcatagaaaaaagcatggctgtgctggcatgatgagggtggatgttttggccctctgatgtcaaatggtgaagcagaggacacgaaaacctttactgcacatcctccatgagttggtcaaaagcagtccagaggtggtggtcatttttttagaaaggggtgcattgtaaaactagtgagctgtcatgtcaaaactgcaaagctggagggggagtccagtcgtggcctcagatgactgattaagggaaataatggaatgaatcagctgtttcttgttttccagaacttgtttctgcttactcctcaggaaaaaattctggttaaaggttaataagggaggggaggactgaggcacatctgacctcttatcccatcatggctgggagctcagttttccctttggtccctttggctcagaaggggcccattcagtcagtcaacgggcttaggattttatttttatttctcaataaatagaagtaactaatatttcatgatcccttaataattaggtatttcatcaaatttaggaacccattaacaataacacacactattattttaaggactgtaagaaaagaaaaccatgccacaagatggcaatctaataggaaacctccagaaaagtgggacacaaaagaattaaattctcaatgtcaagaaaaatgagtaatgaaaccaccatgcagaaaggcagtaagaaacattcatgtttatatattggcacacgatagaagaaagaaaaaaataactcccttaaaaatttggaccttaagctcttactaacatgaatttttgactttaattcacactactcaggtggtccaaaaccctaagcagacaatttaattaaaagtgctctcaggtatgcagtgcccccaaataattggaggagcaaataccaatgtgaccaaacggtgaagatgcactgattagaaaacgcttcctccgcagatgtcaaatgatgataaatagtgatgataacaaggatagacaaaattttgtataatctgaggctttttctttagtgttggcaaactgcagcctgtgggctggctgctgctccttgttataaataaagttttattggaagacaatcatgccattcatttctatacaatctatggctacttttgtgatataacagcacagttaaatagttgccacagagaccatatgacctacaaaactggcaagaattattatctgaccctttacaaaaaaagtttgctgaacccctgatgaatttccacctattacattatttcattttaaccacaatcttatgtggtagataacattatatccccattttataggccgggaaacagggaccaagaggttaaatgacttacccaatgtcacatactagtaaatagcataagaaaaatttgattataggtatgtcattaacttctagtggttaattatgtaagaggggaaggtatccaaagaaaatgggctgcctgatagtaggcgttcaatagatagtttgttgtatgaataaatgcatgaattaatggatatagtcaagatgtggcagaaccaggattttaacccaggccactctgaatccaaattccaatatctcttaaaaacaagatataaaagtgtaattaaccgcagagacagagactgccttagcctctacccttaattaacttgacagagtaacccacacctttttttctgataaaaacatgctgactcatgcatccactagggtactcacaaatacttttgttcccagcagatgtgctctttgaatcccattttaatctgcatttttattaactgacctactgttgtcctgattacattgaagaagaggtcatccattgtaccagatacaggactttctgtgagttaatagatccaaaggcagggaaataattttccttaacaaattatccatttgtttcccaatatttagaagaaaagtcattatttttgttaacaagtaaaataaaattagttaaaagccctatgttaattgaatgctcattataaagttaaaaataatttgagtgaagtatttatatctgtgcttataaatatttcttttttttttttttttttgagacagagtcttgctctgtcgcccaggctggagtgcagtggtgtgatctcggctcactgcaagctccgccccctgggttcacgccagtgtcctgccttagcctcccgagtagctgggtctgcaggcgaccgccacctctccccgctaattttttttttttttttgtatttttagtagagacggggtttcaccatgttagccaggatggtctcgatctcctgacctcgtgatctgcccgcctcggcctcccaaagtgctgggattacaggcgtgagccaccttgcccggcctgtgcttataaatatttctataaaatattcagcttaaaattgttgtaaaaagattattaaaataggaaaataattcaatagttaatagaaaaaaggaatatttttcattatgaaaaactcttttttaatttaagcaagaaaatattaacctactggtgatagtagaaacaagatggcaggttcttttctcaagaggagctcgctgtgtagtaggcgagcctgtgttgaacccaagcagatctggctctagagtctctgcttttaactactatattctactgccttttcctgagaaatgccattttgcacaaagatctctgcaaattgcttaaaaagctttctattggagcagagtggaggagatatttgaaatgagttttgaatggctcatgggagcttagcaagagaatgaggaagaaagaaagaaggtgagatgagatttaaaaaataaaaaattgtgctgaggccagaggcatgaaacaacatattagggtcagagagtttaaagtggtttggtaatggtagagggtagggtgaatgttgggacatggtgaaggatgaaacaaataaacaaagtaataataacatgccctagtttgactttcagccaatgaacagcaaggagtcactgaagaatttaaacaacagaatgagaaactcagatttttattattgaaaattgtcattctggcagtagcacgtgaaatgacttggaatggggaaggcagggatctctctgaaccttccttaacagtggtctttgctgacctttcctctcctgcctattctttacataccaccatggcccaagagccaggccctggcctcttcttgtcactttctacaattccttggccaatctcatccattcccatgattcacgcatctgtacaagtgagctggatccctctcttgagaaatagtctgatggtacacattcacagcagcttggagcagaggaatctcaaagtccacatatccaaggaacagaagaagctcaactctgtggattcagatctgactgacaaccctccaactcataccgtgaactgaaattagtaattgaccttaccatcccatctaataggcaagccaggaaatcagaggccctcctaaatttctctctttctctcaccacccattgcattttatcccatcaatttcaaattaatacttgtattctgttaactcaacctataatagtcccatccctccctttcagtgtggaacctgaagagcttttaaactcttatatagatgttagaactccaatgcccagagagtctgagttaaacggtctggcatgaggctcaggactggtatctcttaaatgttttttaggtgttttggatgtgcagctatgagtgagaatcattgctctcagccaaataaactgttagtgatttgtccattgcttccacctccatgttctctctcattctcagcccatggcatgtccttcagccatgttaaaggcatggtaagttcttgaatatgccgatttattccaagcctccctgctttgacttatgctattctctatgtctgcatttcctaccattatccttctctatacacttgagccttctctcctcaagtagaactgattattccttcattttgcctcagcccctgaggtccttcctcatattttagagtatctataacttcattgcctttgttctttacctatctatcttccccgaccctggaaatcactctctgagttgagcgatcatccagtttcattcttagaaatatttcagaaccttacatatagaacagactctctcaaatggtatgctattgatactttgggctgagaaatcctctgttgtagggatccatcctacagcaggatgtttagcaacatccctcgtctctacccactagatgataagtagcaaccccttcccacttgtgataatcaaaaagtggcacatgtctatagtcccagctactcaggaagctgagacagaaggagctcttgaagttggccagcctgtgcaacacagcacgatcctgtaaaaaaatgaaaaaacaaaaacaaacaaacaaaaccaataacaacaaaaaaaaaacacctacaaacattgtccaactctggggtgggtgtgaggaggacaaaatcaaccctgctgaggacaactgagatgctaaaactgattggtggaggacatgtagaaagtgtggctgcttgttatgctgatggtttctttaaaacaagcctccctatgtagtcccctcttctgttgactcagggcttagccatgtgatttactttggtcaataggtcatcaacaaggacaatgcccacagaggcttgaaaaaagcttgttgtactagggattgcccctttggagctcagctaccatgtataaagcccaggctagtttcctcgaggatgagacaccacaagaaaagagagacacccataccacaaagagaaagaagcccaagtcttccaacattccagtgaggcctgctcccagtgtacctgctatatgaatatacccaggtgagaccagtagtagaatatcccagccaaaccacaggatcatgagaaacaataaatcattatctgtgactttatatttagaacactccatcatctcagcccaaaaacttattgaactgataataaatttcaaggaagtctcagtatacaaaataaatgtgcaaagatagcaatcattcctttacaccaacagtaggcaagcagagagccaaatcatgaatgaattcccattcacaaatgctacaaagagaataaaatacctaggaatacagctaacaagggatgtgaaggacctcttcaaggagaactacaaaccattgttcaaggaaataagagaggacacaaacaaatggaaaaacattccatcctcatggataggaagaatcagtatcgtgaaaatggccacacagcccaaaataatctatagattcaatgctcttcctatcaaactacctttaacattcttcacagaattagaacaaatctactttaaatttcatatggaatcaaagaagaccccatatagccaagacaatcctaaacaaaaagaatgaagctggaggcatcacactacctgatttcaaactatactacaaggctacagtaaccaaaacagcatggcactggtaccaaaacagacatatagaccaatggagcagaacggagacctcaaaaataacaccacacatctacaatcatctacaacttaacaaaaacaagcaatggggaaaggatctcctatttattaaatggtgctgggaaaactggctagccatatgcagaaaactgaaactggaccccttccttacaccttatacaaaaattaactcaagatgggttaaagaattaaatgtaaaacccaaaaccataaaaaccctagaagaaaacctaggcaataccattcaggacataggcatgggcaaagacttcatgacaaaatcgccaaaagcaattgcaacaaaagccaaaattgacaaatggaatctaattaaactaaagaacttctgcacaggaaaagaaactatcatcagagtgaacaggcaacctaaagaatgggaggaaacttttgcattctacccatctgacaaggtctaatatccataatttacaaggagtttaaacatatttacaagaaacaaacaaccccattcaaaaagtgggcaatggatatgaacagacacttctcaaaagaagacatttacatggccaacaaatatttgaaaaaaagctcaacatcactgatcatcagagaaatgcaaatcaaaaccacaatgagataccatctcatatcagtcagaatggcgattattaaaaagtcaggaaacaatagttgctggcaaggctgtggagaaataggaatgcttttacactgctggtgggagtgtaaattagttcaaccactgtggaagacagtatggtgactcctcaaggatctagaaccagaaataccatttgacccagcaatcccattactgggtatatacccaaaggaatataaatcattctactataaagacacatgcacacatatgtttattgcagcactgtttacaatagcaaagacatggaatgaacccaaatgccaattaatgatagactggataaagaaaaagtggtacatatacaccttggaatactatgcagccataaaaaggaatgagatcatggccttttcagggacatggatgaagctggaagccatcatcatcagcaaactgccacaggaacaagaaaccaaacacccatggtcttgctcataactgggagttgaacatctgtgaccagatggacacagagaggggaacagcacacaccagggcctgttggggatagggggtgaaaggaaggaacttagaggacaggtcattaggtgagcaaaccaccatggcacatgtatacctatgtaacaaacctgcacgttctgcacatgtatccctttttttattttttagaagaaataagagaaaatatcattgtctgaagccactaagttgtggtgtggtacattatgtagtaatacagaatatggaggtcattttaaaagtgcagtgaaaggaactgagaatctgaactagggcagtggtggtgggaatagaaagtggtgtggaatttagtttaatgttttctgtactctgctgagcaatctactaagtaccctgcaggattcacatttatcaataattgatgatttatacttgtacactttttttaaagatttgaaaacctttattacctcagtaattattttcttaagtgtttgctatgcattaggcactttacaagcattagttcatttaatcctcgtaacaacactatgaagtgagtcatactatcagtccattttataaatgagggaaccaaggcttataaaattaaatacttgaccccatcaaatagctagtaagtggtgaaaccaggattcagactaagctctgtctgactcctgaagaattgcttttaaatattcttctacattttcaaaaaagtgtttggtgtaagatctttatttgatctttctgggagtagagaaaagctatttgccattcttttcattctcaacaatccctttcccaggctgaagtttcagtttaacagggagtatttttattgtgaataactgcaaggtcaatttgtggtacattttcacttcctgaatgatacaagtttcagggaaatggatgtgagggacatgaatttccagtctatattagcagccaccaaagattatttgctgtgaactgattagcccctcatctcccttctcttcttcaaaatctaaggaacgttctgtcttttccagcacttcgaggactttttgtgatttagaatgggaagcatggggcagagagaaagtcaacttgagtggacagagccagaggtgtgcttctgctgaaggtagggatttgaggggttagcaggaaggagaggtccctaagagggaataagttcacatatgaccttgctatatatcaaggttatagattcctttacttgctctatttacagctttcccaaatgttgctcacactatctgaagccacataaccaaggattataaactttcttgagaaagcattactaaacttccccagacttggcaaagtacacgcttagctgttcttatcgtgcctacagctgtggggagctttctttgaagagtctctcctccccatcaccaaatgcagtatcaggaaattccacctgagaaactattgttttttacacgtcatttgaaatatggcttctgagatttcaaattaaattaacagcagcctgcagtcttgactgcttctagaaaaaactgtgtataaaaagcccagccatcttttgatctaaaagttctgtatatatttaaatttcctagtatctcatgtttacattagaaatgcccatctgggtttgctgaatgaggaataattgtgtgtccatttgtttttctctgatttgtagttacttcactatctcaagataaaagaatattttacctcggtgagagaggactcaagtttttttgacaatgtcatttgtgatacagccaagggctttataactgactgtatacatctaagtggctatttaactgaaaagaaaataaatttggttcaatgcttgagtctatgctaatgtcgactgtgacagaactttcctttctttactctctaatccagcagagggcactgatcaaacatcagtggctttaaacctagacgccttgttcactgaatagtttatcagtgctattagataatttttctcttcaagccattatctaactggaagcaaactttggaaaatgatgtgtacattggccttggtaaatggtttatggatttaaaataataattttcaacacaactgcaccctgtattctctatatttttgccgttcagtacagcaaccacttgccatgaggggttactgagcacttgaaatgtgactagtttgaattgagatgtgctgttaggcatgcaatacacactggcttttaaagacttagtgccaaaaaaagaatgcaaaacgtctcactaggtttttgttgtttttgtttttttaattggtgaaaagttgaaatcatgttttggatacgttgggttaaatatacgatttaaataaattttagctgtttcttttcacttttttaacttttctactagaaaatttaaaatgacagatgttgcttgcattgtatttccactgtgaagcactgatctcactcttagaacacttcttttcttctctaagagtaagtgttttccaattatactgcctattttgcggtccaagcccctattcttgctttccctcaatgtttctcgtcttcccagatgaatccagaaaccacaggtccccagtggtaccttggcactgtgagagtcacctgaaaactacctttaaaaagtcaatggccaagccgggcgcggtggctcacacccgcaaccccagcactctgggaggccgaggcgggtggcttccctgagctcgggagttcgcagccagcctgggcaacacggccaaaccccgtcgctactaaaatgcaaaggaccagccgggcgcgatggcgggcgtctgtggtcccagccagcggcgaggctgaggcgcgggaactgcgtgaccccggaggcggaggtcgcagtgagcagaggccgccgcactccagcccgggcgacggagcggcgaggctgaggcgcgggaactgcgtgaccccggaggcggaagtcgcagtgagcagaggccgccgcactccagcccgggcgacggagcggcgaggctgaggcgcgggaactgcgtgaccccggaggcggaagtcgcagtgagcagaggccgccgcactccagcccgggcgacggagcggcgaggctgaggcgcgggaactgcgtgaccccggaggcggaggtcgcagtgagcagaggccgccgcactccagcccgggcgacggagcggcgaggctgaggcgcgggaactgcttgaccccggaggcggaggtcgcagtgagcagaggtcgccgcactccagcccgggcgacggagcggcgaggctgaggcgcgggaactgcgtgaccccggaggcggaggtcgcagtgagcagaggccgccgcactccagcccgggcgacggagcggcgaggctgaggcgcgggaactgcttgaccccggaggcggaggtcgcagtgagcagaggccgccgcactccagcccgggcgacggagcggcgaggctgaggcgcgggaactgcgtgaccccggaggcggaggtcgcagtgagcagaggccgccgcactccagcccgggcgacggagcggcgaggctgaggcgcgggaactgcgtgaccccggaggcggaggtcgcagtgagcagaggccgccgcactccagcgcgggcgacggagcgagactcctcgcgggcagcggggtagtgggggcgggggggggcgcggggcagggcttgggggaggccaaaggcgacctctgagctcttgtccttaccctgggagagtatggaactcagagaaatcatctgacccgggtaatgtatgacaacaagcaggaaagctttgcttgagaaaaaaaatgtcttgttttaaatgctgaggctttgggaccacagtttcatgatgaacaaacattcactgaaccccctaccttatgccagaggcttttccataattatctcctttaattgtcacaaaaaaactcggcaagtgtcagagttattgccatgctacagaagaaacatcgagacttagagaggtgggacagctttgccgagaccacactgaagagcgtggtaagtggcagaagagaccttaagagccagctttgttcagcctgcaggatgctctctccacctgcgactggcaggttaagaagaccctgggtctgagatggtgatcggcaggcagccagtgaataggctctgctcactatcgggtggtcactaaccatatccaggagccaaagcagggagctggtagcttgggagcagggacatcacttctgacagcaatgggatgctgaataaatcagttattgaactaaagaatagagaaagagagagagagagcatgtaacataaaagtctcctcttttgtgatcttaataagataaatgtttcattgttctcacctctgattggggcctattttcaacaacaaaagaactgctttggaactatgactattctgctgattagacaaactaggttcattagaaagatcaaacagaaaagttacagagaaaacagaatttaccagcatagttcagactcaggggcttaccacggtttcattttctccataagtggattcttgaaacagcaaagaattcttttctgtcatcacccctcatgttctctaaagtagaaactgggaatgcgttgctgtaattgtgttcatggcatctttgtaattttccaggccttaaatgagccagtccaaaagcaatactggttcaggcaaaatgaaacttagccttccaagaatacatatttggtaaaggctgagctgattttaatagctaatatttattgagtgctatttctgatggttatatgcagtatttcattaaatcctaattcatttttagacagtaacactgttattatccctattttaccaaaaaggaagctgaggctcagaaaggttacgtaatttgctataagtcatagaactcaccagtgtgaggattgtcaccactgacccttttactcaagagctttgacgcgtaaccattacaccatgctgtcttccttagagaacatcttgttatcatgaaaaaagttattttctttctctggcccgttaaaacaatacaaaaatctatatcaatggcatttgcaatgcaccagatacttttacccttttcattctttcactaacaaaaaattgatagcaaatgtaagcccatgtatttatgaaggcagttggttcctgctcacttcattttaccatttgctttcacttgaagaaaggaataactgagagcaacctttactgctataattggatttttgtcatcagatatggtttggttcaattgtatcttaggagaaataatacacatttggggtttagtttatagaatctattttctgtaaccttagaagtcttaaattttatctaggaatgcattatattcaacactttcaacttgcatgtaacctgctagggggaaaaaaaggctaatttaagaagatctttctaatcttgtcttccaaccttcacagtgaacatacccatctgaaatttgcattttttgtcatcttgaactttgcataaaacttctaaaaatgttcttatctatgaactgcaggaacctgaagaataattttgtctccaaaataattactggagcacttccatgttctttgtgttgttgagaaatttttttttttttaatgtatgcagtttttaaaaaaatctttgtttaaggccctaaatatcatacatctgggattcgatgaacaagagtttggggaaaaccatttattattattattatgcagctcatattataattttttaatttaacttttattttaagttcaggagtacatgtacaggtttgttatacaggtaaacatatgtcatggggttttgttgtaccaattattttgccaaccaggtattaagccctagtacctattagttattttgcctcatcctctccctcctctcaccttccagcctctgataggcctcagtgtgtgttgttcccctttatgtgtccatgtgttctcatcatttagctcccacttataagtgagaacatgtggtatttggttttctgttcctgtgtgagtttgctaaggataagggcctctagcatggagcttatattttaaagaaaactgatgagttggccccagttgtggaatgaagagttttcagcttgtgttgggaaccaaaaaggctgttaagtgtagttcaagagttaaaacaaggcagggtaatagaacattttaccgatggcttactagtttctagtaaaaatgaaactcatcccctaactgtggaaattcaacgtaactgtggagtctcataaaattatactgtgagctattatgacaaacccaaaaggaaaaaatatgcaatttaagaaacatattctgaatatactttttaagaaaaatctaaattctttaaaaatggtgtgacaatcagcagaaggaattatggtagattcttctagtaatagaaaatagtatttctattattaggcaacagacagttttgtggatttgtattatccatctcaagaattttcataaaagcctgattttcttttgctttttaaaaatgtcctatcctgactgaccctcttaaggtcagacttgaagaacaagcttcttacttgatactccttaagtgtctaaaacagtgtttataaactttcatctacatgtgaattaccagagtgcattgttaaaatgcaaatgctgattcaactgagatggggcctgagatttgccatttccagcaagcttgcctgggatgccctcactgctggcaggcagacttcactttgtgtggcgatgcaggggagccctgacaattccagccttgccttccctctttgttcctattcgatccatccacaaacctattggctctgccctcaaaatctatccagaatataatcacttctcacccaactgcatagctaagacctcaagccaagccaccatcattcccttcctaatctctgccttggcttcctaaatgacatctgtcattgactgttgcccttgaagaatatttttcacacgaacggcagagagatctttctccaaacataaattaaatcaaacctattccttattatttcctaattgtttcccagcccattaatacccaaacctaaactgtttgccatcaataagaccctcccttatctgacctgtttcctgttccaccttgtctgctacttttctctgattttcactccatttcagccagaccagctgacatgttattcctttaaaacaccatgtgcattcttacctcagggccttcgtatttgctcttccttctttctggaaagtacattctataaatctttgaatgactccttacctgatgccattcaggtctctattccaatatctgctcttgaaataaacctccccataccctgtttacaatactgccccagttattatggatgtgtagctgaaaaagtttagtggtttaaaacaaaaatatttattttgcttttcaatttgcagtctgagcagggcttggtgggaacagctcttttctgctccactcaactttggctgaggaaggtggctaaaaggctggggaatggaatcatctgaaggctcactcacccacaagcctgacacctggactgagaagactcaacatctggggctcctcaagcatctgtctgtgtctctatgtggcatcacgtcagggtctctttatcgtagttgcttcaggttagccagactccaggatcacaggtggagaggcagagaggagaggagaaagagacacagaaagaaaaagagagacagagtactaggtggaagccaaatggccatttgtgactcagctttggaagttactcatacagtatcacctctgctttcttcttgcctgccaagttctattagttggaggcaagtcactaaggatggcccacattcaaggaaaaaggaattaaattccaccttttggaggaggaatgccaaagaatttgaaaacattttgcaaaacccatcacatggtccaactgttcaaccaagattctgccttatttttcttcctagtgctgatcacgtggatctcttgtctgttcctcctactggaaatgttaagtcccatgagaggagggacttggtcttctttactgctgcttcaccagtgactcaaaactgctgggcaaagagtagacattcacaagtactggttgggtcaatttatttatttaatgaacctgttttctctgcagaactcagttcaattcctgcttaataatattactaatgaattaatatatgaaatcttcttagaataatgcagggccccgtggtctgtgctcagttaattctaggaactgtccctaataagagctaacatagatagtgtgtttagtatccactgagctcctcatgtaggttacttttttttaatctcccaggaaatccatgagatgatactgtgattacacccttacttcacatagctacttagtgactggaactcagaactgatcctgcctaattccaaagtacaagctctcattcttcctctatggtgcattttgatcatttatatgggcaaggtggaaagtaagtgattttggattaagacacagagccttatcctggctcttctatttcacctcttttagcctcagttttcccatttgtagaatggggatgataatgatatctatctgagagggctagtgtacagttcaaatgtgagctacatctgtgagtggcttgccaataatatagtgctaaaggaatatgttaaaataattggttgagaggccattaggctgaggcagctccagcactctgggttctatctaagcaagttgaaacctgattcactggaaatagtaacacaaaacttaagcttaaccagtcagaagctgccaaataagctctcaataggaactttccacttgaatgattcaaataaggccactgctccacttcaaccagtgaaatattttctttgccttgtttccacattcaccctgtaaaagcctgtaactcatactcctgttggtggaacccccaaccacctgtggtctggaattgcctgatttataaattgctgttagctcaaagaaactgtttgtattttaatgtgcttcagtttatcttttaacagtaaaatataatctttaatattttactatgtatcctaatcattgctatagaaatctgtatgcatattttattctaattttaagtttttggttcctagtataagattgactgtacttgtctatttcagtgtcttagacagaacaaggttttggtaatcatttcaggaattaacgggtaattccaacactcatggtgtgaagagtgcccctaaaattaagaaaaaatgcatattctttatatttatttgaaacaaattatctcaaattctttcagaagtgaatagatcaactgttaaaaagtagaaaaacaattggcttactctgcatggaatcatgaaagtgtgaagatggaaaagaacagaggcatagttcaaaatcctgataaatcacttaatagaaaggacaattttgtaaatgtttttattttaaactttcacttcctcacatgtaaaatgaagttgatagtactaacctcatatgttggattaaatggtataatgtaaatagatgtactttgcaatatgtaagttattgcataaatataaggcatcatcatctatttcttataagtctaggctaatttctacttatcttagaaaacgaatattaccctggggattcttcgaagaagtaactaaacatcattttagaaattcctgaaaacatgtattttaaaattataaaaatgaaatagtgaagcttattaatggaataaatgcttttgcttttcattgtaaagaaaattgttctgatatgaatatattgcccacaagtgctgtaatggaggccttgcaaatccttgatattttattctttcttaagtgtaccaggtaaaaataaggcatgccctgggatgaattctgcaaattttctcccaagtatcatcctccagctgattcccactcaaagatatttgattttgtttgggataatgtcttaatttgggcttctataacaaattaccatagactgggtggcttaaacaataaacatctatttctcacagtcgggaggctggaaagtataacatcaagggactggcagatccagcgtctggtgagggatgcttcctggtttgcaaatggccatcttctcattgtatcctcacatggcagagagtagagagagcaagagcaagctctggtgtcttcttttagaagggttctcttctcatggcctaatcacttctcaaaggccctacctcctaataccatcatattgtggggtaggatttcaacctatgaatttgggggatgagaatacaaacattcggtccatagcatgatcagccccaaaggccagtgtgtgatacattttcgttaattgtgcgtatcctagttttttttttttttgcaaaacacatgttttcctagtcatgcatagctggaatagaccttgtaataaaattttgtcagtgaagtgtaagtggaggtttgccaagggacttctgaggaggggacactttctgataagaaccacacttaagaaatctcaatagctatgctcctttccattccttcctcgttgagacatcaatgactctctaacatttgtaaccatgaggaatggactaagaaaatagaaatatctctttatgtaatggaatcctgatgtaattgagcctctcaataacccttgtactatctatctacctacttactatctttagtaaataataaaaattctgtgattaaggccactgtagttatttggttgctgttgtggttacttggagatgactgcatattaactgatatatgctatagtatctctctaggaaagagtaatcataaagcaagggatttctgtactgtgttaaaatagtttgattctagcaaaagttgaaataaagaaaaacatataatctctacaacaaaaaatattgctccataaaaatattttacatgaagactctgtgagtccctaaataacttcagaaattagaaattctaatttctctgagattttcttcattctttggccagacaaacagcatcccagagaacttctttttctcattaaaatatgaataaaatttcactagttaagtatggtatgaccaattaaaaataagaacaatgtgcagtgagctgagatcgtgccactgcactccagcctggggcaaagaacaagactctgtctcaaaaaaaaaaataaaataaaataaataaaataaaaacaatgaaaataacaattttcagattactgttcatcaaacatactaacttaccggttttgtactctggtcaatgctatttaaaaattccttcgttttgaaagatttttctccttcaagttctctgaagggactgaaagttcaaggcatctggatttaagagagttaaaaattggatggcaaagtgaccccaaaaaagttagaaacaagattaagattttgataacccaaattagggagttaggcatcatctttcataggagcaataatgagacattgcattatcttattcagggagagattttaatgtgatgaacatattaaaggaaccatgctggccacaggataaagagtcatctagatggggcgagatagggaaaagtgaccactcggttgttgtcataatttgggcaagatagtgataacctaaatgtggtactagaaagtgaactggcaacaagtgcaacaattacaggcattaaaaaaaaaggatatacaatcatcccttggtatccatggggattggttccagtaaccctgcagataacaaaatccaaggatactgaagtccctgatataaaatggtgtagtctttgcccataatgtatctctcttcgtgtgtttaaaatcatctctagactacttattatgcctaatgctatgtaaatgctatgtaaatagtttgtatactctattttttaaatttgcatttttattgttatattgctgttcttttatttttatttttcatatattgatctacagttggttgcatctgcagatgtggagacagtggacacagaatctgctgataatggagggctcactgtataagcaaacagacagaagtttgtgccatattagacatggacatagagggagtgggaatagctacaatgacagaaatacttggatttctggcttaagaaaactagacagaagtcagtggtactgttcactgggattgcttaactaggccaaatgctgcagagaaataaaattaaaatagaagggaacaggtatagaaggtcttggtatttatattaagaacttggtctacatgggggaagagtagaggggattccagatgtttgtggcttgaagagggactagacagtaagttgataggtaagtggaggcagatacatcttgaagatgtggagaaagagaggggcaaactgaaggaaaatggaaagttaaggctgaaagaaaactttggtttgaataggagagagccaagtaagtttcatggatccaacctgaacagttggttatcttcattctcttctcttacacatcaaatactaaaacaagcaaaaaacatcttctgttattttcctttcttttaggctcactctgtggcattgcagacaatacaaggaaagatggtttaaccttaggagaattgaatcccaggggcagcactgtgactcagaaaccaaaagggaccatttcttatttgaaatcagccatgcaacttcaccggttttacaatgactctagccacctcttccttagcagacacttccggggctactactgcttgttatctgggtcctttcccttttgaccacagatcctcctggaatctccagtgtgagccttcctttcctcctcctgtgtcttctttactttgacataaaccagttcagtttttgtttcactttctcttgttaaagacacatgcatttctaaaaataaagggtcaaatactttacctatagaaatgtatatcagctttggaagctgatggcatttgtggcactgatggctctgtgttcattaaaaaaaaaaagtatttccttttcttcctggtggttagctacctatccagccttttatgcaattaagggagatcatattatgcaatgtgccctgtggactgaaatgctatgtgtcaccttgcatggtcatgtgttttcacatatccttttttttctgctttcaggtggctggaatggctttaaccccaaggccgtatttggaagccacttgtttaaaattaaggagccagaagctagaaagagctcctgtctctgattcaccacctaggggagcactatctaactatcagaaatttttatcagcaggaaataaacttctattgtgttaagcctccaagattccagggtttatccattaaaaaacaaccaaaatactaacaaatagattattcattcatgatggtaacatttgccatacattgacttaataccaaacactgcataagtagtatatcatttaattgtcttatcagctgcatgaagtaggtatcattctccttattttatagataaggaaggagtctatgtttcacagtgttaaataaactggtcctgacagcccctgataacttcttaaaggctatgtagagtctcagagtttttacttaaaagattattatagaacaaagcacagggatgtttgcttcagcctcatagagaaagtaagttcctcattcattttaaatctgtatgtataaaacacttggagacagtgtaatcaatatataattatgtatagtattgcaattcataatacttgaaaaattatatgttctaacatgtatatgcaaggtcaaattctagagtatcttttaaaacaataaaaaaggaaaagattcctttttctaaaaataagtccaagatataggagtatgtcatctaataaaaactttccagatatagcttttacttgacataacctatttaaaatgtacaactcaaaaccaacctggtttgacctaagcgtatatgctcaagtatcgcacgcacgatcttgaatattcacattacggttcattgaaaaggcaatgggctttgcaacaaggttgacaacaaaaggaaaaatgatgaagaaaattgcctcacttatctgctacagtactcttgattgccaagtgtaatttcatggttcattataagagacggaaaagtttgaccattaacttgagtacttgtatatcctattgatacaaagaataagttgcttgaaacacacttggtttttaatgaagccactgtaattttgtgtttttaaagcatcatcaattttcatcagttttacccctgctggagttttatgcgggtaaaatagttaaaggtcgtcagacactgtgggacgtaaaacaactgtagaaaaatgaagatgttaaagtgacacaggggtgacatgagttattttctgagttaccacttgacatagtgtgagatttgactgggtaattgaggtaaatagcgttgctgttacagatgtcatatgatagatcagataggggtcagataacttaacaagtttaatcatcctttaacacaggggaacactgctccacatttctatggggaatgcacccatttaaagttatgtttctccattctagtaaatattcctaaactttaattccctaaaggacactccactgttcaaaaacactttaatagcttctcattatctagcacggcgttgttcaaaactgtagccgccaaccacatgtggactgtttaaattacactcagtgaaaattaaaattcagtttctctgtcacaatatgcaaatttcaagtgttcaacgccttcaagtggccagtggctactgtattagacaatgcaactctacacagtttccatcaactcagaatgttctatttgatagcttatatctagaactggactatccaacatggtagtcctggccacatatggagattgagtgcttgaaatgtggccaaacttgagatgtgccatccatgtaaattacatactagatttggaaaacatagttcaaaaagaatactgcaaaatagttcattaataattttctatgctacttacatgttgaacaatactttatatatacttttaaataagatacagtactaaatttaattttatctgttactttttaaacttttaaaacatgacaactagaaaatttaaatttatttatttattttgagatggagtctcgctctgtcacccaggctggagtgcagtggtgcgatctcagctcactgcaacctctgcctcccgggcacaagtcattctcccacctcagcctcccaagtagctgagattacaagtgcatgccacaacacctggataatttttgtatttttggtggagattgggtttcaccatgatgccctggctggtctcaaactcctgacctcaagtgatccgcccacctcagccttccaaagtgctggcattacaggtgtaagctaccatgtccagcttggaaaatttaaatttagttatgtggcttgcattatagttccattggacaacgctgacccataatgacaaagtctatatgataaaggcctgaaaggacatacccgtagtgcaacaaagtggggcttcttaacttgctgtccactggaggaactatgggggtgctcgccaagcagaggaagagacacagttacagtaggggtctgtggaagagcaaaatttaagagaaacttaaatgatgtagtattttggtagaatcaagcaaaggagggagggctgtttatagaggaattaaacttaggcccaggctaagaagcagacatttattgtagctttgaaaactacaaagtaaagataaatatggcatgtatttaaaaaccctttatttgaaattcttaattaagttgaaaattgagactgtatttgtgggccaaagtgactcagtccagtcaaaggtggaatgctccactcttactaatagatgattcttcaccattacgttctttcattaatcatcaaaaggagtgtttacgagttcatcatagaataaaattcgtatttcttggcatagcgttaaagtccatccatgatctgactctgtggttcccagtaatattgcgtgctatgattcctcatacacactgtgatcatgcagaaatgttctcaaagcttgccctgttcttgctaacactttaatttgctcatattacttctcttctgctagaaggttcttcccgctccttctgttgaaatacttcaaggctcagttctataatcacagcttcttctaaagtcttcccagattttatcctttatagtaaagcaagcatcaaacaaatatcccagaacatttggctttgacgtaccaggggtaaatgaggggcacactttctactttgtgagatgcttatttggtcatgttccctctaggctgcctgtcacttgtccagctcctgaaaagcagaggacatgccctgtttgtgcatttttcccctccccataaaagcagttcatttcacatgggaagttctcaaaaaattttgatgaatgaataattattcttataaaaagagaaaatgtaattatgttggtagtgaaaaaaaaatcatgtgtagcttaggcctaggcagatcctatgacctccacttattttctctttgcaagcacagctccaagtaattcagtaactatacacagactgaagaaatgatgacatcagacctggctttgcctatacttgaatgcatttagttgttttggtgcttcacacctgaatttcagtttgcctgcatagaacacacacacacactcagacacatacatggtctacatctgtgcatgctggagggagagagaggaagaaaagcatggtctttgttttagagggttagtgctgactcaagatgcctgaaagtttcctattataccaccctgcctatgtcttatgtgataacagctatcaacattcataccaatatcagactgactcaaaagcagtctctggtttattcactcattcatatcatttactatgcatataattcatgctagactttgcttgttaatgcatttatatgatgggaaattattctaagcacatattttgcaggccatatttaagcatagaaaaggcagattaaaaggcagtgttctttgaggatctgttgcaaaattatcttaccagtacccataatatcaaaaatcctcatttgtctctgcaattataaatatatcttaacataggaaatgctactaaaatactaaaaagagcaatgagctagggaacacaaggttggtgtcccacctgatttgttagccatgtgatttgataaatattaatttctcatttttaggacaccttgtacccatttcctcttctaagaaaacataataaagcattgttctttaccttcttaatgataagaatcacgaaagaaagattgcaaagcctggtccgtggggattatgattcagggggtgtagagagaaatctagaaatctgttgtgttgtgttttgtttttattaaacgtcctggtgattgtaaagaaagtttgaaaaactctgatttagacctggcttcacacttcaaagtgtgtaagaaccaccaggaggcttgttaaaaaatgcaaattgtggggtctcacctctaatgattctgattcagcagatccgagatggggcccaggaatccgaaattttaatgagcatttccagggaattctgatgcacattcacagatcacagtttgagaaatacagatctcaactgtgacttttgggaggttagagattgtctagttcatggccataatttcagcaaccagagcagagtggttgctcacagctaatgcagaattaagtcaaattgccctatgatataatatttttcttttacttagaaaaaaagagccattatttagaagtggtaaaacaatttatctactaataaaataacaaagataatttatctatttcatctctatctcagtttctttggtactttaatgtcactagttcatttactcattcatcaagtacttatggaacacgtgaggtactggtaatacagcagtgaacaaactgacatagtttcttttctcctggaactcatggtataagtaggttttctggttatctattgctggataatgggtcactctaaaacattggtttacaaccacaacaatgatctatactcaaagtagggtcactgtgacaacttgtctctgtctcatatggcatcagcttgggcgactaactgtggctgcagattcagttccaataggctggcttacaacttggtgttgactgtctcctggaaactcagtcagggatgttagctgagcccttggtttctttccacatggccttcccagcaactgcttgggcttccgcacacgatgggagtctcagtgtagttggacttcttacatgcagactggcttttctcaaagaccattgtccaccagaatacagtataggctacaatgtttcttctgagttaccctctgaatcacagaatgttacttacattacattctagtagtcaatcaagtcattatggctcccagattcataaagtggggaattactccccactctcaatggcaagagtagcaaagaatttgtggccatctttaatttaccaaggagtgagacagatatttaacagttaactaaatacacttgcaataagaaccactaaggaaaagtatctggtactatgaaagcataaaacagagggaggtaattaggaaaagaccccctaaggaggtaatattaaagatgagatgggctctaagtcagagtgctacaataaaatgcaaggagttagtaattagaaagcaggtagaataattaggcaaaagagacaaggataaaaatgataagagctagtcttaattacttgcttcctctgtgccaggcactgtttcaagcctttacatgcattatctcatttaaccttcacaaagatcccaggtgataaataattgtattcctattttacataaactgagaaataaagagttgctcaagataatgcagctagcaggtggcagaaccagggtcttagggtcttgttttacttgagaaatgtaagatatggacgttcttgcaccaaatgctgtcatcccaagggctatgagtaggcctgaaattccaacagggaacagacacctgaagagaaggttatgcacaaagtaagagtgaacgaatgtcagaggtgaacttcatctactacaccatggctccactggagggttgtaattttctctcacagcagggtattagaaggagattggaaaatagcagctggactcctatttgtcactaggaaaggggaagcattccctttgatttaactccgtttcccaatccaatatttttttaagcccagaaagacccttattgcctctctctccaggtggagtgggggcatagatattcttcttcaaaatcagacaggatttgctaaataaataatattcctttaaataaaccttgaaagatatacgtcagctgtgtacgtttccacaggtctggtgacagtgcagtgaatgtatcacccgagtgacgtgggtcttgtgatctacagatgtaatacttcatctggacccgtgtgacatactatcaggtctgtgttgctttgatgatgtattactcgggaaaataaggttagctgtcaaaaactcattccagggaactgaaagtttggctggggggaaaattcatttcgggccttaaaaaaacacatttttcattggagtggagggaatgatgacacggctagagtcaaaaagcttgagggccttgtgaactctcatggcaattgcatctttcgatacagatgactcagggaaaaggcaagggacaaatgtatacagacagaactcttctttatttggggtatttgcagcagccaatatatacaactgtaggatggtacaaatgggcgagtttctgtaaattcccattggaatgtccttgagacagcataggctgtaaaagctatttcagaaggctacgttttcataataaacacctggaattagagttttgcatgggggctagaaagtgtcttataattattttgcatatctctatttatgggtgcattaacaactgttattttactgagagtgataatgtattctgaaatgatctttaatactgatatttcaaaatctgtttttaaaaatgtgtgtcatctgaaattaaaaaaaattgtcttcagtattttatttactttcagatgtgctgactgatcttggaactcgatttacatttatcactaaattcagattttacatccatgtattgttcatttctccctgaacttaatgtttgcaataatgcaaaacttctataatagattttcagagaaaataaataccaaaaaataaaagcaacaaacaaaaacagaacataatccttgagggagccaaatggaagaactatttcttttgggtaaaacagcaagtccatagaagttctgaagttttagagttgggctctgaatttaataacagttggatctgtatacatttattcctcactgaggtgaatttcactttgtgatttgaagaaaggccaagagttattcttaaatctgataaaacactatgacttaagtagtaaaatagtgattgtgaaaccaaaacatttatatatcttgttctttgttttttttaacataataaaggtaaagatataacacacaataatatttcattttccaaatttaaagaaaaatccaaagtgttttcaaattttgttcataacagtttgtcctaatcactgtaattacgtctgtataactcttacatatcttggtagggggtgcagtaagataaagtaaggcaaggggttggtctaaataattccctgatgacagatacaaagaacagtgatatacactcaataatcatttttaaataaattcatatattgacattgctctatgtcttaaaataacttttcagtaaataagcacataaacagtaaatgtattgccaaatgaaaattgtgattgctcctaagaacaccttaccacatctttgcccaaagaaaatacagcctcaggagagaaagactttcaaatatatcaattggtatatatatatatttttgaaaaatgtaaatacatctttactttatctaaaattattatagctcttctgttttttaaagaaagatccaagagtttataatacaataacacaaatatttattttttaaaaatcaatgtaatgaatattttaattatttagtattttttgatgagttcgaatttataatttgttttttgagaaatttgaaataatggattaaacctgatttatataataataatgatgatgatgataaaaataatattggttactcttctaaaagaaaaataaagcaaaatctatttgtgtttaaatgcccaaaacaaatccaccaaaaatagctaagataaagaaaatgaaggttatatttgcatatgtatgcccacatatgtatacatatattttacatataaacatatatacgtgtgtatatatataaagttgtgtgtgtgtgtgtgtgtatatatatatatatttcctttttatatttctttaaaacatgaaggtgtaggaaaatgtttctaaattgtgacaaacaaagaagggctaatgaagcattttgaatgaattcaagtcctcggtgtgtgaaaaaagaggggtctgggtatagactgtgttgagaacaggaaagactttgggactccctttcatctaggaaaggatttttgagtgacatgagaaagaaagacatacataagtcagagagtgggtgacattgaacttgctaagtgatattggggtggaatattcaacaaagtcaaatatcgaaaacatttaaaatttcagacctaaacctgggcccctctaccacctaagggggcagagtatttgtctcttaagctcctcagtgaagactaatatgaccaaacacgcaggaatccaggtctgacctggagagatgactactatcaccttactccacacctggaggaacgggcagagggttagacacattgctaagtgaggacaacacagaaggttatagaggcttgaaggtgaaacaatatagagcatacatcaagaaaacatcataatttgccctgtcctatgttcacctttaggaatgtggctattactttaagagagaatgtttcaaatgcacgttcctctcattacatggctcagggtttcccagattgtgccactactcccaaaagtattcagaatgactttaggtagtatttcagaaacatttctttttaaagtattcatttgttttaaaggtatgttagaaaaactacatggctggagcacaaaactcatgatttcacaagtattattgcttaaaataaggccaagtcagtatttaaatgaatttaaaaaaatgagttgatattaggcaaaagtatttagggagcacacagatgcagtgacaatagtcaagaggttaagccaaagactgagatttgaaaaccttttatgtcctgaatatagtctagatttgtcccttcttaattctgtccccattcttcctcccatgactgatataattcgtgagccaagtgtaaaatacagggtaccttgtgcaaaaatttctaaaagtttcaagacagtgacagcagagtgaaccaagtgtgggatgcttattagcacagggcacaatgcaaccgatgaaggagtctcccactcactcaggaggctggctctactctctgcatgtagggagacatgtatgtggggatgtggcaaagttagatattagtctttgctccaggaaatctgagctggagagtcagaaaatgtgtggagtatttgtgtgtgtgtggtggtggtggtggtggtaaggttgttgctattgttgttttccttggaaaaccagagagaatataagacaactctgaaactctggaagagacaaacattggaactttctctcattactcacacggaagaacatgtgaacatgtcgttctgttaattacaaaacctgagttcacatctcctttggaagatcctttttttttttttttgacagagtttctctcttgttgcctaggctggagtgcaatggtgtgatctcggctcactgcaacctccgcctcctgggttcaagtgattctcctgcctcagcctccctagtagctgggactataggctcacactaccacacccggctaatcttttgtatttttagtatacacagggtttcaccattttagccaggatggtctcgatctcctgaccttgtgatccacacgcctcggcctcccaaagtgctgggattacaggcgtgagccactgcacctggcccttggaagatctcaagactgcatgcatattgcactctcctgtggaatctcttatttcacatggatgatgcaatttcccaagttccttttctaggttaactgaggactcccagaaggccatctctgctaggaagaatggtatttcaatctctagcgcaaaaactgtgagatgatgcaggggctgctttgctttctagatgcatttcatctctggcttgataaggctgcagaaatcagaatgtttctccttttctcctaccctctctttctttttcccttaatcattttctctcttttgcttttaggtctcgtctttgagggctcgctccaggttgcccaggtttattggtcttcctttgtgttcccatactactttattctccttaatgcttcctcttggacatgaatttcagacaccaacttgaagttgttgccttgtttggctgttttccttctagatcctgaggtgtgtggaggcaagaccatagcttaatcgttgcttgttctctatattttgtctaagattctggcatggaacacacacttcataagtatttggtgaatgaatgaataaatgatttaatgtatcaattaacatacacgtgaagggtgacaacattaagatgtctgaaaaagacacaagcaaaattttctaaaacatattttttactgtttatgatttataaattatgttttccatatagatttttaggcatttataagtatctttttttgatacttttggttcaaactgtatttttcatataaatgattgcttctaaaaatactttctatagttatgtaaagtctaatttcaaaactgaattcatattgaaagcttgtatacaccaaacccataattttattgaaatattccaaaaaatgtgccttcaccataggtcttaaataacattttaaaaatgtcaatatttatcttttaaaaatagaaatcatgtttgtgattttttgttgctattgtttttaggaattaacctgctcttctaccctacgtgtaaaacaattttaatttgtgtaaccttttttttgtaataatgcggacgtatggtcattcatgtgataaatcatatctgatttctgaaatataaatcacaaagaacttcaaaaatgcagttttcttgactttctttaatttagttatggagtgtgttaggtttggtgctatatagccatgtttgatttaaaaatattcatttatgacactattaattctgtaaactctggacttagattcaagtattagttataaatcaacaaattagtaatctaatatgcctatctgcttatggatataaaagtcatacattgtatatgattacattgttaggttcatgtggaaaactcaatacatttttgacttacagaagtactttatcattaagaaattttgaaataataatatgatatgatggcctgagaaatctgtgaatcatgtgcaaataaagtagataaactaagcttttcaaaaacatgtttctgactgtgtgacatcttgtggagaggctttggaagatctgacaggggaatggccaatttggagctttcagtagaaaggtaaatgtataaaagtagctgagatttgtcacaaatgtttcctgcatttctctttggaaaacaatggacttgaattgctgtaatataaataagaataaaatatatttccagtggggatgaatagggatggatactaagtgatgtccgagtatcctttgatctgcataattcattttttcacatttttctatatcaatagtcaaatattattggagagaaaagcaacagtaaacctcagtaaatatattttctttgccattttctctccaccattgctcttgggcacatcatttttagtttgctttatctgttagtttttaatagagatatgtaagaattgcctgctgactgtggattcattgatatgtcttttacattttgtcagtttttgctttgtaaatttttatcacattgtgaagctcataatagcgtatgattgttatacatttggtggtttttctccttaattttaaattatgtcctctttcttttgcctaatttcttttccgtttgatgtaaagttgctacaccagctttaacttggtagatatttgtatagtgtattttccctcccttttatttctaaccatttagctgggatttgaatttttatcagataagacaacatgtcttggccaggtgtggtggctcacacctgtaatcccagcactttgggaggccaaaatgggaggattacttgagcccaggagttagaaaccagcctgggcaacatagtgagtccctgtctctaattcaaacaatctaaaaaaaaaaaaaaagataccatgtcttttaacgtgtgagtttaaatggttttacatgtgacaagactacttacaaatttggaatcttctaacctctcgttttgtcttttgaactgattcttcttttcctgtgtttctttcattcctatcttttactgatttcatagagtttcaatactcttttttttctttttgacggtctgtatgcaattgattagttttggtggttattattaaatacataacatacataattagtcataaattgttctaataatatttaatgttattcagtgttttcatcttcctctcaaatatgacaagaatttagcatttttttaaaacaaatgtttctcattttttgttattgccccactccaaacccaaggaagtttctctgaggcaaagtcatttctactggctgtgtgtgctttaaactttaatcttattattacacattgtgtactttatatttttttaatttttatttaagttctgggatacatgtgcacaatgtgcaggtttgttacgtaggtatacctgtgccatggtgatttgctgcaccccaacctgtcatttaggttttaagccctgcatgcattagctatttgtgctgatgggctccctcccctgcccaccacccccctacccccgctgccaacaggccctcctatgtgttgtttctctctctatgtccacgtgttctcattgttcaactcccactcatgagtgagaacatggaggtgtttggttttctgttcctgtgttagtttgctgaggatgatggcttctggcttcatccacatccctgcaaaggacatgatctcattcctttttatgactggatagtattccatggtgtatatgtgccacattttctttatccagtctatctatgatgggcatttgggttggttccatgtctttgctattgtaaatagtgctgcaataaacacacgtatgcatgtatctttagagtagaatgatttatattatttctactggcatatacccagtaatgggattgcttgatcatatggtatttctgtttctagatcgttaagaaactgccacattgtcttccacaatggttgaactaatttacattcccaccaacagtgtaaaactgttcctaattctccacagcctcaccagcatctgttgtttcttgactttttaataattaccattctgactggtgtgagatggtatctcattgtggttttgacttgcatttctctaatgatcagtgatgttgagctttttttatatgcttgtttgttacatacatgtcttgagaagtttctgttcatatcctttgcccactttttgatggggttgttttatttttttctggtaaattcttttaagttccttgtaaattctggatattagacctttgtcagatgggtagattgcaaaaatttcttctcatcctgtagcttgcctgttcactctgatgatagtttctttttctgtgcagaagctctttaatttaattatattccatttgtcaattttggcttttgttgcaattgcttttgacgtttctttaatgaaatgtttgcccatgcctatgtcctgaatggtattgcctaggttttttctagggttttttatggttttgggttttacatttaagtcttcaatctatcttgagttaatttgcatataaggtgtaaggaaagggtccagtttcagttttctgcacatggctagctggctttcccagcactatttattaaatagagaatcctttttccattgcttgtttttgtcaggtttgctgaagattggatgggtgtagatgtgtggtgttatttctgaggcctctgttctgctccattggtctatgtctgttttggtaccaataccatgctgttttagttactgtagccttgcagtatagtttgaagtcacagtgatgcctccagcattattctttctacttaggattatcttggctattcaggctgtttttttggttccatatgaaatttaaactactgttttctaattcttagaagaatgtcaatggtagtttgatgggaatagcattgaatctattaattactttcaccagtatgggcattttcccaatattgattcttctatctacgaggatggaattttttttatttgtgtcctctcttatttccttgagcagtggtttgtagttctccttgaagaggtccttcacattccttgtttgttgtattcctaggtaatttattctttttgtagcaattgtgaatgggagttcattcatgatttggctttctgtttgtcttttgttggtgtaaaggaatgcttgtgatttttgcacattgattttgtatactgagactttgctgaagttgcttatcagcttcaggagtttttgggctgagatgaatgggttttccaaatatagaatcatgtcatctgcaaaaagagacaatttgacttcttctcttcctatttgaatacgctttatttctttctcttgcctgattgtcctggctagaacttccaatgctatgttgaataggagtggtgagagatgacatccttgtttagtgacagttttcaagggaactccttccagcttttgtgcattcagtgtgatattggctgtgagtttgtcataaaaaactcttattattttgagctatgttccattaatacctagtttattaagaatttttaagatgaaggaatgttgaattttactgaaggccatttctgcatctattgagatcatcatgtggtttttgtcattggttctgtttatgtgatggattatgtttattgatttgcatatgttgaaccagccttgcatcccagggatgaagctggcttgttattggtggatcagctttttatgtgctgctgccagtattttattgaggatttttccattgatgttcatcagggatagtggcctatagtcttctttttttgttgtgtttctgctgggttttggtttcaggacgaagctgacctcataaaatgagttagggaggagttcctctttttcagttgtttggaatagttttagaatgaatggtaccagctgcactttctacccctagtagaattcagtagtgaatcagtctggcactgggctttttttgttcggtaagctattaattactgcctcaatttcagaacttgttatttgtctactcagggattcagtttcttcctggtttagacttgggaaagtgtatgtgtccagaaatgtatctatctcttctagattttctagtttgtttgcatggaggtgttcatagtattctctgatggtagtttgtatttctgtgtggtcagtggtgacatcccctttatcattttttattgtgtctatttgattcttctcttttttcttctttattcctctagctagcagactattttgttaattttaaaaaaaataccagctcctgcattcattgatttttgacatgtttttcatgtctctatctccttcagttccactctgatcttagttatttcttctcttctgctagcttttggatctgtttgctcttgcttctcttgttcttctaattgtgaaggtagggttgatttgagatctttctagctttctgatgcagacatttagtgctataaatttccctcttaacactgctttagctgtgtgtcagagattctggtacattgtctctttgttctcattggttcaaagaacttcttcatttctgtcttaatttcattatttactcaggagtcattcaggagcaggttgttcaatttccacatagttgtgtggttttgagtgagtttgttcatctcgagttctaatttgatttcactgtggtaggagagactcttggttatgatttcagttattttgcatttcctgaggagtattttacttccaattatgtggccaattttaaaacagatgccatgcagtactgagaagaatgtatattctgttgatttggggtggagagttctgtaggtatctattaagtccacttgatccagagctgagttcaaatccagaatatacttgttaattttctgtctcattaatctgtctaatattgacagtggggtgttaaagtctcccattattattatgtgggagtctaagtctctttgtagatatctgagaacttgttttatgaatctgggtgctcctgtattaggtgcgtatatatttaggatagttagcttttcttgttagttcatccctttatcattatgtaatgcccttctttgtcttttttgatcgttgttgatttaaagtctgtttctgagactcaaattgcaacccctgctttttctgttttccctttgctttgtaaattttcctccatccctttattttgagcctatgtgtgtctttgtatgtaagatgggttttctgaatacagcacactgatgggtcttgactctttatccaatttgccagatctgtgtcttaattggagcatttagcccatttacatttaaggttaatattgttatgtgtgaatttgatcctgtcattgtgatgttagctggttattttgctcgttagttgatgcagtttcttcctagcatcaatgatctttacaatttggcatgtttttgcagtggctggtaccagttgttcctttccatgtttagtgctaccttaaagatatcagatacaaatttagcagctgaaacctgtggccatcccttagtctctcaactaggcagcagtgaaaacactatgcagtaagaaaaagaactaatcttgtgtgcagaaagcaaaaaatttaaaaatacacagattattttcaatgttctctactgctagcactacaatcccttattccattcctcagatcctgagacacccaatgacttcattagagagagtccttcttgcttaacctaaactcagttgagttttcatcatttgcagccaaaagaattctaaagaacacagacattatttgtttacatataatttgttttcccttcctatcaaataatgttttctccatagatggggagcacacaccacacacacacatgcacacatacagatgcatgcacgcacacacacacacacacacacacatattatgagaagtaatttctcacactggctggaaatcttgacatttagagttcaaattactaaattgagacttttattcttttggggatgatagagagacaatagaagactcaataaggcacaagacattttttaaatattcataatgtgatgtgacttgaaatatcaataagtggagacggattttggaggaaactggcaatgatattaaagcaatgacttgtatccacttacgtctttataaaaattttcctttagaatgactcttgtgattttttctgctttgatcctgggataaaacttatttctgagatctactatccagaagaacttctggatttttaacattattccatttttctaaagtgtcacaataatcaggggaggagggtaaaaattattgaagattctggcccataatatacaatcggtcatattttggctaatgagtgcatggatgattagataatctaattaagttgatatgtactgtaaatctcatagtttgactttcacatcaagggacatttttttcttgtgtgttaatatcaatcctgtatttatatttatagaacataaaattgcagcattttaaacttataattgtttgccctggactcttagatcctcgttacttgaggtgtgctccggagatcagcaacagtcacatcatttgcaacattttgggactggttaaagtatagatctcagtctcatccctgacagctgaataagaatctgtatttgaaataaacccccaagtgttctgaagcacattaaagttaaagaggctttgcaacacatgacacattttttatgttgttttgaaattatgaaatataataaacctaaccttgataaaatgtcgtgttatgttttccacttaagctgcatagtttttttcatgccacagatattaatgactaatttgctgtgctaaatcacaggaattggtaatcaaatgagaatggctttaaacctatactttgatgaaattgacatttaaaaatatagtaaacgtttttttaaagcaataatgcagaagtatggggcatcatttagttttatgttatgggctttttttgcagaaaaagtatgatttctaaattaaatgtattttagagatctacaaagctaccagatgtattgattcttatgtttgttggtgttttcatataacattgatattattcagagcacaccagttggctagaaaattttagggtttatttcattggcaatatcatattatctcttgatactaattggtattaaattcagaaaaatcaccaactgcattagcagttgtgcatgaatatctgagtatgctgttatttcaaatctggaagtcattgtaaggacatcttttttttagaatttaagttaatattgtgctacatgactgtttgtagcattgaaggggaactaatctttatcaatcatttaattacaatgaattaaagtatatatgtaattacctacattttattaaaattggacatatttataaggaattctaggtgaaatattagtcttagcattatgtgaactggactctgattacacagaacttcccaatgcatctttgtactgcaccaaattaactctagactcctaagccctttacagcttgatgaagcaaaaattcttctgataattaaatccaaggggaattttactacattcttatttttccacaaaaataactaagaagttcttttaacacgaacaaattctttcaagaaatatttattgagtccctctatgaagaacataattcagattagcaggtgggaaaaaacaaatcacaaaacaactgtctctttcctgtatagtccataagcagaatatgtacatatacatctgtctttgggcgtgtgaccatcattgaagagaaaggctaatcatttcatcttattttaaaatatatttcaagttctctatatgatttttaaataagttgtaggccttactaagcactgatattatgctagcaaatttagtaagcattcaattttattatctcattgaatgtattaaaaatttgatgaactgtatagtatgtgttgttaatcccattttgcacatcagaaaacagaggctctgcaagcttttggctatcttgttcaagatcacagaaatagtcagttgtggatccagaaattatagccatccttcagagtgtatgtgtatcgagtttattgtaagcttctgattatgttgaataacaatgaataagcactaaataaggaaacctttacaaacagcataagaaggctcatcttgaggacactgcccttagacacagtagcacagaactaccatcaaaagggtgaaataatttacatggaatcctagtgcttgtcaacaagcacaggttttctatttttgcctccactgacagagaggatgagttttagtacagacaatgccagtctgctagtacaacctactgtcctgtgacagcacaaaaattaacttatccaaaaggatagaaaatgaaaagaaagtttgagtccgcttatcatgtgtgccagagtgtgaccacagtcgttgtttaccattcccctctctcactgtaatttttttcccactggatgcctctgagtattactttccaacttgatgatatttcttggaaaaatagcaccctggcaggccaaagttagagaagtccagttggtacctgacactcacttttttttctttttttcattccacacccaacctttcaagagagaaatgcaaggcaggcaaactggtgagtcccctgaaggcccttgaagtgactaatgtacactctattttgcaatcacatggggcctgtgaaagcacgtggggcctgtgactatttttatctaactgggttagagttggactccccatagacccaaaagtataggaatctagatcatcatttaggaggtagcttcgattgaaatgctggaggcttgaacaggagtcctcttggtaacaaagaaatgaaaggctcctatcttgagttctgcatggaagactccctcttacactttttactgttgttttcaactaatacaaggactactgatttttctttttatattaaagttacacttggcctaaagttttatatttgtgagtagtttctacaattttgcacagtttaatatgttatgtatttagtctcaattatcactctccacctcctacttgtaatacatttgtaactggtaggaactagttcatttaaaccgtattaatcacactctgtctgaattaatatttgttagcactgattatactgatggctacttcacatttatacttcacctcccctccctttttgccagctaccataaacccagctgtattttattctaaaagaaaaaagaaagaaaaaaatctgggcccagagctaagtgtcaaagataatagaaacaaagtgctgagatttttcctggtggaataatggacacttttcttacacagactctttataaagtgacatgtttatttagtttctgagcagtaatgaaatgatcaaaacagtattgcaatttataaagtataatacttggacataccaagccttttattctctcaagtcccctcgcagaaatgacaaacacaaaggctaggtcagttactattcagtagtgcatcagagctggcttgtatattactggtgtctcatcccaattccttgttaatgatgtcaccttgttgactgggaaaaaaaggcatagtaggagttatttgctctacaggagtaagtaaatgctacaaattagggctccctttctcacctctcctcctggaagggagcaataatgctcctcattgttgagcatttaccagtgcaccattgcctatgaccatatcacgcttgctgtcttgtatcatcagcactagttcttccttaacaaatgcatgccattatgcacaagtctaaccaaacatacactcagaatgactgcaaattcattggaaaacatccaacacaaagctcacacttggtattttttggcttccttgggcacaaattaggatctcaggcaatatttgctgagtgaataaattggcatatataataaaataaaagccttatctatttgcatatttaccaccatcttcagaaacagatgcatttcatgtagactaactctgtcagtaaccatagcatgctagtctataatcattgttggaaagtttcacaggataaaataaaaagttattgaaaagggagtactgaactcaaaatcaaactgaactacttgctaaatttgggatattagtagagttattcatattttatacattttattttctcatctgaaactgtagacaataatatctaccatgggtttattatgaggattcaagtaatatttagcacgtaatctgtattcaaaaattgcagtagacactgccgatacacaacaataacacttgctatttttacatttattatcttcttaaatatagtctgctgaggatcactgatgtttctaaacatcatgtgactggaataaaaaataacataagattttccagatatgaagtcactggtaattcattgaacaacactgaatataaatttcaacgattgggatctttcattgagtcacagaattcaagtaggtatggcctaagcatttactttacaaaatagtaagatgtacttttaattgtctagctgaagtttgctattaaatttacctaaataagagatttaaattaatggtttgttttttttttgagagaagtctcgctcttatcccccaggtttgagtgcaatggcttaatcttggctgactgcaacctccgcctcccaagttcaaatgattctcctgcctctgcctcccaaatagcttggattacctcgcttgccaccactcctggctaatttttgtattttttagtagagatggggtttcaccatgttggccaggctggtctcaaactcctgacctcaggtgatccgcctgcctcggactcccaaagtgctgggattacaggcatgagccactgcgcccggccattaatgataaatttttaagagcagagaaaagcaatttcctaaatatcaaagaactaaaaacaggcattttttggcctttgatgttaccctcaaggaaataggtgataatacaataattttactctaaaataatgattctcaaacattagagagcagaaaaatcaccagagaagcctgtggggaaaagtgcagattattcacattccttctactgccttcctatccagggagggagagtagagaaggaagaagggaaggagaagagagaggaaggaaagggagagaggaaagaatgagtgagaggaaaggagggagggagataaaaaaagggagggaggaagaaaaggaaataggtgactatttcccaaagagattaatgtttacatcagtctcctattttttttttgagtcttgggatttgaaaaatacattgggatttaaagtgatgtcattcagatagatttatctcttaaggtatatcggcttatttgaaatggtatcattaagttaaaatgaaattaagtcaaatatgattttccacatccacgttccaggccacataatgaaataagaatagcaccagctttaatcaaatgcaggtgatataactgtacaacagaaagccttcagaagggatgtagattggtgaagctatgccacagagtcaccaatgatacaaaattgcacttgatacagtcctgcatcccagggtgccctgtaaaattattatgctcttcataactcatatccctttattaatgtaacacggcataaaaaaggcaaaaccagtggtatcctggaagtcagaaggactacactccttgcagaaatctgtcactagcatgactttaggtaacgatggcataataagaattccctaatagttttttgacttataaatgtctttcttgatctttttgttcttactattagtttttatggaccaagttatctgcattaaaggtcaatttcttggtccttctgctaaattgtaagcaaatgtttttgctttttaagcctagtaatttatcaagaatagcagctatacaccatgtaccatgagtggatatatagctgctttgaaagtgtgcaaactgacacatatttgcttcaaagttttaaatccttgattttttatgagagtaaaattttaggcttgaatagtggtcagatttagaagcactggactgaattttgtcttaactccagaatccaaaaattattctttctataaaagactttacagtcatgtgtcacataacagtattcaggtcaatgatggaccacaggtacaacagtggtttcataagattataatggagctaaaaattcctatcacttagtgacgttgtagttgtcgtagcacaaaacattactcgcatctttgtggtgatgctggcatgaacaaacctactgtactgacagtcctataaaagtctagcacatggaattagtacatactaccagagaatgattataaacacctgtgttactggttcgtgtatttatgatactccattttttatcattattttggagtatattgcttctacttatgtaaaaaagttaaccgtaaaacaggcttagacaggcacttcaggaggtattctagaagaaagcattgccatcatagtggatgatagctccatgtatgttattgccccgggagaccttccagtggggcaaaatgtggaggtggaagacagtgatattgatgatcctgaccttctgtgggcctcagctaatgtgtgtgtttgtgtcttagcttttaataaaaaagtttagaaagaaaaaagtagaaaaatgcttatagaataaggatataaagaaatataattttttgtacagctgcacaatatatttatgttttaagctaaatgttattataagaataaaaaagttaaaaaacttataaagtaaaaatgttacagtgagcaaaggttagtttattattacagagaatttttttttatttttttgagaggaagtcttgctctgtcgcccaggctagagtgcagtggcgcgatcttggctcgctgcaacctcagcctctggagttcaaatgattctgctgtctcagcctcctgaatagctgggattacaggcgcatgttgccaggcccggctaatttttgtattttagtagagacggggtttcaccatgttgctcaggctggtctcgaactcttgagctcaggcaatccgcccatctcggcctcccaaagtgctaggattactggcatgaaccactgcgcctggccaatattttgtataaatgtaaagtagcctacgtgtacagtgtttataaagtctgaagtagtgtacagtaatgtcctaggccctcacattcacttaccactcactcactgactcacccagagcaacttccagtcctgcaagttctattgaatggtaagtgccctatacggtgtaccatttttaatcttttataccatattttagtgtacctttttacgtttagatacgttgagatacataatgtagtccctgtgttacactgacctacagtagttagctcagtaacgtgctctacaggttgacagcgtaggagcaataggctacaccatctagcttaggtgtatagtaggctacaccatctaggtttgcctaagtacactctataacgtttgtacaatgctgaaataagctaaggatccatttctcagaatgcatccccatcattaagtgacgcaaaactgtattttaaaaataatataatagtggatcccaaatctcatcagtgaatcatcttctagtgcattaaaatgtaaatatacttcatgactaccgattaacataattgatattacagaaacaaacatatcggagtcatgtgtcggtcagaattcagacaggatacagaaactattctaagcatttcaagcagataattcaatacatggatttgatgacacaagcaacataaaagcttacaaagtcaaaaagagaatgaggaagcaacacagaagttagcaacagcagactcagctcccatccctagggctggagagatagaagaaatggattgtatcagaccccagagagctgttcagttgctgcttgatgggagttgcaaccacccaggggtgcagacgttgcctgtaaacatgcccaaggcacagcaaagtgggaaagaaggaccctgacttctcccttctgcttttcaaaagtgtggggaatgcgtctgagaattaaatagtcaaagaatggcacaaatagcatgtctacatatgtgttgttccttaaagctgtcctcttgcaagatttcacattcactcaaatgttgattccattgcacaatatatttttatatcttcacttttagggtttttgctacccgcaaaagaaaatctgtctttcctagagtccatgaatagcgtaagttcatttatgtcctggctcactgttataattactgcgcatgttaacatgactgtaatttgcctgtgctataagatgtgaatcaccagatgttgactgccagaagatgagatctgtctgtgctagaaagtttcaagagctttcccatcagggaaattaaggatcatgtactttggactgtatttgcttatcacacaatttgagaaagctcaaattgtgtgataggcaaataaaaatgtataacactgttagttttaaactactaatctttaatggttcttgaatcaggactttaaggccagttaatggtggcatagggagaatgctaagatttgtcgagtacctactatgtactggactctatatagatagcttgcatgcattatcttacaattatcttacaatattacaagataggcatgatttttagtttctttctttctttctttttcttttttgtttgaccaagtctcactttatcaccaagctggagtacagtgggccaatcacagcccactggagcctcagcctcggcttcctgggctcaagccatcctcccacctcagccccccagttagcagggactacagcatgtgccaccaggcctggctatttttgtattttcagaagagacagggtttcaccatggtgcccaggctggtctggaactcctggactcaagtgacacactcacctcctctttccaaaatgctaggattacaagcatgagccactgtgcccagccaggtattatttttaatggtctctaatatccatgctctcttccatatatatatatataattatatataatatattatatataatatattatatataaattatatattatatataatatatattatatattatatatataatatatattatatattatatatattatatataatatatattatatattatatatattatatattatatatatttaatataatatattatatattatatattatatataatatattatatatattttatatatattatatattatatattatatatatttataatatattatatataatatattatatatattttatatattatatatatataatatatataatatatattatatatatataatatatattatatatattttatatatataatatatatattatatatattatatatatatataatgaatattttggaccaaactgatttgtggctttattttatgtgaccttacattatattggtcttagtttttctacttatcttcagtttaatttttttgtatatttttgtgagcaacttttaaactttgggggaattaaacatgctctaagtaaagaaatgtcactccatttgaaatataagtgtgaattaccgtactggattgtgaactttttttacgacagatactattgtattaccttatattcttccaataccaagtgccagatagaaagtgactttaagatttttgtgtgtgtgtttatgtgtgtgtgcccacacatgaatgtgcatattcattatttcatttaagtttgatttttatgttatgaggacatttatatgatggtatctaatatatcttccgcttctctgtcattcttgtatgtatacaaacttattaaaaaagaaagtatgtattttccacgcttttttctgggtcctctcctaagaattaggtttcactaacttgagtattgtattttctcactgtaatatactgaatttgaaaaagactctctaatctctaaagaaaaatttgcagttaaaaaattatgtttgcactttgttgttttgctgtaacttttctatatttctattgcgtccttcagtctgtaagacaataaacacaagtcgtaggatagagcagtcttctgagtaccactgggatgtttcaatctacagaagtctgacaattctcatcacatttttttaataaagtgggctctttaattttagagtaatctttctttgtcttagaacaataagtttgtgagagcgtcagcatggtctctcaacaattcttgtcagtggaaaatgtgtttacatgttgctagcaacactatgaattgctcactggggacctaagcaggtgacaatgaggtttattgcctgagagtgttagtgattattttacataacttggcttgggaacatactacaaaacaaacaacttttgagagcttttttgctttggtaattttgtgttgttgagatcatatggagaggcaggcagctctgcagactatggaacaatgagctagcatatataaatccgagctgataccttgaggtaattcttctttgcaaagtaaaaagatattcggtaatcagacactgctaatgtgtctccatgataatatattcttgtcttgaacacagcaatttatttttctgctaacatattcctgctagcatttatgtctctatctaccgctcaattacatatgcatgagttcatgttttcacattgtgtgttttattcacaccgtcctgtgcacttgaaacacttaatccaacagtgtattatttatctctgtggagcagtgtgttcatacaggtacaagcttagcgaagaactttctaaacaccacagaattacaggtcaacaaacccagtgattttgtatgcatttgacaaataaccatttcattcaaggagagaaaatgtcaataaagcagcttttaaaaaattaattgagtgtatgattgaccggtggattgagattggtcagaataccactcaaagtagaagagatttggggagagaaatatactaaaatattctgctaaactagaaaactgcttttcaaacaattggcaggtgaaggtcttcttcccaggtcctaagagaaacggaagaatctggtatatctaagtgattgtggttttattcttgaacttagcaaacctctgcctacttataaatttatacatgggtgtccatcagagtggcatctagatgggatgaaggaaaggatttctggtactctctcctgcttgatttctccattggtcttgtcactggaaggcaatgtgggacactgcagccagaaaatgagacatcttagttgctgctatgacgcatgccactcacttgcttttccttgaaccaggaaaacctcacagctatttactaacttttcctttactttgacagacactgcaatggaaattcatattgatttttaccagttctaagatcttacatcttttaagcctcataaaagcaaagtattgagaagaaaacccccaatacattatcaccaaaattggacagaggaggaagataatttatctatgtaattcagtaatattctctttttctttagtgggggattaaattttttgtaaccttcttaaacttttgttacctttgtaatttaaagtgacaagttaaatgctaacgcaattgataggggtgagcaactggtcaatgactggcctgatcagactacgtaatgttgctgaaattgctaaaatatgcaggtccattgtaattttgacagaaaacagttttctgcagggctttatatctccctggtgatattaaaagccaacaatgttgtaagtaccaaatttctttggaggaaagttgagagacctcagcaacctagacgtcatgttaaaaataaataaagtctgagtatcttgagatttcatctgtgtcagttttgaatgggaaatttgatggtagagtataatactgcagttaaaagacttgcattcactttcctcccacagccaagttacaaattataacaagtaaggacctatttatttttttgcttaggcctaggacccctaaggcaaaataaattggatattttgtgcagtaatttagtgatgtggtggtaggcaatcggagtggtggaaaagggtatgcatatttagcatacaccatttaaggacacgagttaacatttattttagtaactttggtggagcccaggacatctgttaacggctagtctgaacaataaacatctgccagtatcttctttctaaaaatagtttctttcttttgaccatatcctttttatttctactaggtgctctttatttttgttcctacatacagaaccagattattgttagttcacacggcatggttttacaaaagagaaaaaggtatgacatctgagtacattcagcaccacacaccagggctcatggcaggtccagctgtgtaatttacagagcccagtgcaaattggaaatatgggatcctttattaaaaaattattaagaattttaagatggtgagactggatttctgaacctgcccagtatgttagagcactcctagatgtaggttagtcagtaatgaaggtacactggataacatctcttgctcatctagctaaacacccagtcaacatgaagaaggtttcatccatttgtgatcaaatccattttattacttaatctttgaggtggaaggtggtgtaatttagtagtttatccttgaggaagtcagatctgagtgaattcaggctacatcacttcttgtttggctggtctgcaaaatggtttggtttaagtaccttgtctgcaaaatgagaatatctgcaacatagaattctggttaggataactcagatacatctctgtcataggcattcagtaaataatatctctgactatggtcaaataaaatcaagttattctcttaatgaccaagaattatattaattactactagctttggttatcaaaaacagtgccttgcaaatctaaaatataatttctagaaaataagaccctttataaagagagaaagcattgtgaaatcaaacagttagatgatttcaaacataaatgtgacatgaagattttctttaataatacagtaatagaagcttaaattaggtttttaatcgtgtgaatgtgtgttttatggaagaagaattgtcttgctataattgtgctttcatttaaggagaccaattatttaaataaacatcaccaaggaaattaagagatttactatgaatgagccatacaaaggtaaataactactattctatggagagaaagaaaagaatttaatctggaaaaccttgagtgttagccagttaaaatatttgcattgcccaaaatgatttccatagcaatgggaatttggtggtctcacaacaatttaattctaacattctatctcatttcctaatatatttcatcttgatgagaggccaaaaattcttgtgatatcaaaagatataaatatcaatggataattttttccagaaaaacacattttaagtatagagaatggtacattagatatagcatggaatttggatccaaacagactgttcaaatttcatcttctaacattgaataatatttttttaatttggcaagccatttaacctctctgatcctagattcttcattcttaaaatctgggcaacaatgcccacataacaagaattgaattaagaatgccgtcttatgtatgtaagtggctttccaacatagttgttgctcaataaatgatggcttttgctacttattaacagtaataacaaaattgagaatatttctgatttttatatttgcattttatcttcccaaatagattattcgctcgttctggactggcatcatagttaaactccttttctttcctcaaaaactctcagcacaactttaaacagctaacagccaccaggaaaaagaactctgtaaaaaggcattattttattcaacaatgaagcattctgtatctagacctgggctgaaaatccagatgcttacagaccaagagagaaggtggcctggatcattccttatgaaattttgacttgtgctcctttgatccagacacacatcatgtcacgtaaatctcctacaaatattctccattctaccaagatatgccctttcctgtttttagaaagttagagattttcagtctatctttcactttaccacagttcggtagagtcataggttcaatactattttattttcctcttaatgctaagaacatccaagtatataagtgtaatgacagatagtacctggcagtctaacccaatatcaggggacattgtgaagtggtggagactgtggtcaatgggcaagtttacgccctaccccaaggggcagctacacatctgatgatcttggtaataaattctgataatatttataaactattttcttcattagcccaggtgctggatttctataactattaccgactagttaaaaggagtaaaaatggtagtgacttaatgcatttttaagatctttccagatttcgaggagcaaggaagtattcttgtttactgtctgccgaatggaggtgtcttgaaagaatatgtgacaagataaacaagagaggaatgcacttcagcagccatggagcaaagtttcatagagaaatgcaatgctgtttttgttcagtaagaaaggtgtctgccagcacctgcagtgactcatcacctccttaaggatttgtcctctgaagtagccattcagttctccctgttataacctgttgctaacccaggtactctttctgctcaactctccatgtgtttggataccactactacatgtttttgtgctctgtttcctatctcgtgattgctactacatcaataatgcatgacttttagctgtctcgtagtttttccagcttgcacctcagttcagattcctctagagggaagatcttactgggtctgttagtcaccgtccagtttacctggtgttcttcttggccaagctttcaagtcactctactgcttagcttgaagaccactgatctgtggacacgtccctgaggtcaggtccccacattggtccaatcagttgtggtcaaggttggtagagtcaagtggtctgaagctcagtgactccttcacaagaaactccttgaggtcatgacaaactccgaggcacctcagaaggaatagaaaatattctaacttgtattatgttgactgactggtacaaataataatttttaccctatctcttcaacttaactataggttgccaaaaatcctcaatgattcaaatgcatttttaattcaaaaaaacaacacattatttgatatttggctcagtagtcctatgtcttctgaagttagcagggtttacaatgtctgttctgcccagaaatgatttatgtcttttgatactcaaactctattaacagttggtaaagttttaaaatagaattgtaaattttcatattgctctacacagagatcatatgcatgaaagctcactgatgatgtaaagtagggctgcttgtgcagtctaattctgaacagtgggtcagtaaaatatcaaattaattattgggagagatttatataaagtgtcattcctaataggtaactaaagtgtctgtcctgaatgtttgatttctaattagctatgaagttctagcactagtgagttatgcacagattcagttaggaggagctcctttgacatagaggacagaacttcagaatgaataatgccttacaattactcatttcttccttttagatttatatctaaaatttcctattcccatcaaagtgaagtatagttcagttttctggacaaatattatctttgaattctgaatcttcacaactgtgaaggctttttatttcttgtttaagtccaaagttagaattctctgttggtaatgagttactctgtctctttcagaagtccgttcagtcacttctccacacatttagaccacatgcacacaagcatcatgagagggagaaaattgaaatgttctaattacaaatgaataaatattcactgaaataatttgttttctattcaagttttaccttagtaagattccaaattgaaactcttatctatgacgtttgaacaactcagtgaaaagctacagttaacaaaaagtgaacaagagaaccatcaataggaaatccctatgcgatatgttaacataaactaatattaacaaaaagactgttggtttttcagatccctttcttctgctttactttgatttttagtcaattgcaatatggaccataataaaaatgacctaattatttattatcattattattattattattattattattttgagatgaagtcccactctgttgcccaggctgaagtgcagtggtgcaatcttggctcactgcaacctccacctcccaggttcaagcaattctcctgcctcagcctctggagtagctgggattacaggcatgcgccatgtccagctaattattgtatttttagaagagttgggatttcaccatgttggccaggctggcctcgaacccctgacctcaggtgatctgcccacctcggcccccccagtgctaggattacagtcatgagccactgctcccggccccccaaaatgacctaatttttaaaaacctaaccactaaaacactcaattttgattattcctttatttatcggggtaaaaaatacataatatgaaatctgccctcttaactaatttttaaatgtacactatggtattgttaactataaacacaatgttgaatagcacatctctagaacttttggagcttgtataattgaaactttatgcccattgaacagcagctcctcgtttcccctcccttcatacttggcaaccaccattccacctctgctttcatgaccttgactacttcagatatgtcgtgtaaatggaattcatgcagtatttgtccttctgtgactgacttatttcacttagcatagtgccctcaatgttcatccatgctgtagcatttgacagaattttcttctctttttatgactgaataatattcaattgtatgtgtatgccacattttctttattcattcatccatcaatggacattaagattgcttcaagattatgttgtctaatttccacgtttgtgaattttcaagctttcttttcgctgtcgatttctagtttcattccactgtgatcagaaaagatgcttggtatgatttcaatcttttaaaatttattaggacttgttttttgtgatctttcttggaaaatgtttcatgtgctttaaagagtaatatacattctactgctttgggtagactgttctgtgtattagtcataaacatttttttcctaaggcgtagttcatgtcttctgtatcctattaatcttctgtctggatgtcttattcattatatgatagggtattaaagtctcctactatgattgtgttgctgtgtacttcttttagttgtcaatgtttacttcatatatttaggtactctaatgttggatgtatgtattctaataattcctatatcttcctggtaaattcatacttttgtcactatataatatccttctttgtttgttgtaacagttttttacttaaattctattttgtttgacataagtatgtctgcctagctctcttttggttaccagttacatggaagattcttttctaccctttcactttcagtttatgtgtatccttaagtgtaaagtgagtatagattcacataattggatcctggttttttttttttttttcatttattcagccactctgtcctttgtttggggatttaatctatttccatttagagtaattattaatagcaaataaattaatattgccattaaaaagtattttctggcggctttatagatcttttgtccttcttttcctctattgctgtctgtgttttaaaaatttttttgcattgatatattttgatacatttctcattctcttttgtgtttctgctatagattttctttgtggttatcatgtggcttatataaaatcttatatagttatagcaatctcttttaagctgatgacaacataagttcaattgcatacataaactacttttaattctccctgcaacactttatattattgttagaaattacattttcattatatatttatttctgtattataatatcccatcggttattttcaatatacatcaatgtgaaacataaattacttatttatttatttatttatttacttacttatttatttttattttatttttttggaaacagagtctcactctgtctggagtgtagtggtacaatcttggctcactgcgtctctgtctcccgggttcaagtggttatcctgcctcagcctcctgagtatttgggattataggcatgtgccaccacgcccaattaatttttgtgtttttagtagagacaggttttcaccatcttggctaggcttgtctcaaactcgcgacctcaggtgatctgcccgcctcggcctcccaaagtgctgggattacaggggtgaaccaccacacccagctggccttgattacttccatttttttttttaaatctttgtacatacgtacttgagtatttatattatgatttgtctgcatggtaaagtcaagctgaattaataatgagtatgtgaaataatgtgttaaatactataaaattgctttctagaaatttactccaatttgcacactcacaattccttcaatccaaattgtcatgcccatacacatttaaaaaaaaaagaagcctcactcttgttggccccagcatgtgacagatttttaaagaaagattttggtcgtattttagctctttgcacagtaacagctacccattctaatcccttagccacgtggcaggcttgtgggcaggtgtttcaggagttgctggcaagcagcttgcaaaagccagggtagagtaagaaagagagaaagaaagaaagaaggaaaacaacaacaacaacaacaacaacaacctttaaaccctgtctgtcctctaaatattgggaatctgtgctctgattgctggttgctgcttctgatcataggcaggaaatcattctttttgcatctcccccccatgttgcaagcttcccccatttggttgaagtgacttccaaagtatttaaagggctggggcctgttttaacctttatttctttttttttttttttttttttttttttgagacggagtctggctctgtcgcccaggctggagtgcggtggcgcgatctcggctcattgcaagctccgcctcccgggttcacgccattctcctgcctcagcctcccaagtagctgggactacaggcgcccgccaccacgcccggctaattttttgtaatttttagtagagacggggtttcaccgtttttttagccgggatggtctcgatctcctgacctcgtgatccgcccacctcggcctcccaaagtgctgggattacaggcgtgagccaccgcgcccggcctaacctttatttctaactcttccccttttgggagccagacattaagaactacgacattcaaatgcaaccacatataaaggggaaattagaaattcactgtatatgcccagagaagggtgtcaggtaagagaagacctggaaagaccttaggtttgcacctcagtctgatccctggcacagaggcagcctacaacaatcagaagaacaaaaacagaaataaaacctaatatactccatggaaaagggaggatctgattcctagaattaacacattattagattcaaatgtccagttttcaacaaaaaaaatttacaagacaaaaagaaataggaaatacggctcagttgaaagggaagagcaacaacaacaaaaactgtcagtgaatctactagaaaaaggctttaaaataactctcttaaagatgatcaaagaactaaaggaagatgtaaaaaaagtataaaagagaaatgatgtgtgaatgaaatgggaacatcaataaagaggtagaagacagaaaagaaactaaatgaaattatgagctgaaaaatataatatatgacataaaaatttacttgaggggttcaaatgcaggtttgggccagcagaaagaacttgtacacttaaaatacatcaatggacattatcaagtctgaggaacagaatggaaaaaggttaaagtgcaacccagcctaagggacctgtgggacaccataaaatacaccaacatacatgctgaaggactcccaaaggagaagtgagagaaaagggcagagaaaatatttgaaaaaaaaaaaaaaaaaagcaaattgcaggtcaatatcctctatgaacattgatgcagaaatcctcaggacaatattagcaaatcaaatttaattgcatgttaaaatgatcatacaccatgaccgagtgggatttctacctgggatgcaaagatgatttaacatatgaaaatcaatcaatgtaatataccacattaacagactgaaggaataagttcacataatcatctttattaatgcagagaaaagcatttaacaaaatttaacaaactaagactgcctctacataataaaaattatgtattaaaaaactgaaaaccaactttattctcgttagtgaaagactgaaagctttttctataacattaagaacaaaacaaggatgcctactctcactacttctattcaacaaagtactggaagtcttagcagagcaaatagtcaatgaaaagaaacaaaagggatccaaatataaaatgaataagtgaaatcacctgtttgtagataacatgatcttatatgtagaaaaccctaaagattccatgaaaaacattataaataataaattcagtaaagttgcagaatacaaaattgacatacaaaaatcagttgtgtttctatacactaataatgtataatccaaaaggaaatttaaaaaaaaatctcatctataatactatcaaaaaaataaagtacttagggaaacacttaaacaagaaagtgacagacatatacactgaaaattacaaaacattgttgaaagaaatttaagaaaacataaataaatgcaaaaatatccaatgttcatggattggaagacaatattgttaatacatctatactatccaaagtgatctatctacatattaaatggaatttctatcaaaatcctagtggtatattttccagaagtagaaaaacccatgctaaaatttatatgaaatgtccaagaaccctgaataaccaagacaatcttgatacaaaagaacaaagctggaggattcatacttcgtgatttcaaaacttactacaaagctacagtagtaaaaacagtgtggctctgtcaaaaagacaaacatatggaatggatacaaatggaatgcaatagacagcccagaaatcaaccctcaaatatatggtcgcatgatagtcaacaaaagtgtgaggatcattcagtgtggaaatggacaatttttcaacaaatgttattgggagaactggacatcctcatgtagatgactaagttggatctttaacactgtataaaaattgattggaacaattcaaaattgttccatgacccaaatataacacttaaaaatataaaatttttagacaaagatattgggcaaaatcttcatgacactgaatttgtcaatgatttcttggctatgataccaaaggcataggcaacaacaacaaaaatagacaaattagactttattaaattttctaaaaattgtgcaccaaaacacactatcaacagagcaaaacacaacccagaaaatgggagaaaatatttgcaaattttatatctgacaaaggattaacatttagtatatatagaacactcctaaagttcaacaacaaaaaaacctgacaacttgattcaaaattgggcaaaagatttgaaaagatctttatcgaaaaaagataatcaaatagtcagtgagtgatatggttgtctgtgtccctacccaaatctcatcttgaattgtagctcccataattcccatgtgttgtgggagggacctggtgggatgtaattaaatcatgggggctgggctttcccatgctgttctgctgatagtgaataagtctcatgggatctgatggttttataaagggcagttctcctgcacatgctcttttgactgctgccatgtaagacgtgcctttgtgtctcctttgccttctaccatgattgtgaggccttcccagccatgtggaactgtgagtccattaaacctctttcctttataaattacccagtttcaggtatgtctttattagcagtgtgagaacagactaacacaatgagcatgatgattaattaggaaaatgcacatcagaactacagtgagataccacgtcatacccattaggatggctagtattagaacaaagaagaaaaagaaaagaaaaggtgttggcaagtatgtggagaaattggaacccttgtgcattgtcggtaggaatgcaaaaatggtgcagccactgtggaaaacagtatggcaattcctcaaaaactgaaaagtagaactaccatatgattcagcaattccacttcttggtatacagccaacataactgaactcaagttctcaaaaagatatgtgtacacccatgttcacagcagcattattcacaatagctaaaatgtggaagcaactgatgaatggataaataaaatgtgttgtatacttacataggaatattgtgcaggaaggacacttggacacatgctataccatgaatgaactttgaagacatattgctacattgaataataaagtcacaaaaagacaaatactgtttgactccacttaaatgaggcacttaaaagttgtcaaactcacagagacatcatggttgcctgggtctgtcaaggagggggaaacacagagtgtttaatgggtatggattttcagtttgcaagacagaaagaattttgtagatgaatggtgatagttccacaacaatatagctatacataataccaccaaattgtacacttaaaaatgactaagacagtaaattttatgttacatgtattataccacattaaaacatttttaaaaatattgtcactttttagaatttgcacttcaattttgatgtttacaatcttctcatgtatttattggctatttgtagtttttaattgcctgttcatatcatttgcctattttttaaaaaaacaactgagtagtttgttattgatttgaatgaagtatctataaacattagcaaatagtcctttgtctgacatataaacctttaaagcagaaaatttcatcattatctggtgactcaggataaggtggagctggtctgagggaggaactgctattggtagactgtttttttagtaacaatttgtctcactcattttggtcatgcaaacctataatttgcatttcattgagaccatgctgtgatttcaaaatgaccttccaaaatcaaacattctatatttttggacactgaagtcccagtaaagcttgtaaaattttattttttcataaattacattcgtaatgttgtgtttgccttgtattctgggaggcttttcattcctcaaaggtgttacaaaaataaatgagttgattcataaaaatgcaattcatattttattatttttgttcccataatgcttacttcatcttgattcgtgagtgagtgatgtattggattaattcttggcatataccagtttgattttaatttgttgaacagcattattcagaaatagtaaaataaataatttcatgttagaaggcctgattctaaaacgactctaattttcagcatggcttggtgtttatcatgtaggatacttgattccacaaaacactcacatatattttgaaaactttataacatttctattcttatgcctggaaataatataatagagaacttaaagtattttagaaaccactaatctatctccaccaaacacatttaaattaacacatttaaaccctcacaatttaaattaaaatttagctgctattaattacaatacaaaaaactagttgtgatggtttagcataaaactaatgtttcaaactgcaaataatttaaacatttcaaaatggaccaaaagctgttgtttcacctttggattaacagccaattactatttaatatttagtagtaacaaatggttactttgaagagtttctatctttccacttcaaaggaagcctgtgggagcccacatgattcctgatatgaaagttgaaaatgaatcatgtatataacactcaatattgaatatataattgtgtccggaattggtgggttcttgaacccttgtggtgttacagttcttaaaggtggcgtgtctggaattgttcgttcccccccggtaggttcatggcctcactggcttcaggagtgaagctgcacacctggaaagtcgaaattagacaacataatcttgaagcaatcttaatgtccattgatggatgaatgaataaagaaaatgtggcatacacatacaattgaatattattcagtcataaagttcataaaggtggcacgtctggagttgttccttcctcccatctggagttattctttcctgccagtgggttggtagtctcgctggcttcaggagtcaagctgtagaccttcgccgtgactgttacatctcttaaaggaggggcagatccaaagagtgagcagcagcaagatttattgcaaagagcagaagaacaaagtttccacagcctggaaggtgacctgagccggctgcctggctggctcgggtggcctgcttttattgccttttctggccccacccacatcctactgattggtccattttgccaagagctgattggtccattttacagagagctgactggtccgttttgacagagtgctgattggtccgtttacaaacctttagttagacacagagtgctgattggtgcatttacaaacctttagctagacacagagtgctgattcgcgcttttacaaacctttagctagacagaaaagttctctaagtcccgccggacccagaagcccagccggcttcgcttctcaatggcagtcgcagcgggactttgtggcacctagcccgggcactctggcagcccacagggagctcatcccccgatcaagcccagcaggcgcctgccggctgcggggcccgccaagcccgcgctcacccggaacccacgccggcccgctagcgccgggcgcgcagcctcggcgggcgggcgcctcgccttccacacctccccgccagcagagggagctggctccggcctcggccagccccagagaggggccccctcagcgcagcggcgggctgaagggctgctggagcgcggccagagcggacgccgaggccgaggaggcgccgagagcgagtgagagctgctagccagttgtcacctctcacagagaggtaagtgtataatatgaagagtccggagacccagaggttcttctcagtttttcctctggctcagtgtgagaacggggttaacgttctttgcttttttggcctcccttctcatcctcaagaaagagggtttggaatcacctatagatttactgcaaaacttacgtagtttatacttcatggatcctcacttgcacaggtcactttcaaagccctgggagcgcaaatgtttctgacttcgtattttaaaattatttttcttaagccacctcacgcccgcaaccccagtggtatgcactgctggattcatcactgattagaatacattatttaaggtttcctccagttcgacaatccagtccttctatgtgaatacttaataattgtttatatctagtcactcataactgttgtcacccatagtgttttctctcctaggaagtttctgctttttaaaataacactttacagctattatgaagattgattttcactgagatgttgtaaaaactctgcagatccattatactagacctatatataccgtgtattatactagtcaggattctcctgagaaacagcaccactaggttctgttcaagcgcaggagataagaaaaaatatcccagctcaagcagtgagatgaaaagaaggggttagtcctccttcctccaccttttgttttattcaagcctgcagtggattggatgatgctcacaccatgggtaaaaggaatctactttactcattccgccgattcgaaagctagtctcatctggaaacaccctcattgacgcagtcagaagcaatgtttaatctgggtaccccctggcccactcaagttgacacataaaattaaccatcatatctgtcttcttatctttaattcttccctctgctgacttttcttgcctctgagtttaacagttctcagactgtgatctcagcattaggtacatcagaatcattaggagttttattttatttttttaatgaaattctcaggactgcaatccagatttactgaataataaaaggggggagggttgcagatacaagaaacctacgttttgaacacgtcctccaaatgtttgtgtcccctagtctttaaaagtcaactattcatttccatgttctagaaggtgtgtgtgaatgtgctttttcaaaatcaggagcagatggcaaggagaataagaatgtaaaaaaagctaaatgtaggtgaaaatttgtgacctattccccaaacaaatattaaaggatgatattattatattttgatgtattatatcacatgatattctgtgaatcaatgtacatcctctttttattatgacattttcactttccatttttcttggttctcatagctggtctaaaaagaggagagagaaaagctagaaagaaaatctgcccttgccttgttgaatttctcgcttgtagttccagaacatgagaagaggtgttctggatagactaagagaagttatggggcagagacacttggtcttacccctctattgatgctctggggagaatctttgtgtagacctcccttatactgcaaggggctgccccagtaaagttaggagagaggtgcagcatacacacacacagagtaaaggtctagtttgcacactgatcctttctgaattccctatgtgctagacgctgagttgagagcctgctgcctgccatgaggccttatgagggaactcaagatgaccacaggaaggaagccatgtgcaaagcatagaccaggaaccataatgagtgaacaggagaagcttaagggctccaatatattttcatgttgaaaggagagattttagaatgttgtggtagttagatgagtcccacttcacctcaccccaccatctcctggaagcccctgagaaacagtcacagaccacagttgggaaacacaatttccattatgagaagccatcaacactaaaagttgaaaaaacaaagggagtatttacagagggcttttcacagtgctgtaacatcttctgctagttttttaatatgatagtttgcttgaataagtgtgtctggaagatagagaatcaaaaaggaaaaacaaagatgtgaaacaattagttgaaaaagacttcaatcagctgagattccatgctggattttggaagacgtaatcacatattgtatgtgattaccaggggtaccagcaagtgtgtgtgtgtgacaaagaaaagtgtacattatttcagctgatgtgtctgttgctcagttgaaatgttatgctgcccaagctgttgaggttgtgtattttcttattcagtagtcatgcatttcactgtggatttaaaaatggagactcacctcaaggattcactggaaataaaagttattacagccaagcaagttgttcgtttgctccttattttcaagtaccaggaagtttgatatggttgaaggaagtgtataaatgaagattggtacagtataaataaataatttttgtttgatgtgaagagaacttttaacataacttttgtgaaaaaaatttttaaagaaaaacaagaaggcaaatccagccaagtgtttcttgaaagccatttctcaatgtcataaaggattcgtgggaaaatattaaatgtgggcaatcaaattaatttccattaattaattattctgagttttcatgcttcttggaatcttcctcttaagagctcagtcaacaattttagtctttacaaccacatgtaaggtcaagatggatatattaatttgaggctcagtattgaccatcatatctaggggacagctctttataagcataactttaaccaattttatattttcaactcacggttagtggtgttcttgaatataatgagtaggcaacaaaaagaaataggaagagtatttggaagtcaggccattcatttatacaaacgatttacaaacatgctgttgaaacatacagctcttacttgcagtgtggttttctgtgcatcagtgttatttacccacattttgttaacaagtgttttgtgtcatgaggttgcagataaatgcatataaaatgacaagtactattattattgattctcttaaacagtagctttgagatttgaagacattccatcagcatgttgatcagaaggaaaaaggcgccttaggaaagagactaaactggtctataaagttatttgaaggaatcatcttgggaagttagttccaaaagaaaaactttctattgccggagggctattcattatctctgaggttggcagattagtgagttgctgttgtctttgataacatgtctaaaataagctcaaagttatgagatcagttctggtattaaagagttagttttacgttgtggtattgttgagctctaccagaactccaggggctatttgagaattctgggtgtacattaaaaatccattttcactacccaggatatacttttgtctacatgtcaatggttttaatgactaaagctgggtatgcagcaaaaaatggtattggttttacagtaaattcttactcattttatttcatttttagcaacaatttaattcttaaaattcctggggaagtaaagattaatcagattggatgaataattttcaaattatgctgtgctcttaccaatttccccagaattcaatgtctgccaaacttttaatatttatttctcccagggattgtaattacattgttgcttattctagccaacatttttaaaatcggattttgtttttcaaatgtatcaatattatcactaaatatttatttggcatacacatttctaccttaccttttcaaagatcagtctcatctctagatgctattgttcttaatgatgcaaatgatttgctgtttgaccaatatggctgcataaatcacagtgagagtaagtacttgtagtgattgaaacttctaagttacctctgttctgctacaatttgctcatttcctgtatataaaaaaacacaatattttacttagtactgacttttccccatgcctgaggaagtagtaaactctccaagaaaggagaaatggctacatatttctatagaaacaggaaaacaagctataataaagactataaatttggatacgtgttaaatggctgaggagtatatctggtgctgtgatagctgttaaatgcattttaacatccataataattgacaatagtagcaaaacaatcatcatgaatagtgaaacaaacataaactaaaaagaaactgctgttcattattttttgtgactgtttctagtgccagataattcttccctactgtgataatggtatgaaacatcaatataaactataaaatatgaaggaattttcaaaatattttcataattatttcattacccacactttcattttcaaaaatatgtcaaaatatgttaatactatagtcgacttgataagctggaccttctaagaaaaagattgcactttgttttatacaataactctttcagtaacgtttattgtggacttgttgtgtgcaagattctttaccaaattacaaagataaaaagattaatgaaatatgtatcttatttcaagatactgtgaacttccttcttttccttccttcctccctccctccctccctccctccctccgtgccttccttccctctcttctttgttccctctctccctcttccttccctccattctgtaactatattttgaactgttgcttgttagacctaatgcttagcactggacataaagcatgatatttattttcattaaatcaattcaagaaaaactttcaaacaaaacagtctataactaagcagcttagctcaaactgcatttaccatttttttctttcttcctttctctccagtctcaagatgtagctttgagccaaactacaaatgtgttttctttcatcttgaaatatagcctcggaatgtgctgtgaacctccactctcctctccctttcccactttatgctcccatgccttatgcacatttatttgcctaggtacttgttaagcacacaccatgctctcttatctggtcataaatttccttagaagctttaggggccggatcctgatacagagcagacacctccagagttctttccaacgcgtgattacctcaagcctggaatccactcttgactagagattgactggaagattgactgcaattgatttgtaacctggttgggcccatcctggcacgggttccttcactagatggaataataattcaaaacaagtcatcggagcaggttgcaccgcctgacacctcctaagccgtttgtttctcctgcattccaaacctctcgctttaaaaacccctgcattccctccacaaattaaagagtggaaatgtttggaaagaattccgcccagtcttgcccttgctaccacagataataaagcttgctctctttctatcacacctcgctcttgttattttggcgtctttctccaagcagcaagcagctggacccttttgcctgttacaagtctttaaatagggtagttttcaaatgtcttcctcagtaaaaaatatgattctatccctccaataacataacctttttttttccttttctgtctgttgggaggagtttaaaaagaaagcgtgggcattccatatgtatatgaaatttcctgttggttcctgaaaaaatgataaatttttcaatgatgtatctagaaaatagtgacttctgtgatttaatttatgatatactagcatatgttttgtggcagaagaaaacccttaaatttagtatgcagacctcactgttgggggcacaatggaacagactcatactgagacttgcctgcattctggatagggcaattgagtccgtagagctgcacttcatcatctgctaagtcagcagttaattttctttctagtgcattatttacttcaaaattaacattcatgagaactcaaggaatacaagctagcctaaagagttaggctttgtctacatttgtcgtctgcatgaagggagcaattttacagcaccccaggtgccctaacacgttgacagcctggcagtattttacacttaaaattcttcagctgaatactggacattttgaacaaggacgttacattattcttggtacttacggctacacagcaaaagtaacatctgggaaggaaataagtcgttacaaatggatgtggacatctgttttctgatggaaaaagagcttctgtcctacaaaatattttcttgtaataatggataataatgtttttatttatttttatttgtttgcttttaactggagaccacagaattttcttataaaatatttatttgcaatattccaagcattgtagaccgctttgtctagtggcaagtcctgatctctgtagtaacagtgacacctatttagtgtggcagagtggctttggtgtcaaaaagacattgctgcaaatctcagtatttataacaggaactactttcaattctctcttggggatttttgttatccacatatctcccttttagtgggagagcaaagccagtcttgctgtttttgaactcttacttaaaatctaacctgggactaataaaaagaaagttagagatcctctctggcagccaaagtccctgaagtgaaaaagcagagaatgagaattgtttgttaaaagtgaccacagcaaaagctagaaggtgaggaccaaaggagagagctggtaagagatactctgtgacactggttgtccaatcattgaaaacactgagtctttgtgggtctccggcaaacttccagtcctctcctgctttcagcggagagtctccacttaataatttaagaactccacttacactagcctttctatttgcatatctttcttgatacttcttctccaccaccctcaaaccccaagcactaagattttctcagttgtccttctgaatatctattgcatgcatttgacttctattcatcgctgatctccatggccatttcccactgtctaaaacttttcaaccagtgccattgactgaggccttcagcaatttctgtaatatattcctgagtagtgcttcatgatctcatctttgtctacctttccagcttaatctgtattgttctcctttcttctatattgcacagaagccatctgggacttgcaacttccgtttgctgttcacaaaagccatgttcatttcaaggcaggaatatcctccctcacatttctcatctgctgtattcctactcactcttcagttctaactgaaagttcacttgcttataaaggcctttcctgacctcttagatttgtgttattccctctgctgtaggctttcacaacaccttgtattttttaatattaacctttttaatatcaacttaaaaaatcacaatcacttaatgtgtttgttttctaccaacctgtgagttacaagaaattgggtaccattctgtttctgtttatcttgtattgctaggactgggtagagtgcatacacgtagtaatgcctaaataaagacttgttgcttaactaaatggatgataatatcaataattcatttgggaattagacataaacaccaatttactctatatagtatcaacaaatcatcaaagacatcaatttggatattacaaataatggaaatccttatatgtagaattagggccgttatttatttttaaaatcacttattccacatgaaattattgtacacctctgtaagcccgaagaaccactgttataccagaagttgttttgaaatggtaggtgttcaaactatagttgtactacatgttttacagtattatttattgtgtaactttggtttaaaaatacataatttatagatcacagaaaggtatattagattattattcaaaagtattaatttcctccccatctacctccgtggcacgagtgtacttccctgtctcttgactttgggtttggatgtcacttgttttggcttgagggatgtcagcagatgtgacatgtaatacaaacaaaaactcaccatgtgcttctgcaattatgggcttgaacaattgtttttctgacattctgtttaagaactttcaccctgaaacctgctgtccccttaagatagacctgtcaaatgaatacatagactgcagagccaacccagctgacctgcagacccaatacagaaatgcatgctttttgttgaatgccgttattatgtgattgtttgttatgcataagagtttacgtatacacggagttcccatgtaaatttgtaggcgagatggtgtaaggcagatggtcacttgctgcctgaggacatcacataagtgaaacctccttaattatttgaatgcaatataaatatgtaaagattattaaggctgtgatgttaagttgttaaatagagaagtacaaaataactgattgaaacatcataggagtaaataaagaagacagtcaaggatggttatgcagctttcatcccctaggtcctcccactccaggttacctccttctaatcatagaaactggctcagctctgtgtcttacatgagtctctctctctctactttcaagtcacttgaaatgatcagagaaccagtgaattcttaactaacagaagctaactagatttgtccccaaattgtaatactaaaacatgcagagatttttgtgaaggctgtaaccaatcattaaaatatagaagtgcgcgatcttcgtttcaccatcataaagcatcaaaaggcatttttaacatgatgctataattcataatcagtaaaaattttccagtacgttggaagctgaagtatgctttcaaaaaatgaaattggtactctacttccattaatgagtgctttgaagtatgtatggagatagctttcctcattttcagtaattcttcttgttcattacagcatttaaaggggtagagggtggggagtaaaaatatcattttgcaggcacaaaaattttaactagcagcagatggtgagactgtaaagaaactgctcctcacatgaaacttacggaaattggtttctttctgatatagtcacgcatcatttagttctagaatcaggggtcagggcaatacttgccatatgctaaccctagtatatctgcctcttgctggtatagatgctacatctcaaggaatttggtttgagccaaagctgctgtaatttttataataacaagccatggtctttgctgacattttaccgctgcccaataatgagttctctctagagctggaagctgttttttaaaatttgaaataaagtttaatcttacttaagttctttggaacaacaacaacaaaaaaacaaactttattaattttttacatgcaacctagtctttctgtctgagaacaaaggaaaactggtgttatgtgtgtgtgtgtgtgtgtgtgtgtgtgtgtgtgtgtgtgtgcgcgtgctcccctgtgtacgtgcacctgttgaggtgagggtggaagaatgccatggaggaaggaacaggctggaaatttacagtccttctctggtaatttaaaaaatgtgtccacaagttcttggatatactttccttccaaagtcagagacaaattcctctcttgctgaatgtggattggaatttttgatttgtaactaacaatgggaatgtggtagaaatgacgctgtgacttccaagactaggtcgtaaaaaggacagctcctgtctggctctctcttggatcatttgttctgggaaaagacagctgctgtgttgcgaggtaactcaagtagccctatggggagtggaactggggcctcctgccaacagcaagcaccagtttgtcagcatgtgggcacaccatgtcaggggcagttctttcagtcccagtcaatgcttcagtggactggaactctttagagtatatgactgcacctcatgaggtacactgaactagaactgcccaggtaagccagtcttgaatttgtgactcacatccattgtgtgaatttataaaagttttttactattttaagctactaagttttgaggtaacggttactctgctataagtaactaatctgcacagacttattaagtgtattgtcttattcgattatcatagcaataagataggtactagtataatcattttcacatatgagagaagctaaaactaagttgtaattaaattactatgtttgctcatggggtctgtatgtgagtaaagattaaattcagctacaagcaacaggaaatgtaacataaaaatgataagacaaatacatattcccacccataatattatatatgaggaaattaagggctggttcttttgctcatggaatgcactctgggtcctagctgcttctaactctttagatcatggttactggcatgtggctttatactcatgttcacatggtagttgccacattaccagctgttgcaaccatattttggacaagaagaaggaaagggggaaaagtcaatagtctttggacagcttagcctttttgtgtcaggaagaaaaatctgcttcatgacacttctgcaccataatggccatgcttatgttgaattgcctctcttagttacaaaggaggctgagctcattggtcgttggagtgaaaagtcaggtttctgttggaaagcaagaaatgaataagagatatttctaggcaactagttgtagctgctatggcctacatttttggttattctgtatattcagataaatctttatcccactttttaattttgcaaccatacttatcacaaaagaaaccacctccaagtttcatccagatactaactttagctcaaagtctaaagattctgagtggtatacagatcacttcatcattcccaaaccttagagtaaaattaaaaatgtatgccatacaactctgctatttcatggttaaaaaataaatgggtctttatacttctagcatctacgtaatcaattaaattctccacacttaactcacattttcattgcagttaacatgaacaactcattcaagagatgtaaaattattctagctccagtattcaaattatactttgatagaaatcaaattagtttgttcaagttcttaaaaattttaaaaacttttgtatttctccagttgttagtgaaagcaagtaattgtaacccaaaaattaaatagcccactcttcatgtgagtaatatactcaaagttcattaaaatgtgtactgtattattcagtaataattatgtacaatcattgtaaaaatttatcaaacttggttaaaatttatcacagtttagttaaatttaagtggttaattaaataatctacatatgtgtactcttttctaacagagagttaatctgttcaggtcaattgcaagtaggtttttcatgaaaatagcttattataagcctaacattgtaaaaaatatcattccaaaagccatttggacattaaattctatatagtcaggtgagtacataatttatgttcttccctaaattatattaaatgccaaaaaaagacttaaaagtgagtaagtccttactagacctgagaaaatgagagtgaaattttatgaaacaaaccagaggttttataaaattttctaaagatacatcttgtatgttacaaaaatgtaatacaaaagaatgcttgaaaaatatgttgtcaaaataaaaacatcaatagaaatattacaattttaaatgaataaattttttcaaaacatagttaatcacaacaaaagagaaatgaaaacttaggagatacagtatttaattcaaaggaacattgtgaaaacagagtggaggaaataaatattaaaaagtgactaatattaggggaaaaaaatctgtatttaaaataaaaaagccaactgagggccaagtaagataagctgttgaaaaatctcatcatttcatatattcttgccaaatttctgacaataaaagattataagaatttcaggaagaaaatactgaggttgcattccagaaaaataaaaaggaattaaagaaagaggaaggtatgggatccactcaacaatgcaattagcacaggtgttcagtaaaatgagatcttaggatgaagagttatacatcatccttaaaaagcaatcagttaaagtaagaagtctgtagtctgcacaaaaactattttcaagaagaagatactttctatttatgaacttggaatctctaatgacaagaaagcacaatgcaaatatgagacacattaaaatgttttattagtttttaaaattgttagaaagttagaaaaaaaagagtgcagttgaattttacactcgaaaagctctcctctgagttgtctgcacctagcaaccaagttttatactgtcagtctaaacagacttcttgattttgcattaaataacattcgcaggatcatgccattggcataattacaagtataggtcatgaattttttcattttggaatatgtctgtagagtatggtttgggagatctaattgtggtgacaaaatagactctaaatgttatcaaaccataattttaaaggtagaattaattgataggggacagaaggggtgagaggtgggaaggaagtatttttagggtaaccaattgcctgatctttcacaatggcaatcagatatatactaatatctattttctagaagaaataaaaaatcaagcattaatttaaacttaagaaaactcaaagaagaattcctgtctaggtcttaaaggccccgcaaaaattgcaaatttgcttacctttcagatgtgtttcattactggaggtcaaaacaatgactttctttctatttctctcacactccaagcccttttctgcctctggtcctttccgttttttgtatctttgctagaaaaattctttctaaaatttttggtgtggctgtcttctttttttttattttttattttttattattattatactttaagttttagggtacatgtgcacaatgtgcaggttagttacatatgtatacatgtgccatgctggtgtgctgacccattaactcgtcatttagtattaggtatatctcctaaagctatccctcccccctcctcccaccccacaacagtggctgtcttcttatagttgtgcacgttcaactcagttatcactttccaacatttcagaggagatctccaccttgcccattggtcacttcatgccatgaattatttcactttgtggttttcttaatatttatcaccatctaatattatggtagttttttgttcaatatttcttctctcttgcttgaatataagctccaagagaacaacttaaaaaaaattctcattgggttgatcagtgataatttgttgaaggaatcgatttaaataataaaattaataatagcaatagtaattagcaatcataacaatcatgttatgggctatattatggccctccaaatttatatgttgaaaccctatcccatagtacctcaggatgtgattttatttggagatagggttttacagaggtaataacgttaaaatgaggtcattagggtgggccctaatccaattatgactggtgtttttataagaagagaaggttgggttacaaatttacacagggaaaagactgtgaagacaggaaaaaggccatctaccagcccaggagagaggcctcagaagaagccaaccgtgatcttggacttctagtctcaaaaatgtgagaaaattaatttctgttgttgtcacccactttgtaggaggctatcctagcaaactaatgcaagaactgtcacaactcaggagaagaatggactgtggatatgctaagtgacttaaatgaactaatacatgatctttcataacggaaaaaaactaggtcctgagtaaactttacaaaaaaaaaaaaaaaaaaagaaaaaaatggtataagcatataatgcagaaaactaataaacatgagaagtattaaaatggattaaagttattgcttcttagaagtagggctagaaatagacagcagatgagaggcattttaaaaaaataacaatctgtattgtataatttttcattcttggattacttgtatgaaaaaagtagatataattaattttttagttttgaactatttatggaaaggtatagtgacttgtggcatctgtatctactttttttcctaatacatttttatttcatgaggcattctggtttacagagtataaaaaagaaaataaaatggttgtgagagctaatttattctttagattttgaaaatgaagaaaacattggtgaaaatacaagacagaaaagtctgcagtaagaaacagacttcaaaggagttttccctgggaaagcagactggaaataagatataatgtaggggatgtttataaatcctaagcacagtcatgaaaacagatggagtaacaggtggtgaaacaacagatgaaatacagaatgttgatggtgaagaggagaaggtaatgaccagattcagttttctggaagggcttcaattcaatacatttgagaaagttgatggtatttgaaataactgagggacaattcttttgtacccatgttctagccattgtcatcaactgcgtagagaattcaacttttaaaataatcagtaaatacgtaatgtaaaatcgattcacggcagccaggtagcccttattttgaaattaaagagcataatcaagtattaaaggaaaacacaaatatcattgccggactaagtctggatcaaagtatttgctattacctttctaggaaaaggataacttgcagcatttttttttaaattcgggtttccatagttttttttttttttttaatataggtggacttcttttatgaagaaaaatatactataaaaatgtaagccaaataatttgattactcattataagtgaaatggaatttggagattatttatgggcagaatggagcaattatacaatataagcaaaactagataatctcagatgtaggacattattcaaaatgatttcagatttttagttttaattggcaagaaaacgtcttctttgtccctataattttaaaagtcatcatcaaattgaaactgacccaataatcccatagatagtatttttttatatataaatatagaaattgacccttctggtcttaaagcttgaaaattagatttgttttatctgagttccttcctctggaaattaccttcaggcatctcaaaaaaatatatcaaagaattgaaactcaccagatccagacaatgagatacccctcattcatcatgattgcttccttgcccctttctagctcctgttttctcacatattgttgcatttctttcctgctatataaaaccccaattttagtcagttagggagatgaatttgagtgatctcctgtctcctctgctgcagcacccaattaaagccttcctccttggcaatactcatctcagtcattggctttctgtgcggagagcagcaggacctagactaaacccctggtgtttcggtaacaaaatgattgacagtgattgagttttcatcatgtatattgattgtcttccattacagccaaatgtatcataagatattctacccttgttcactttactttttgtatgtccctggctttgacttccacggtattactgaaatattcttaataggtgaacaaggactttctcataattacaccttacactttatttgaactgtcagcatctctgagctccagatttatttatctaagtatctactggttccttctatttgggtttcctagttacctcaaaatcaaactttggaagctggagctaactgccttcttgttctttcttccaactagttgctcaaaccagaaattcaggtaatattattgactcttccaacctgttttctaacctcatctactgatcaccaattaaggtgcatattaactcctaagtatttcttctaatctgtcaagtttctctctgtccacaagtctttattctaattaactccagtatcatcttttgtctgaattatatcaattcccttctgactaatcttattgtctacaatattttgcaactccattcccttcttcacattgcagacaagacaacctttttcaaaagtaagtcatataaacatgtaagtgtgtatacactatatggatatgtctgtatgcttatgtatgtatacatgcatgaatgtgtgtatgtaattccacattttaaagttcattggtttgtctcagaataaatttccaaatacttaatctggtttaagagtaacctgtgttttttctgcaatctttatgtagtatttctgtttatttatccagccctaccttatattgtatcatctccagattttacaaccatctgtattgaaccacattcagttccagaataattatgacattcttttttattcctttagggttttatttcccaaaacatacttttccttctatttgcaactcttttttgttcttcttcaaaccatgctgtcctgctttttcacgcctgcttctggataatctcatggatggaaagggtgaataactggatctgtggactttcctctcatctcctggacatctaaggtttgcccatgggtaattattcttgtaacattaactcaaagaattgctaagagtttacttttttggatcaagataagtgagaatccagccaggggctataggactggctgaagcagttgctttttgagtaatatgtgctgataatatacaggcatcctagagtatggaggcaagtcgtatacccctgagtgaacacctaaacaactaggggtaaaaggtagagtgagctcagagctggggcttttccaagctgaggttctgcatacacttagcttgcctctcatgacaatgtttaccttgagtgtggaatgacatagactctgtgcctgggagtcataagaactctacaatgctgccattgtgcatgctctgttgtttcttttctccatccttccttaaagtaaacctggtcttactagaagcatgttgtgtctcatgaattaggctgccaacaaaaactgaagacctttggtgctggtaagcagatggtgctgcatttccattcattgtttagacttcactaataggtcacttcatctgagaagtattccctgattgatcagctgagttaaagatgaaaattttaatgtactcataaaggctatatacttctcccctcaacatttattgaattatattctagtcatttcttatctttattcctcactgcattacatggacacaatatcttattcataggtgtatttccaatgtatgtaacggtgcttggcacttagatgcataattaaatttattgattaaacaaacagctgaagaacataaatctcattgtgaatggagaatagataaatggttaacaaggtttatataactatagctaaattttctgtttatttccccattgtatcagttcattcttgctatataacaaactccaaaactcagtggatgaaaactacaataattatttattattgcacatgtgtctgcaggttggcttgagtgtgactaatcaatgcgcaatacgtggttaggacaccctactttgggctgtagtgactgggtggctcttctcactgtatgcctgtgggtcagcaggaaagctctactccacatgtctcttatgatccttggaccaacaggatacccaggccatgctttgtatatggcaatggcagagttgaaaggagtgagtgaaggcttgttggggctcttgtgcataggcttggcactggcacaatgttacttctgcctgaatatcattcaccaaagcaagtcatgtggccacgtccaaagccaaagaccaggaagatacattccaccgacactgaggcaatgggggatggtgaaacagcaatgtgatcaaccacagccaccaacataacatgcagtaattttagaatacttgatctcttttaaatacaattgtttttatattctgtatcacacaaattattttggaacaatttcaatcatttcatcacattaaactggatttatttcaatcaaaacgaatgtactgagaggctccaaacagcagccaagtgtgaagttgtcttcattttaccctacatcttccttcctgtctacctgtctgtgggcaacaggtattagctcaagaccagggggctctttcttgttcaagatcttcccttcctgactgtccagcctgtggtcttctggcttgcttaaccacctgcacagttgtgaaggcaaatcctaacactaaatccacctgcaaaaaccatatcccctactggttctgcttctctggtgaaccttagctggtatactccctcacaatgcccattgtccagtagttccccaagtcctgcttactcttttttctaagtagtaccttaatattactgaagaatacactgccacctggggatccaattataatttctcacttcttccagtgataattgagagtaatttatttctgtcctttcccactgccattagccaagaccaaaatgtcatttgctcttaccagaatgacaagaggagcctcgtaacctgtactcagcaagccgttcatatccaaactactttcttctttgaatataggaaactttcataaatacaaacttgaacatgttagcttacacctactcttgctgtggtttcccactgggaagttccttaacatgacctaaaagcttctgcactccctggcttttcctccatgtctccattgtcctttcttactacaccttaccttttcacccagtggcctgaaatgctcttccaacattctccacggtgtaggcagaaattaccccaaagatgtccatgtgctactctctggaacatctgagtatgtcatgtcatatggtgaggtggagaaaaggctgctgaagaaattaagattgctaatctgttgaccttcagaagaggtgattatactggaccacctgggtggtctcaatgttgttacaggggtctttattagtgaaagaaggagctaggagagtcaaggtcagagtttgaggcagatttgaagacattacactgctggctttgaagatggagaaaggggctacaatctcagaaatatgggaagcctctaaatgctggaaaaggcaaagaaatgcattctttcactgagccttcaaaaggaaaacaccttggctaacatctgatttttgcctaatgagacccattttggacttctgactttcaaaattttatcataataagtggtatatcttaagccaccacatttgtagtaattgttacaatagcaaaaggaaactattgtatgaaattcttccatacattttcagtttaaaatttcaaaactgatagattatctaatttttatttttaaatagaaataattaccatctattataccctgattttcattaaagaagcacttttaagttttaactttttatttttaaataatcaaatttatagaaaacttacaagaatagtacaaagaattcccacatacaatatatccagattcgccaatttttaacattttctcgtatttgtttattattctctctctccctttctctctctctctctctatatatatatatgcacaaaaatgcatgcagttattattgaaaaaaattaacataaaaacaattacaaagggcatgatctcagaataaagcaaaatcccttacgttcaataacttcacaatatggttcttacattttccttgttttatcatggaccagtaaaaacctaattatagaaaagcactggttcatggacaagcatgctgaaaacactgtcttaataaagtcttacttatacatccttatgcttactgtactagccagttctcacattgctataaagaactacctgagactgggtaattataaagaaaagaggtttaagtggctcacaatcttgcaggttgtacaggaagcatgactgggaggcctcaggagacacaattatgatggaaggcaaaggggaagcaggctcctctaacattggagattaaaattcgacatgaaatttgggcaggaacacaaatacaaaccatatcacttactcttaaatgactcattttcaggaaaaccttatattcccacactagagtttattcctcaagtttgagtttctcttgaaacctgaacttcttgatgtccccgataacattggcatactctctatcaagttccttgagggcaggagccatatttttgtctgccgtataatcttcttaggacagaagctggcgcagagcacatactctttaaaaatgtgttcactatgttaaatgattgacaaagaactgaaaaagtagagaatgtagagttcattaaaaaaattcttataattctaaaactgtatttcatattgcctcagatttatacttctaattctaatttgcccaaaaaaagtgtccaaagaaaatgcttactttaattttaagtctaacaacatgtaagccttagaattataaaaagcaaatttggagctcataacctttgactcaaaatggaaaggtgaactaggatttattgaaaaggcaccattttttggtcctttatttgtgatctaggattatctagttaaaccccccacccagtggatggagaggatacagttctgtctctttccctaatctttatcagatagctattttatttcattaaaaaattaatctattgtatctgaacatgcctgtgaattatgctttatttaaaaccctgtgattattctcacattttttctcccaagcctaatcaaaaagaagcttcaactccttacttgggcattctgattcatataaaattcctttaagtgagctggcctgggtacattgttttttccttgttgattatattatgttggtgtaaaagtgaaaacaaaaacaaaacaaaacaaacaaaaaccaaataaacagcaattactttagcaccaacctaataaaataacactatatatatattcttatgaccacgttggtgtctcctgaaatgaaaagtggttcatttaagtgtagaatcttaattgcttagttgtttaggtcaatgtgttgtctttgttggttttacttgaattatatggttaattttattcatcattaactagtcttgtcctgaaaatacctgactaaagttgtattcctttcttctaaacagctaagacactcattagcattactgaacatgttctcacttttttgtaatttattttggtcaaagggaagatcaattacattttgaaaatactattcacgtcgttacaaactttacaatcaattcaagcagggaagatgtacattccttatattataatctaggtagcatctaaggtagtgataaatgtcttactcagaataaaaacacacatttatttcttttctaacctacaaattacttgtgtaactcaatattttaacttgcttccaatatttaaaaagtagatgatttaaggtgaatcagtgaattcattcctcttgactttaaatgtgccttcatcatatgcattccaaagaaaaattatctaatctatgaagatgtattataatcaccaaataatctactgaatacatttataactgcaattttatgcattgtgaagcactgtaattgcttaatattgctaactctactctaatgccttgcaaaaagaaggtgcaaaactattcagagtatatactgactccagagaagcaaatatactggggagacagaaagaatgaggcagtattttgaatgcaaaaactagaaaatggcagatttctagttcctaaaccctttatattggttacagagtttgttgaggtagaaataggaagtgaaaatgtttctgtggaaggggtaataaaatactgttgagttttcattttctattttaaaatttctttcttgtcagtagttgtactgagatggaaacaaccgaggtctgagccatttgagagaatgacatgcagaaagctgagtgcaataggtgctcaaaaatgtacaaaatgactggtttctggaaatcattgctttattttgctgaatatctggttaggcaaatgaagggtattccctattctccacactagctgctttatgaggttggtctgtatctttgagttatgaatgcatgtgtttgctagataactgtagcagaatggtcaccatatttagggggcaaaataagaaaagtttatggtaaaattgatttttgaacatggtgatgcttgaaccttaaatgtgtgcattcctgtctatctttaataaatgagctaatctaagtatatgtgacttcttatgacacatgatgttttttttcttttctttctttttggaaactgagttatgctctatagcccaggctggagtgcagtggcatgatcttggttcactgtaacctctacctcccgggttcaagcgattctcttgcctcagcctcctgagtagctgggattacaggcgcctgccaccatgcctggctaatttttgtatttttagtagagacagggtttcaccatgttggccaggctagtctcaaactcctgatctcagacgatccgcctgcctcagccttacaaagtgccggaattacaggtgtgagccaccacgcccggccgatacatgatatttcaaagacaaaatacattgattcactatgagctgtaagatgatgttacagataattagaacttgagggacaaagaaaacatatcaatagggttgttttcatcttacttttcctgctattctcccagttagtatatggtaaacacttgatgtcatcattgaaagaacgaataaataaatgatgcaggaattgcgaattgagtgttgcacataactgagaggaaaagattcatattgtaagacacatatatgggagagaagatcaaacataaaagctgagtaaaaaaagtcaaggaggtagactgggaaaaatattatctcgaagacagtgagaagaaagttattttatgggacctgttttgcattgaaccgagcacctaacataggcagaaattgagattgtgtattggagccacaaaggaaaacacctaggttagttgtgcatactctaatgtgagaccttgaaatagacatcctggatccaagccagacatgatctccaaatttatagatttttactattttccaaaaaatgtatttatcaacttcacatgtaatatctcattcattctttacaaccctgagataggtattatgttatagccaatctttttcagagggaaagttgtgatagggaaagagtaaataatataccctgggctcccacagctgagagtggtggaaagtaggatagaacccaggcgatgctctttgaattgttgttcttaacctttagaaagatctccagaataagaaggagttaagggttatggcttctcactacttcagatgaatttttgagaaaattgtgggaggagagagatgggtggaaatatctcaaaaaggtgtgtgggcctgcaggaaaactagtgcttccatcagcgagtctcagcaggtacgagagcagcagtacaatctgtgtgggtacagattctccagacatcaggagagatggccttgaaccttcttcattatgaggctgggtaggtacaaccctgactgtggtcaagaggcaggctgccacctcatgtcagggcatgatggcatcaagagaagactgacattcagtggttggagctctgtggggaaaaaagaaaaaaatccagtaacccctttaaaatataactaaatgtcagttatacccttaaatattccagagagtatcagtacctagatttaaagtgctgaattcaatcatttctgcatcatccagctttataacaaaagcttataggttttatatacttcagaggatagtctggtaaccacagaaagacaatttcttcccaacatgttatttgcctgaaagggctttatcccccaaggatattatgctaggcagtcatagacaatacattaaatagaaatcgagacactggacactaagttgtactcggttactaataggcagctttgcagtaaagtactcaattgcttttttttagatttttttataattggactcatcgctttcaatttaaaggtacttctggaatagatatctgaaaaaaaaaattgaaaatgtaagtaagatacctttaaaaataagtttatattttcccgttttttacatactctgacatgtatataataagtgctcaataaacggtaactattatgctttctacattcaacttttaaaataatcagtttttggtttctttgctcagatacttcaagctactctagtgaaatacctttgctccccaagtcactagatggaagtgtgtcatgctgggtaccaaggagtgaggctgggtttctacggctttgtctcaatgaacaggctttgtctctaggctggaacttctctttactgccctaggcagtagaatgaagacagaagtgaaagcgatgaatccttgccaataattttgtcagacctcatgttctcttgtcttttaaaataatcagtcgtacagcctctgaaatgaaatggatggtagggtttgaagtcgacacaacagaaaaagagaaggttgtgtggatttacatgggtattttatgcagacgtgcatgtgtttgcttgatttatttggcattccaggttatctgccttctgcagggagcatggttctcttggggagtatcctccctcatctgtatggttcttatgaagctggaagggcaataccctttcatggtaaagagcacatggctgtgaggtggattcataaccaggtgttaatacataccgtgtgaccttgggcaacttacttaacgtctttgtgcaccaggagcttcattttaaaatggagataatacagtaccttccttattgagtcatttgtttagcctggatttccctcaaaagtagagcctaagataagggattgggtgcaggtggtttgcactgcaaaggaatctcaagaagtggaagcatagaacgagtgaaacagggagggagggaaacctaatccaaggttttgtatccaagctgttcatggcagcggacactgggtcttgaccttgttgcaggtcctttgaggactgtgcagactgcattatagaattgtctccaagggatcaaggaggggaggagtatttacataaaacctcccattctgtgttgggcaagattgacccattaaagtgttccctctcttacatacgtaggtttgcacatgtgtaccagaatatttccataggagactctcccagctctgatacagaagcccaggatagaagttactgttagagacaagatgttgtcatgttatatctgatagctgccaccaactggctggagtaaaagaaagaggacttggagatttgacaggagatgttgataaaggattaaatggaaaaaaaatatgtgcaaaacttctaggccattgtctggctcagagtatgtactcaattcatgttaactagcaagcatgtgcacttttctgggcagatatatacataaatttatatgtataatcatatatatataattatgtttttacatttccttctcctgttatatcatgcatatattacgtcttaggataaaattgtcaaagcttcacttgaccatgttccaggaacaatactgacagtttatcactcctatatcttcacagaagggagaattaattgtaacttgagcaatgtccagagatttgctagacttgcaagcaagattatccagggaagagaagagttaacaagttgctatggacccaaagttgctaatcagtacatgtgtccgaacaggatctcttcctaacctccatacacacacagactctcacacacacaaatgggtgcacacgcacagagttgagctaacaacaagttttagagagtatgagtcgtttctcagaaaagttttatgactgctttaacccacaaacaaggcaagcaatttagactgacatttagacctccttattttcttgatttccaatttcttcactgggaacactgaacttttcctaatcattgtggataatgaattagtaagcttagttttaggtcattcatgatttcttttcttaatctataattgaaaaattacttcctttttgtctttgttttttcctttgatgcttcctcattgtatttaaatttttatttatttatttattttatttcattttatttttgagatggagtctctctgtgtcgcccaggctggcgtgcagtggcgctatctcggctcactgcaagctctgcctcctgggttcacgccattctcctccctcagcctcctgagtagctgggactgcaggcgcccaccaccacacctggctgatttttttgtatttttagtagagacggggtttcaccgtgttagccaggatggtctcaatctcctgacctcgtgatctgcccacctcggcctcccaaagtgctaggattacaggcatgagccactgtgcccggcctaaatttttatgtcttatgctgataaaatatgtagaagcatataggcagatgttcagcaagatgtctgtaagtgaggacctttttaaagtctgtctttcttacagaagaccaaggaatttgatatatcatctgaggaagtaagtaagcataaggaaaataaaatttttagtaaaagtagaaatgcaaatgaccatattcttttttttgactcccaaatttttcaggtggtcagaaggtcattttaaacattttaaatttatttttaaattttgtaggttgtgtgtacattttctgggctgtctagtgagtgttaaacatatgctttataaaattatcaaaagccgaactattgatatacattttgacagatcctttttggtttgttaaattaaacattttgactctttcgtgtgttttcttgaaaatgagagcattggttcagtttttgaaaatctcaaatgtaatgagattggttcccagcagaagtggtgggtaagaaaaaaattaagcttgtcaagtcattttatgaaagatgcagtaagggagagttgggtaggaggactattcagagctgaataaaatcagctgcagcatctgataaggcatttcaaatgtttgtggttttatgctaaatgctaaagagatcaggtgtctaccccataatggatttacctaggctcctcacagtgtttttaactacagcagtgatcatgaatggtcatatatctaagcgtaaatttaagacttgggaagtttgcgtctggtgttaagagtgacttactgtaaataaggactggctgcccttgaacatttttagagcatgtgtgaatctggtgttaaaactagcaaaagtcattgcccgtttttcctttgcaagtggaaaaatttacagtatctctcttgggtctcttgagctatgcggagatgcgcaaatctcagttgtagtgagagccatacactggctttattagtcttatgggaaccagaatcagcttcactgactgggagatttgctcattttagaaaagtacatggacttttgtatttaggataccctatattatcttaattgtgactcttttaacgtacttattgcttaattcatgggagtttcttctcagtttttatcttcttatctctattgcttggatttgaagatacagcaattaggacaaaatgactgaccttcttccccagggtcagcaaggaaaaacaatgccatccagtgaaatatttgcattctattaaaacaatgatgatctagattatttaaaatagtaacaataataactaatataatgtctcattttaaataaggtggtattttccaatagattttatacactaatatatttaacttatagttattcatatttattacatgaatatcgtaggcaagatgctgagaaaaaagcaagtagagaccttgccttaaagatacttatagtctgatatggtcaatgagacagtttaaaaatagccacatacccaaaggaaatgcatatatatgttcaccaaatgccataaattaaatattcacagcatttactccatgatagtaaaaaactagaattactcacacatccatcaacataaaatgaattactaaactggcatagttgcatgatagactacattatagccataagaataaataaatttcagccatacccaataacatcgaggaatcccaaacttgttatgttgagtggaagaaggcagatacaaaacagcataagctgtatgattttatttatgccaagaagagagtaaaacatttatgtgctgctggaattcagtaaagagttaagtgttgagaggtgcagtgactgggagaggataggagggggctctctggcatgctggccatgttctctttctttgaaaggtgttctccgtgttcagtttataaaaatgtattaactttgcatgtatgatttgtgaatttctctgtataatatacttaactgaatttttaaagtaagcagtatcattaaatagaataagaaaagacctttgtggataaaatcttttgtaagaaactgggctgtatctaccatgtgctactaccttagttttctttttgtaaagtttttttttaattaaaaaaaaattcatttgccttagttttctggagtaattgggaggatttgaagatctggagatagagacagtcctggaataagaaagcgtataaaccaaagtaaaagggtgggaaagtattattgagtaacagactgaatggactttcaagtacttgaagagaagttggaaaagtacaaagaggaaagtattgtgttaggtttcagccagacaataaaatgttttaaactatcatggaatatggtttctatttttttctttgggtgatgggaattgatgaaaaattttgcactatggaatggcatcattaagattagatatttgaatatctggcaagtgagcttaggggatggattgaaaggcagagagactgaaggaggaaagatttgaccatcttttctctgcagtattacagaggattgtcacgtgggtgtgcaacagatgacaatcagcagtgggacagtgactggtgcctaaagtgtgctcaataaatatttactaaatgaataataatgtgaagcaataaacaaaataagaggatttttgcatttgactctgtaaattagcattcttaagcaataagtttgcgttttcaagtggttcatcataagcagaatctaggttttgtttttgcaaggtaatgccacttaaaattgggactggagtacttggtaaagtctttcataatctgtatgtgatattcagatcattgaatcttatctgtttggaatccagattgtgtataggattcaataataggccacgttatactgtctttctgccaattccttcacaaggccctctgaagtaaaatataaactttcctccggtaaaatattgtacctctttcttggttattatcctggatagaagatctacagttatcatatcctttcgagtactttggttaaaaattattgacattataattcttcagtagttcttgaactgaaagttggtaattccaacttttttagaaatcaggtcaatggtagtaagtgctatgtctgtgttttccctttgaattctggcttactttttaggatttggtgtcagtttttaaggaattcatataggtattgaattatgtggtttcactattcttagttgtgattactgggaagaactttggcacacctggtggtaattggctatggtcatttgtctctgagaatggttagggggatgctacagctaccagatccaagtaaggatgtgaggcaggtggaacacagacaatttatcagcaaagtccgtgggtggaaaggatgcctggatcatctaattcttttgagctagtgtttgctgaactgaatctagtagataattatcttcacctttgctttatactcctcgacacagcttaattgtaagagaatgaagaagatagatagaatgtctagctgatttgttacatattggtgaacaacttcaattttagctcctattttaaactcttccatcctttccttctgtcatcacttgcccacttccaatccaacttccacattctcatgaatattctcttttaaaaattgtattttattggccgggtgcggtggctcacgcctgtaatcccagcactttgagagcccaaggtgggcggataacaaggtcaggagatcgagaacatcctggccaacatggtgaaaccccacctctaccaaaatacacaaaattagctgggcgtggtggtgcgtgtgtgtagtcccagctacgagggaggctgaggcaggggaattgcttgaacctgggaagtggatgttgcagtgagccaggattgggccactgcactccagcctggcgacagagcaagactccatctcaaaaaaaaaaaaaaaaattactttattatgccacttatctgctgaaaaatttgatggaacaatttgggaggcattaaccattttaactggcttttagtaagtgttaatggtttggtaagtttttttgattcaacactgagaaaaatccattactaatggaaagctcagaaataacatgaccctaaaaagattttagcttagttttgttttgttttgctgattatattttaaactatccactcaatgtcaaggtcttcagtagtgctaatgaattagttatctctgaaacgcatcctggagttcattgtaaataaatactgttgcaatttaaatattgattcaggaataagtgcttgagattgcaaaatatattttttaaaagaatgctgttatttttgtttctttatggtgaataaaaaaagcttttgagtttgaatttactcatatgagagctaaaaacttttacaatacatccccccaagaaaatatattcagaatttaaaaagggaacacagatattagaagaaatatcagattcagtccagattaatcacagaatgaatcagataactattctttcacaaatcatgctatttctgaaatctaattattattaatgccaacatgccatatttttaatggaaattcttttaacattttaaaaaatcttccatcatccatacaataaacccataaatgtggaagcatttttaacatgccattatttagaatgttttaataataaaaacatctgaaatcaagttttacttattctttcctgtaacagagagctgacatataactttaaaagatatttgccatgcgggaattggggatgttgaatcaaagaatattcttagattgtatataatctcttttataaaaaaagtatatcttgaattcatatttttgctttttcaaggtagattttgctctttcttttggcatctatttttcttttgcaaaatgaaagaccgcaaaatatttgcaagtcatggtttcataagatatgattataaaaagataagcaatgcaaatcctatgcatcttgttttccgtacctttttaaaaattttcttttgcctttacagatttactttcttacactccctctaaaaatattttctgtttaagaaggggaaaaaaatggcttgtgacaatttgcataatatgttaatgtggatgtgcatctagacatctggatggcattttaatatctcattctcattcaaggaattagacctcacacagatggtagagacaattttaagagcaatgttgtaaacaaataaggcgtccaggaaaccaaacacactccaagataggctttgccgccaaagaagctttttagtgagatgttttgactacaagattgtacagcccttatcagtctctgacaaaaggagagggaccagcaggcagttttcctatgcaaaagaaaagaacaaaaaatgtgccaccagtcatgaattttcaattttgaacattttaaatattaaatatattttatacacatatacagaatatatgtatgtgtatatatatgcatgcattcatgtgtacatataacatatacatgtgtgtatgtacatacatacaagcatatattttaataaagtagacctatacaatttaacaataagttgacctcttcctcccttctgttcttagaaataactggagtcaaacctctgcatattaaaaacacaggactctggaattgtttggtctacgtttaaaacgcaatccaccattaactagctttgttatttgggcaggtgactcattctcttgtatgtgttttgtcatctgggataataatccttgtgtcacagcgttgacaaaaacattaaatgcattaattacacatcaaacgtttagcacgtgccaatgcataggtagcactcaatgcatgttagtagttatcattgtttaatttttactactttttactttgctttatttttgaatctggccatctctaacacaaaaacatttgacttgttcttttacgtagtaagaaaagatttctgggtctcctgggcttgtgacaaggacccagtctctggattcagacagactgatcgttacacttgagtatatctcataccaactagactgtcatgaaaactctgtcagagtcagcttgcttatgtagcagaggaagcacagttccgaattcactggattattttgcccatgtgacaatgcacatgaagtaaatgcttttggatgtgcctatttttaggtcacatgtctttttactgagatttgcatggtgacttttacccaaaggattgcacatccagcaaccatatttctcctttctctatttctctgatactcattgattaatttgaacgaattaagatttgggattctgaagtgtttggctaagcttttaagataaggatgttgcatttgacgagctcgctgtcatgtttgtccttaattatgccaaaagaagtaacagtttctcaggacagacagccagaaaaggagttagaggggtgaacatccatctagaagagagagaagacactcagcatggaacagagaaaagacagagtgccttttcttgggttccatataacttccttttcttcaattccatggcacatcttagattcattgaaattgacttttgtatgcatcttgtatgtgataggtttctttcatatagctaaactatcccagattaagatgacaagtaactagatcattggtgggacggtgtattcagttagcctatgttgcctatagaacaccagtgagcattagcagattgcatactgtaaatccattttgaagaccacatctattgtgaaatttggaaatgaactgacaaaccagggaatgaaaagagcagggatggcaaatctttggtatacccttgacagacatcactaatcaatcatagcttcttttcccttgaatacagagaaagtcttggaatgcttttcattgaatgatgtcatgaaggcactcaatttcattaagagaagtgtgggatgtagtatgagaaataagtcaaagcaagttgtttaggactaaccctgggaataactttctaaatgggctatatattccatgtgatacatagggcaagtatagtgtcttaaaggagatgtacaaaatgaacacaaaggatgcaaaaaatgttttacattgttcatgtttttaagcaactaagtgagatctgaatgaaaaggcaagttcataaaagcaaaacaaaacaagacacatcatattttattaggggccaagtaaatttaacagacaatgagagcaataagatgtaagaggtcatgtgccctgaggacttggaggctggccagggctgataggttgtggggagagcattataaagctgtgcatgggcaccaatgagcaagacaagttgtctggagcagacattcataccggaaaacaatgggaaatagaattgacggaccaaacaggaaataagctgtgaaaatccttgaatccatactaagaaatgagaacatctgtaggcaatggagaacatttggagagttcaaatatgtaattgtggatattagaacggagggggatcctaagagatcagttggcctagcccattgccttaatgcaggtgtgttcatattattttacttgatagaaatagctgattatttatgctcaaaacggaatttctcatgatagtaaggggagaagagatggcttagttctttattgaagtttatatgattgtattagtatattgtagtttattgcatatataagatcagtatacacttacagcagggtttctcaacctcagcacttttgccattttggactggaaattctttttttgaggcaagaggagtctgaattataggatgtttagaagcttccctggtctctgtctctagatgccagtagttacctgtacctctagttgtgacagccaaaagtgcatctagatgttgctaaatgtcctctgtgggtcaagatgcttttttcagacattactaaaggtcctctgtacattacagttatccctggtggagaatcactgacttggagcaagaatttcttttttaaaattgaaatagagaaagcacttgcctagagttcaaaacagaatattgacatataattaggtagtgatttgcaggataagttagagaaggtagaaatgggaggcaatgagaatatacaaaaatgatcatgtcagtctagaaatgaatagatgggcttataagctagagctctgtggctctgatagtaatagaggcactgatagtaatagaatagcagcagttgtaatggtagtagaagcagcattaattgtgcagtcataaaagtacttctcacaattacctttagaaatgtttgctactatggttatccccatactgccgatgaggaagctgaggtttagtggtcacccatggcaatggttgggattccaactcctatctgtcttgcttccaacactttctattgcttcatctctgaaacaggttttgcattcaagtggttgacaggaaaaagcagtctgaatggtcacactctctgttgtttgttaaattatactatccttcccaaaatctcactctctttatttcgagatgtgaacaaaaattgttccccctaagaacagcataggctggtacaacttagagccccatctgctctggtttgttggataccgccacattacattaattagtagagagagagcattcacatgcataatgtgcccatttttcaaaagcatattttacatggttgtgtcttttccttaaaaattcattacaaagataagagtgtgtttatcacataaatacagccaaattatggcataagggagctttaagaaaatagataaaagaagttataaaattttagacattataaaatatttgttactgatattatgctatgtttttcatgctatcttaaagactttttatagatattattctatgctcacaactagattttgcaattccagcatgcccatgaatggaggaaacctccagttagcttgaactaattagcttcttttgtgaaatgtccaagctgctaatttctgtccttttattttaaaatagaacaccttttgtttatttctctgagacacagatttctcctacaactccaagtaggataaataaaaggagaaaaactccagaaagaactgtttggagttggttagaagattgtccagatgatctttattttaatgttgggaaaatatagatgcctatcttggaatcagcaaataaattatactcatattaaatttcattctaaatttctgactttacggtttattttatatatataatatatataaataaaattttatatatgtatatcagtaaacatatgaaaccatgcatagtacataaaaactaggttcaagtaggaactcagtttactttgtttctctgagctgtagtttctcaatatgtgaggtgggaataaaataggaacttcacaggctgttaaatgtgccaatgagagaatgtatataaaatgcttacacaatgtctagcacaaactatattacatatggtgactctcctatggtaacagctatttaccaatctctgcagttgccttaatggaattgtaacaaaactggacatgaaaggctattgtaatttcagcccaatgcctaacattcgtggaaaaacatttcagcttttctatgcatagcatatttttctccaccaaacatctgtgaaggtgattttcatttaactatttaatgggtcaataacctcccttctattttcatattccatctacatcatcaaaaaagaaattttaattaccctttggataaataataggaataaaatggcatgaatcaaaacacagggtttatgcatattctctatgaaaaactgcactaaaatgttgttaataaattttacacccattaaggaagtgtgtgagtctacctggtagaattaaagtatagttgaaactattgctgtgggatgaaattatgctcactttaatacttccgatatattttctttgtactagaaaaaaaacagatattttaaaaatgccgcatttatctttatctctctgtgcacatgaggatttcataccttattttcacttgagtttctttgaacaatgaaaactttggaggagtgtatgctatattaggaatttattagatttcatcaaatggcaggtggttatgaattttgtttccaaaaaggagacctgagggatattccatattaagggttttattcccttttggtggaaacatgcaaatcatttgtttttgctaaaaaaatctatgaaacatttctttcattatttcccttgggaatggcagctcgctattattcgtaattgtaaatgcagttgacattttgaagtttatgttcatgggaataagatattttttggacattttagtgatgccaagcccaggaaaatctagttattttttgcaatacacatgtatatacagtatgttaattggagtaacagagatggccatttcaaatttggctctgttattcatctttttttttggaggcaaagagtgttggtaagcgaatttaaccagaagagcagtagattcttttgaaataatgacatagtggaaaataaaaacacatatacaccaagaaacaatttgtgagctaaaacatgattaaatttaatctgttgccataaagtagaaaatgttcgaaacaaggaagactgtgtactttcagctaaactgaaaataaaatgacaacaaaaaagcaggactctccacaattcaagacttgctgcttctatgatgccacactcttgattatttacccctgctatatgaatgagtgagtgttaacactgatgtattacacctaaaagactggaagagcatctttgattccattccagtccaccacgtcgtgctagaaccaggacatctgccctccatagtaaatctccataaaattttactgaggagaaaagaatcctctacatatgaggtagagatgtgaatcagacaagtccttaaatgcatgattcatctaactgcctctgaataattggttaacttcagccacctgtatatataagcatgtaggtgttcaatgccaccacacactctccacaaacaacaactgcccagggttgccaaaagataattgcatggtggcaaaatgtgctgcttgaacagtgccaacgtaaaggataaaaaaccaggaaccacactgtaaggaagtgaagactgtattatactaggaattccaccttagactccaatctgaccatctgaatctgaatcggactatagtggatggactgatgctaccctgcagccttacttccttaactttgtttccccaggccctaatataaaccccaggcaaacaggcatacagctgtatgcatttggcagattactatccatttcattgttcagttgttctggaaaggcaccgaatgcaactgaagcctggaaacattaggaaaaatggtactgttcctgatatccttgtttcttcctaaatgacagttgaaggtaactttcctttgtacagttctgcctgccgttagcaattttccaaaattaaataccatattttgtgtttgataggcacagctgtgtctgttaccaagggcaagcccacctgcacagcactctgtgttcatttatgtactgagaactttatttagaacccagttttacagaaaaaaatcaagttgggtgaaccaattttgagggcagtgaattcttgaattctcctttggggttatgaaaagggaaaatttatttgcttctgatagaagtaatataggcctagtggatatcttagcagtgcagaaaataggatgtaccatctacctatattaactgtgtgtgcattaatttctgaatctggttttaaaaactccattgtgttctaaacctgatagtttggaaagttgtaagaccgagtctagagactcatgttaaaattctaaattttggtgcaagaggaatagctctcgtttttgcccaagccactttatttttcaatgtcttcattattttatctgccaattgaacccatcagagtagaggaattcccagaattatttgaagctctgaaagttctacaatttgggctagagaaatggaatatatgaattctaccaattaagacaccaactcttcaggcaaaattaatttaatacttggggtatgatgggttgaccctgaatatttacaagatactaacactggaaaatgttagtgtgtcacatgggacaagagtctgttaaggtgttctacaagaatgggaggttgtgtggttaaacatttggcatgcttggcacattttttccctcttcctggagagttatagtttgcattcacatttaaaggatctgagaaatcctgcagaaaagaaaattatgtagctttgtttaacccaatgtttcccaaacttagtggactttatgcattcgacatctttcctttgctcttccaaattagtcttcagccttccctaccctgctctgtgttcatgaaactgacgtgtgtgaattctaacttggagttttctttctactggctcctggttgtttggctgtcaagagaaacttctggaggaatgacggcaggaaaaggtatctgaggaagagagaagtaaggtgcttgtttccctggcttcctctctccaagctgactgcatctgcccaccagaggtcacatttcttgtcacgtgttctctccacacattttccttccagattcctgcaaactcttatttccctccatcctttcaggcatagtctgtaggttactgccttccttttcaattttcctataacctgcccacatctattcaaatagtgcttgttttagacattcctcaaattaccaaatttgagtgtcatcttttttctgcaggaagtctgagtgatatatatacacatggtatcttttttaccttgctgatgcatgccatttttatggaaaagcaaactgctatatttaaagtgaggaaaattattttggtatcaaagtgtctgaaacactgttgttgcttgacttgctaactaattattgtccgaacccttctctatgcgtagatatatcctaaaaccaagtcagtgaaaacaggtccttctgagtttattttaccattgtcagctttctttttgctctcagtgggcccatgagtgataactatctccacagttagacatcagtaagccatgccatttacctgatttgtcaacagacatttgtgaagcatgtttgtgtgtgtgtggcattgaactagatgctgagaataaaaaggtagagaaagattaacatgattcccagggtatccaaagcagcctgtatgcccaccaatacaacaataataaaatgtgaataccgataataaatgttataatacctaacacttacatagctctgagtacaataagacatttatatagtttgagtgctttatctgtattaactcattcaatcttcccaacaaccttatgaaaagctactgttaattatctctatttgacaaataaaaagatgacaaagtcaggctagatgagtctgttcatgttcacatgtaattaagtggtgggagtggatttttagtccatgtagtctggtcacagagaaagtataattaaaaaatgacaaggagatgtgcaataggagggcttggctcaattgagatccaaagggcaaaaaagtaaagagagaagagtgtttcagaagggaagaacttgtgcaaagatactcttaaattgtcttgacgctgtttcatcagggcagacgacatacaaaaaggccagtcaaaatggagttgttaagaggtggtctatacagatacatcagttaagtacacgcacttatattttctttgctgtgctattcacgataacaaagacatgaactcaacctaggtatccattagtggtggattggataaagaaaatgtggtacatacaggtaccaaggaacactatgcagtcataataaagaatcaaattatgtccttttaagcaacatggattaagctgaagtccataatcgtaagtgaattaatgcagaaacagaaaatcaaataccacatgttctcactaatgaataagagctggacattgagtttacatggacatgtagatggaagcagtagacaccggggactaaaagaggggagagagaggtggggaagggttgaaaaactacctactggatcctatgctaactacctagatgacaggatccatacccccaaactcaggattatgcaatatacctatgtaacaaacctgcacctgtatccccccatatctaaaataaacactaaaatttaattaaaaaataaattaaaaaaatgaaaaaatatatcagtcattgactttattgccctgataacgtagcaatggcaacttcacatgttgacttaaaactttgattgtcaacctttggtgtttgcaggatacttaaaaaaactggattatttaatgacactcttgaaggaattaaagtataaaaaagttatagaatattgaaaacatatttccatacttattgaattagttgtttttaatttgaggagaaccaaaaaactctttactgtcctgaccatattctctgatacagtaataatgcaaatttcttacaatttctggcatatagggcatctttctttaacactagcatgcctttacacgaagccttatcacttctttgcagcaacttgttccacaactcactgagtgtgcattgttctgccagagacatcactgtaagagtatgtcgtgtcaaatgtagcaaaaattgtttttatatggtatcagttataaagtgcttttgaggactgtttcttgcttccctgagaatgctgacaagcagagtaaactaagtgctccaatttctaggttcggaaaattacccattttagtcagcttctgcagggccttctaggacagggcacagcaaaaacaccacttctgaacaccccaatcccctggaccacatctagaggactacagaaggtaagagggagaattctcaaagttgtagttatccataatcctaccccttcttatcaagaggaggagaaaggcattgaactctctctcatccctgccttttacagatggttctggaatatggacaaaaggaaaggagaaaaatggctaaggtgccagaggaaattcccaaagcagcctgcattccctcataaatcaaatgtataacatggaactcacctgacacttatatcatcttttcagtgctccaatggtcatacccacaaagaaaagggatccaggcaacaagaggatggagggtagattggtcttggacccggagtttaggtcaaggtgatgttgaggactttgagacaagagtgtacattttagttattgaattacatcacagaaataatcacaccagcctatatttttcaccaaaaatgaatgaaaggaaaattatatctgttctaggcagatggaggtcaaaggctgctctagatccagaatcttaacctatatcaagattcatgttcgtgcatagctttattgaaactcttggctcaaattgacttacttccctaatgtcaaaatttgagagcccatttgtaaaatggcttagtgtaatgcactgtggatgatcaatcaagagtcactagtctgtgttcctattggagaaaataatattgcttttctgtttacatctgtgtaagaaatttcacttagacatgaatgctaagaaaaactacaatcctttccaagcaatagacatatccttttatgtttcataaaattatctcttcatctgggatagtagaagtttttattcaggcttgctttatgctttctcaaaactacggttatgtttaacatatttgctttatttctagtccatgcctttgtcatattttatgttaacattttgtgttgaactatctagactatctacctttatctatgtatgtatgtatctatctatctgtctgtctgtctgtctgtctgtctgtctgtctattttattataccaaaatcttcttgcaagtgttgatgtctaaataaatttgataatgtttattagataaccttcatttgtaattgatttgctcatctgttatccatagaacttggaagcgtatttgtagataaaagttacagatgtatagatacattgatagataatgcagttatataaaagtatatatattaaattttaaccatataaatatgtaaccagacatatacagattttagtaaacttcttttgactttttatttttaaatgtgaacaaaaatagttggtgataatggtgtctgaatctgtggtctcaattataatctcacaactccaagttcccaacacagttggaaacatcatttatctaccgaattcttctgttggtgtttttctcccagggaagcagagaaaataaagagttctctgcttttaatgtttctgctttttatatttgtcacagtgctctgcttttagcaaacaccctgatacactaaaagtttgctttttatttaaccttaaaaatttctttggtaagcttgtcctaaaaacttgacccagaataatacaaatgccattcaaacatctatttgtgcatctctttttttttcacttcaactgaaaatatactttctctaaaatgtacatttgcaataggaatatattactgatggtggaaataaatttccatgtaaattcatattgtccttctacatagtgaaatgacagctttttggaagtcacgtgcacacagctccccagggaatctcacatctattatccatttcatgcattgtgaggcttttatggcaatgtccatacccttcattttagatagatctatcagtctctcggtactacccatgcactttggatcactaagactcctcctgagtagatgacatactaatatgtgactagtaattgaatttttgacatatgcaaaaatgttgtaacatagataagagagaaagtgccataaatagatatctaaaagaagggaacagatggcctctttgtgaagatgtttggataaagccaaaaaatgacaaacagatggtttatacgtatggggtaggttgacagtggaacctgaagctggtggggcataatgcacagagctccaacttttcctaaaaaaacctgaagtttggtctataagaggaaagtattacagacttcataaaaacatagacaattgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtctcgttgatctgtctgatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttgtctcttttgatctttgttggtttaaagtctgttttatcagagacgtggattgcaacccctgccattttttgttttccagttgcttggtagatcttcctccatccttttattttgagcctatgtgtgtctctgcacatgagatgagtttcttgaatacagcacactgatgggtcttgactaaccctatttgccagtctgtgtcttttaactggagcatttagtccatttacatttaaagttaatattgttatgtgtgaagttgatcctgtcattatgatgttagctggttactttgctcgttagttgatgcagtttcttcctagcctcgatggtctttacaatttggcatgattttgcagtggctggtaccggttgttcctttccatgtttagtgcttccttcaggagcacttttagggcaggcctggtggtgacaaaatctctcagcatttgcttgtctgtaaagtattttatttctccttcacttatgaagcttagtttggctggatatgaaattctgggttgaaaattcttttctttaagagtgttgaatattggcccccactctcttctggcttgtagagtttctgccgagagatctgctgttagtctgatgggcttccctttgtgggtaaccggacctttctctctggccgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccgtcactttcaggtacactaatcagatgtagatttggtcttttcacatagtcccatatttcttggaggctttgtttgtttctttttattcttttttctctaaacttcccttttcgcttcatttcattcatttcatcttccatcactgataccctttcttctagttgatcgcattggctcctgaggcttctgcattcttcacgtagttctcaagccttggctttcagctccatcagctcctttaagcacttctctgtattggttattctagttatacattcgtctaaatttttttcaaagttttcaacttctttgcctttggtttggatttcctcctgtagcttggagtagtctgatcatctgaagccttcttctcttgactcctcgaagtcattctccgtccagctgtgttccattgctggtgaggagctgcgttcctttggaggaggagaggcgctctgctttttagagtttcgtttttctgctctgttttttccccatctttgtggttttatctacttttggtctttgatgatggtaatgtacagatgggtttttggtgtggatgtcctttctttttgttagttttccttctaacagacaggaccctcagctgcaggtctgttggagtttgctagaggtccactccagaccctgtttgcctgggtaccagccgcagtggctgcagaacagcggattttcatgaaccgcgaatgctgctgtctgatcgttcctctggaagttttgtctcagaggagtacccgctgtttgaggtgtcagtctgcccctactggggggtgcctcccagttaggctgctcgggggtcaggggtcagggacccacttgaggaggcagtctgccagttctcagatctccagctgcatgctgggaacaccactgctctcttcaaagctgtcagacagggacatttaagtctgcagaggttactgctgtctttttgtttgtctgtgccctgcccccagaggtggagcctacagaggcaggcagtatggcacactcaattcatcttcctggaaacctccatttacattttattgttcaatccagaagtaaataacttacattcaactattgagaaaaattttaaatgtgaggactacagggtagataaacttcaaatatctcaactggtacccagctaagttcatgtagacttaggtttaattttttttttttttttttacaatattggctttgccttgttttatttgctttagaaatgaaatcttaagaacgttgaaaatatgctggcttatttctccctatagaaatatattgctagttatttctacttgtataaaatatatagggtttctacttgtataaaatatatagggttttttgttgcttgttggtttgttttttagaacaaatggagtcaatgagctctctcttcttttaggtagcactttccatgttgaataattctcaacacaaggaaacaaacctgttttctttttaaaaataattacacaagcaggtcttgaaaaatttagcttacacagtgcagtattatgtagatttaaatgtgtcctcatcctgcccactgctgtcttatatttattttaaattaccattctattctgatttttttttagtggtagtcattgctatcatttcaacatacgttatattctgtcattttctctggctttacttgtgtatacacgtgtccaaattcatatatatggattttattaaaaccataatttaataattttgtttacatgctttttttctgttaacaatagcttaggttttatacagatatccctctcattttgattaagaactacgtaatatttcctagaatgaaagtaccataatagcttattccattaaaaaatctgttactcaccatgcttcatcatgcatacatgaagatatatatttatggtcatgtgtagaaaaataaaagcagaaatattaagtgaaattaaaaatatataacctttacaagatttctaatagatgctagcaaattgcatttaacaaattattttctctccaagactgtaggaaaatgacataaccccgtcccctaccagaaatgaatatcaaattaatcttgattttacaagtattagtatgcagatataagggttgttagttaataacaacaactgagtataatttgagctgttagaaaattattttcttatatctaaggtaaaattttcccttaatattgatttattggtcttagctctactcttggtatcaaagagaaaatgcttctattttgtttatgtaacaatttttccacatacaaagtagtcacatggtaaaagactgaatagactgctaaagccctacataaagagcaacccatatgttacctgtgtcttctatggttacttgtgtcaaagagatttcaataatatggtgcaaattttaaggggtcacatttatttttcccaagacgtgatctgtgtattcgtgttgccttcacaattcaggcaagaaggttgctacccagggcttttctttatccccatttctcccatcacccccgaccagaaactatattaattacacacgcagatcaaaatcaccaggttttatttcagttctactttacttgccctttggaggccaacctcccttatttccacccatcctttttgtttcttcctagctgctgtcattttcttttcatattttttctattaatctccatatcgttcacggtgtttatcatgctattccattgtaattaatgtctctgggttatgaaagagcaaatttaacttctgtttcacttagatgtgctttatccctgagtaacacgatgcgtgaaaggatggacttggtggatttggaaatggagatgagacccataatgctttgcagcaaatatgcctgattctgaatttgaaaactcttttagtttagattccaattgtatcctaaaataaatttaggttccacagacattttactaagtgtctgctttgggtcaggcatagccccaggaactctcacactgtattgttacgttaacaaaagttattaagtgtatgagagtgaaactgtggaatgaaaactgcatttcgtatcagagagaaaagaaacaacttacattttacatattaaaatataaaaaatccaatattttacatgtgaatcctgtgggatttcatactgcttgtatacattagctcaagtgatattaattgcaatatggtggaatactaatagtttcatttttgcagaagagaaaatcgagtgttacagatgctgacatccttgccactatcctacagctattcagtgacattccagggctaggtttctggtggttttctttttctctggcttccaagagaatggcatattatatcttagttttgattgccttctcccagtagtctccgtaatcaacagaagcagcaactctacttactagtatgcataggtttgtgtttttttaacgaagtaaatatattttattgagtctttccaaaatctttgtaattttccttaataaatcaggaaagaaagcattgtgacttttttttccaatataatcctgtatttccatgaagatggcttctttcagtgtttattttgttaagcacatagtctatacatctttgttaaataaatgaatatggagcttttatttttcataaataattttatgcatggttccaaactgacctgtctgtatatttttatcacctcaagccacaatatattgatagtatttattgagtatccatttgattatagcaccatatttcctgcatatatgtttttattcaatatttgatacattgggagaaaaaaatgaatacattaaaagtaccgactgttttatttcttccaatatatctttttctatactgatatagtttatagctttataaattctaatagctacattctttttcattctcttgataaactcttttgattaaacattttgcaattgttgaacttcatagttgatttttttttttttttttttttttggggagatggagcctctctctgtcgcccaggctggagtgtagtggtgtgtagtgtgatctcggctcactgcaacctctgcctcctgggttcaagcgattctcctgcctcagcctcccgagtagctgggattacaggcccctgccaccacgcctggctgatttttatatttttagtggagacatggtttcaacatactggccaggctggtctggaactgctgacctcaagtgatctgcctgcctcggcctcccaaagtgctgggattataggagtgagccactgcgcccagcctcattgttgattttttaaagcagggactctaagtttgcatgtcaactatagtaaatgcatgttacataccctttttccattttttttttgcttatttttagtttgttatatgaaacctgttattgatataacctcaaaaaacttgcatgtgtctaaagtatgtttacgtatatttacagcagtggtactgtcattaaagattttagggcagagggcagtttgcatccttatagatacaattacaaatatctctgttctttcttttgtaactacaaaatgccttctgaaagtaaaagcatggataatagttctaaaggcactttgattattttttggaatatcattcctgaattgagctgtgtgcggtatcaaagaattgggcttttcattagtcaggatgtttgtcctcaattgtttccttaatgatggttctttcattgctggaatgtcctgtttctcctgatgtatttattagccatgagttgactcattctatttttgaggtatgtttcttctgcaggaataagctacataggtaattaagccatttttctaatttgccttttaaatatacacaatgtgcaacaacccttttttaatactgccacttcaattttgccttttgaaaataccaataatatttttctcaacaatttcttagtttactacagattttctttattgttttatattctattttagtagtcattgcttttttcttttatttatataatcatgcttttttcatgattattaaaaaagtagtttctctagtatggatatttttggcaaattttgttgtttattattttttgtatttcttttatttagatctgacaccccaccctcgttcctcttttactttgttcataattttgaagtctcccactgacacttactactttttctttactatataactatttttttcttttttaatttttattttaggtttggggtgcatgtgcaggttcgttgcagaggtaaacttgtgtcatgggggtttgttgtacagattatttcactatccgggtattaagcctagtaccctgtacagttatttttcatgttattttcttgagtataaaaagtggtaaaatgtactccatttatatgaatattccatgtctttcaactttagtagaatttatgcttattaatagctttcttttcctatatcactggcaatggaataaaaccaaacatctgtttctttgttgctatcagcatatttaggaattgacagaatcatttgattgaaaattctctaaatatgatcacagtactttatggattttcatcttttttaacaacataaatatggattacatttgccttataatcatgtgtttgtgatgcaagcagatataccagtacttagatggttctcaggagagactccatttctcagtctaatactggtataggggaaaggaatttaaactgttttcagaaaaaaaggtcatccataccgcgtgtcatgttctttgcatttattctagttttaagtttctttaatatttaacatggagatgttactacttctctcaccaagttataatagaggatgtttagggttgaataaaataatatatgttaaacattttactttatggtttatatactattagtattatgcttattttatatattgccattatcttatcatgaaataacaaaaatgccggggggggggggtctatcgattttgagttatggtttgctaactgcgttgtcctgaatgatttctctgatcatgaaaaagtacacagtgggtggaattgcaaacatcaattcttctggtagtgtacacaggcttctgtaagttaggaaaatccttcgacagttatggccttcaaattccccttcaagacagctgtacaatagaatattgccgtatttcaattttctccccatgaattgttcacattagtttctcaacctaaaatgtcttttggtgtggtcttatttttaatgtgaactggcttagaggtcagagattaattgccaataatattcctgaaaagagtaggaaactacttttaagtaaaacattgcacttaatccaataggtctttattcttcataaaccaaatgtcctttctgaataatatttttcctactcagttagatattttggtatgtcctgtagatacctcaattttaatatggccaaaaatatctgtcatttcctctcttcaaactatttccctctattattcttaattttgattactatagccattatctacatacttttttgaagcttaaaacctaagaactgacatggacaacttccttttttcattcccacaataaactgttcattaaaacttttgaatcgacttccaaatgcttctcaaatccaacctctcctctcgtctccttgccttttgtcaatactttacttcaggcaaactttatctattgtctggcctatagctgaacatcctgacttgtgtccctactctcagttgttccttagtctttcattcctggacatctcgttaaattctctacatggttcccaaagttacctacccattatatcataatatcatttttaaaggtttaaaaggtttttgatgcaatatcattggctattagagaaaagcaaagtaaagctacaatgacatgccactatacacttactagaatgggaaaagtaaaaccatgctgacaatatcaagtgctggtaaatatgtggaacaactggatctctcctgcattggtggtgggaatgtaaatcgatacatttattctgaaaagcagtttggcagtcttttataaagttaaccatatctttatcacatgacatagaaatcacaatctttagtgtttatctcagagaaatggaaacttacattcacgaaaaaccagaacactaaaatgcataggaactttatttgtaatagccctaatctggaaaaactcaattgtcgttcaatgaatgaatgaataaacaaactgtggtacatcattacaacagaatactactcagaaatgaaaaagaataagctattaatagacacaataacttgaatatatattgaggctaagtgggaaaaaagcctatctcaaaaggttacttactgtgtgattctatttatttaaaagcctaaatatgatgaaatgtagtgatggagaacagaccagtggttattaggggttatggtatgaggaagtggagggttgtgactattaaaagataaatttctttatgttgatagaacagtactctatcttgattgtagtgatacactaatctatatatgtcatggaatttatagaactatatactaagggaagaaaagatgactgaaaagtagatgaaatcacagtatgatctgtagtctagttaatagcatacctatatcaattttttggcttggatgaacttcttcgcttacaagtttctttgggaatctctgtactgttttaaaaacttgtttatcttaaaatatttcaaaataaaatcttattcaagggaaaaaaaataaaggcttctactgattcccaagaccaagagagataaaaatcaaatttttaccaagacatataatatgaatccaagttgtttttaaactctctaatcatcactcttcttcattcttgcaagtagttcatatcttagccattgggaaatcacagctatgcacagaatgccttctttcacctctcattgacaaattcccacttatctttcaatacatgggctaaattcttctttgaggatcttctcaaatctcaagtgctgctcctactctgctgctataacacttcatcatacattttttgagaaattatcacaatccattggttttttttctgtttatgcatcagtttctttctttagacaatcaactggacagatggtatagcactgttccaggttcctctcagaggagacagtattagcctaattactttataagctcaatctaaaactaattttacaaccaagcccaaaataaattaatgttttgtattaattgagctgttgcacttagacttggttaatataaatgtttttattttcttccacccacaaggaatgtctatttttcattgttgtttctgatctccatattcttgccatattagcagaacatcagtgtttcaaatatattttttaaagcaagcttcatggatctaataaacactaatatcatcagtgcttttctatggcccagggaaattctatctagagttacaggacatttttgaatagagttagaaatatatacagttctcttggagtccataacattttatttcccaaatattatgtttgtggaatctaatacttgctgttgtgtgctattataggcacaattttaaaaacatttgttttatatataagctcttgggtcatgatctcaggaagtcattttagattatgttggttttgtatgatagaatcactttctaaaagtgataatagtacaacatgacagacagtggtaattgaccatagaaaacaaaagcagaaaaatatatttgtatgaagcaaagcaaattatgtattaagtttgatgccataattgtaataatatgttgagatgcctactaattctaacctcttattcaacctagtttttaaggattttttcctattctttttatcatcagtaagccaaggtctgttcctccttctgtaatagctttttgttttactatagacagcatagagtaaatgcaaaagttttaatcaatacaattaacatgattcacaaaccttccagtgacatctttgccaaatttcataccctatattacgaagttctgcatgaaaagctttgactgtttttctaatcccattgtatatcctccttttatgtagtacaccccagacttattggccttcttcttgttcctccgacatccaggcttgcactggtttgggaactttagctgttatccctcttcagggtgtaatgcctcaagatttcacacacgactttttctggtttttcagatcttagtttaagtgtcactttcccagagaggccttttctgagtatacaacttaaagtaatcttgtcatagtgtgtgtgccaatgctgtcttataacagctcactagggcttacagtatacctctttccaactatgtattgagtgatgtcatattagtatatttaaatcagtcatgttgggaatgttttcatcacagaaaatggcaaaaactcggcttgctttgttccttttagagagctggttattaaacatttgtcagcataccattgcctatattgcctattaatatgtgactctttatattctttatatttcttgcaacctttaatttctcttctgaaaactctattcatatgcatctatttctagtagagtataagtttgataagaaccaattccctgctgtcttgctagtgcctagaatactgatttccacatcatgaatgtacagtaaatattttttgaatgagtaaattactaggctaacctatctgttattcagttatgatgactttattaatatttaacatccattagttgatttttaaaataaagcatctattcttctatgaatgatttccttaagtaacattggatatatatgtatgctctgttattagtctctttcaattagtcagatgcccatttcaagatagctcgttagatttgctttatcctaacatataaacttcactcagaagagagaactttcaaatccttaaatcatctaagaaatctctccaattctttcatgtcaaggttaataattaaacgtttaatatctctttaagctattaagctagcaataaaaatgcaatattttaacccaatttactcgattaaggaacaatcccagatgtgatttaacatgaagaattgcagtgatctgcagttcattaaaatctgaatactaaaaagagaattttaaacatattatgtaaagacgttcgtttacctcttttccataaagaaatattatcttcattttccttaaagcatgttgattatccttaggtactggatatatctaacatgaattattgcctttttccctgcagagctgtgtactggtagttattaaatagcccattatcaactgaaattcagatgcaggttttattctccttttttctgaccatatttttctgctagtgtttatttatttacttattttcattaaaatgaccatgaccttggtgttaaaatcagtaatgtatacagaaaattcatttggaatgcaatagttataattcagttctgaaaatttatgtttatcaaagtataaaatatttttgttatagctcttttaacttttcctaaagtgatgtgtgagcatgatgtaacgtagcagaggcccaaatttcctttaagaatattgcttagacctcatatcatcttctagcctcactataagcaaattgagaactgcaatcatttgatggttttaggacttaacaagaaaagaaaatactaaaaatcagatgtcctacactgagagttttatcttctaaagaattctttcatcttttatgttaaggacctccaaagtatgatgttgttaacgtgaacacatatgtgcacaaatgagagctgcgttacagcgctgagaaactacatgtggatcctgagaccaagtttagctgaaaaagtacatctgtgagcaaacggcattgaattttattattaagcatctgatgaagtggttcaccttttgtttttaggtccacatttgctgaaatgtaactcttatctcatgcactgggagtgatgaacttcactaggaaatcatcgttctttctggtaagtcaccacagcacaaaactgcaaccattgtttagtaacaactagactctgatagatgctgtggagaatttgactagaagtaggaggatcatttactacatggcaaaaaaacaaatcagtctatcttagaaaggttaaaatttacatggataataaagaaaggaaggtagaagaagagtgataaattagtgagaaaagaacagtaggtgtaattatagcaatatgcttaaatgaaagagaaaaatatggcagaagcatttattgatttgagattgtaatttttttaaataaaaaagcttagtctggattccaacttgtatataaaattaggagcaaaggtatgattaatatgttcatggaatataattatcaagaaaccacagacatttgtgtatggaggacacagaaaggtgagaacttgctaacaggaatcccattaaagaagcttcagaatttgaagatcagcaaagagaaggaagagatgagaatgaaaggctttatgaaggaatgaaatgacagtcattgcatttattgatgtatctgtatttaaacataagtatatttatttatatttgaacataacagttttctagcaaaattaataaggattatgctacagacatactcagttacgatcttagagggattctgagaactctttgataggttatttacttatagtttgtcagtagtttctaaacatttttggatggacatctctataagtaataatatttgagcaagtaaacttcagtactatatttgtttatatgtacacaatttttctaatatataatttaaaaatacctactaaaattgatgagataagatgaatgtaaacagaatttttaataaattatttctaccacagcagatcatttttgtatgcatcccaatctggagacttcacagtttgatttggcattactattgatttgaaatagagttttgtttatttgtttcattgttacaaagaataggaaacacaacatagaggctcccctcctagaatcaaactaactttagcatattatcaacaaatgcttgcctctgaaaaaatactattcacttcttgtattaatgagactttatccaatttaatttcatatattggatgaggttaggcattcattagaacaagtcatgacaggctagcatttgtatttattaatagtatggtagatattgatctttttttcttctgaacaacaggcattctattttctaactattctttcctcgtttcatgtgattttgatgaggctataaatcacaggaccctgctctttcagcttagtctaattttggcacaaagtatgcatttaataactgataacaattattactactattgtaattattactattattgtagttataggtactaattgggatttgttgagagtcccatatttgctctatggaataaaccaaaagttgatcaactctttctgtaaagggccagatagtctatgttttgggctttgaggacattatgttctctgccataaccacttaactctgccattgtaacataaaagtaaccagacagtacatcaaaaaatgaatgtggttttgttccaataaaactttagctgtgaatatggaggtgggtttgatgtaatttgagggccatagtttgccaaaccccagaaaaaagcatacaaaatttactgaatgccaatctgtacaaatgcatagctagtgtgttaatacataaatatgcatacagtcattcattatataataatttagttcaataatggtctgcatataccatggtggttccataaggttgtaatatcatattattactgtacattttttattttgacatgtttatatacataaatacttaccgttgtgttacaattgcctgcagtatttggaacaatcacaagctatacaggcttaaaagcgaagagcaataggctctataccacatagcctaggtgtgtagtaggctatatcatgcaggtatacatagagcataagtacattctatgatgttcacacaacaaatcacctaaggactcatttctcagaacatttccctgtcattaagtgatgcatgactacacacgtacctgaaactataaataactttgaagcataaatagttggttgctttctggtatttaaaatcaagcctactttttaggctaagtgatagaagaataagaaaatgctgattcctttcaatgtttcttttgctttcattatgaactgaatgcttgtatgcccccaacatttacatgttaaagcctgattcccaatgtgatggcatttggaggtagatcctttacaggtaattaggtcatgagagtggagcactcattagtggtattagtgcccttataagaagacacaggatagagtgtgcttcctctttatctttttccaccatgtgaggaagccgtggaagaaggtgatcatcagaacctaaccatgctgacaccctgctttcagaatttcagcctccagaactgtaagaaatacatttctgttgtttaagccacccagtaattcgttatagcagcctgaaccaactaagtcagctttcattatttgtttctttatgatttgctgatcttgttttgtgcttcacaaagatccacataaaacgtcgatccccccagtagttcacttgcagttggtcaatttcctgcagcagagctaatcaactcattgcagactctccttgcctttctattctagctgatctaagtttgatctgtaaagtatagtttctatgtcaactttaattttgctatgcactttttccatgtctttaaaactacataaacacatgtaatatttaaacactgtggtctattctaatctatgaaaagcctattattctgttccatttttcaaaatacatttctcaattacaatgatgctataagttttataaactcccttttattaggcaaggaaaaaatgcccctcttctagatagagggcctccaagttaattcatcagcagtaaacattttttttcctatggttaaattgatgtattcactgctccgtcctttcttacttctcaacattaaccctccaacaacctggattttcctgtggtctctgaagaattttctgctaaataatgtatccatcactacttttgacttataatttctattttaataaaaaaagattgattttttaaaattaaaatattttattcttaataaatattaaaagactgttactgttaaaatacattgattctatatatattttttctctatccttcctttgaacgacgctcaaggcatttcttccattatgcctacagacctgtgttataacacattctttgccaatccttgaaataaatgcttagcaaggtaatcttttagttgtatcaggaggaaaagctatttgctttctgtcatcacagaccaatcacaggtcctgtttcaacttcatttattaatattgagtcaggtatgctgctcagattcctttgtatatgctaaactgtctccacaaattggtgtttaatgtctacaagaaaaaaaaaagagtggctatatttgtagcaaaaggtaaactcattgattttcatctccagaagcaatacaaggatgatttatttccttgagagataatttcttatatgtatagtaatcaaggatagcaacacaaatgaaaatgtaattatgagtactgcataccatattggtttttttcttctatttcttctgtttttgttaattgtcaaagccaagagtatgtcaagctgagaaaatgtcattaatgaggatatagattaaatggtctgtgggtaattaatgatgactgcaatgtctttctcactttctgcataaaagatggggtttattgcttctctctttgaacctgggttagctctgtgactgcttcatcagtaaaatgtggtagaaatgacttggtgacagctgaaagtttacattttaagcagagtctgctcccatttcctattgcttggagtgcttgctctggggaaaactagatgccctgtaagatgtgtgaatatttggaactcgacacgctatgaggactccaagccggccatgttgcaacatcatttaaacactatgcatattgaattcagtaggttcttcacacagatgctatctttaaaaaaaaaacaaatgtagtttaacaatttatttatttgtttttgtcaattcttacagcaaacatttgtagaatatagttaaggatacagagataaaagataacatttttatccacaaggaatgcttattgtattctgtgagacagaaaagtaaacacacaaaatttaaaaagtattataggtaataaggcagaaaaaggtacaatgtacaagtttggatgctaagaaagaaatactacttctatccggaggcatggtatctagtatgctctttgtgtataataacaatatattattatatgttttatatgcatttttattaataatggtaatggcaactctccattattgagcacaaatcatgtgccaagcattatgcaagtgagctactattctgcttctacctgagaaaggagcaagaaattagaaataacatgtttctaaaaatttccaatccaaattgatcatctcaaaatagtatggcacttaggtcaatcaatttcttgggaaaagaagctaactagattataaaatgggatccctcctcaaaaggcagctcattcatgataactctctaaatggttgtatgaaaagataaaaataattaagtttcatcctggaccttttgatgctaacattaaaaggacagcactgtcttctcacaaaaatcccttatttttcttcttaccaatagaaatccatgatgagtgagcttgtctcattgtggcaattcctataataacagataacaactagtaacaaatgtctctgagtcaaatctctcttctgaccagccacactgaatgagataatttgtcatttcaatttaagtgtttgtgtgatgatgagaatactgaaaatgtgacttttaaagcacttgatgatactttgaattctttagtttttgtagttttggtccaaatttgcttgctttatttcctcataggtaatgaaaatataaatccttagcctaacacttttgcaaattatttcaaaatgagaataaatgaagtttaaattcattgtgtcttactcaaattgtttttactcatatggttgagtttcaaattcaccagctgcacaacctcatgccagtcatttgtttccctcacatatgcctgtgaagatcaaaggttatagttcttgcttgtggttttcaaaatcagttttgctgagaaaactgatctctaaatcaatgcttagtcagaagccaaatacgtaaagcacataacctcagggttacttgaaggatctctaatcaatggagataggatatgatgaaattggacacgaatgtgttagatagcatattagttgtggatgttacacaaagaagcactctcctcaaataagtttgagacactcagtgataaggaagttacacagtttctttattgcagtacttctccaagacctagttatgctgatgtgaattgttattctgtggtgaagggtagtatttctcaaagttaggcaacaaatcattgaactttaagaaagacagaagtgtattttatgtactattttatcctcaatgcttcccataatatctgacacataagtgatatcaataaacaacatttgactgaatttaaataatccatgagatttggtttctgtgccactcactactgagtagctttttgttttgaagaacgtagtcttttctctctgttattatttttgtaatgtgagagatgtctacaaacacaagaaccaactgagcacaaaacaaataaacaaaagctctgaatctataactaattgaaccactgaaatttttcatctaaactttccttacattctgacatccagaaaagaatttctgctcaaatgggcaagtcataaagacaaatacttttaactgtcttggtgtttcaccccatttgttttattatctcttacttctttttatgtaagttatatttagtagacatttgtccactattaatggacttctttctagaggtggcattatgttgaatttaattttttaaggtcattgcaagtaaatgaaaaatttctgtctattatggtcattactattgaaaatagatgtgggagaatattctgtttatcattactgggaagatatgtaccaggtactgttctaaatttagtacatttttcaaaatatctaactttatttaattttcctaaaattgcatgagatggatattaccgtcttcattttctcaacgagaaagaacttgaggatctgaaacattgaggaatttttctaagaacaaatagctgtgaaattacagagttgaggtgaggactcaattttaccctgactccaaatcatatactcttaaataataaataatagaaatttgaaatacaaaaatcagtttctctctccttctggtttcctcattttattctgagacatcaagggaaagaagaaaatatcttctatgttaaaacccctcacctcaacgtgaatttgtacactattccagttttattcccaaagtgattgatgagttcaaacagacagaggtgagggattggaatattaatatcaaagatctcaaacgattttctctctcctatgacagtattgaatgagcttaaactaatgttagcatcaagatcttcaaaacatcattcatcgtggggaaaagggaatcaatactaacatcaggatcttccctcttacttaaagctttaattcacttctatgttccacttatataaccccaaacagccaatacatttcattttataatattgcctatgaattttacatatttattttgtgttatttcattagtcactgcatgcatgcctctgtcccttcaacaaatgtttattgaggacctattacatgtcagcactgttgtaggctctgggatgcatcagagaacaaaacaaacaacaatccctgatgtaacggagcttgcattttaatgaggaaaatagactataaataaaataaataagttaaatcaatagcatatgagaatattataagtggggggaaatcactcagagaaggcagagaaggagttttgggaagtaggggtgaattttaaattgagcattcagaaaaagactcactgaaaagatgaaatttgagcaaatgcatgaaagagatgcagaaatgagccagctggatatctgaaggaaaagcatgctaggcagagggaacagcaaggtggcacatatgctaaactatacggtgaggaacagagtactagagagatgaattcacagagcaaataggggagcagggtgtgtgtgttcaaaactgcagaccaggggttagtaaacttgccttctaaggggccagattataaacaggttcagctttgcaggccacattatctctgtcacaactactcaactttggcattataatacaaaagccatcattgtatgtaaaccaatacatgtgactgttctaatccaacttgattttaaaaagcaagcagtggtcaaatttgctacaatttcccattgcagaccattgagaaaattttggcttttgctttaattgagatgaagtgtagggtagttttaaaaaaactgtggcatattctttagatttcttcccattgagaggtgtctctacatcttgccttcattttggctggacttatgacttcttctacacatgtactatggtagaaatgatgctatgcgacctctaagcctagttaataaaaaagcatacaacttccactgttttctttgtatcctccctctagagaaaaccaactaccatgtaagtatatggctaccttgaggccactgaattggagaaaccacattgaaaaatctcacaagtaggacaggagatgccagataaatcccagctgttccagccttcacgtagttgtgtcatgcaaacctgtgattgtggaaggcataaagatgacttcagcctcgacctccatctgactacaatcacatgacagatcccaaaccaacacaacccagctgagtctagttggttcccaggaccttgagcggagtgatacatatttttttaagccagtctgttttggaattgtgtcttacacatacccaggtaactgaaatcagcactctttaaagtattttgagaaaaggaattatgcagcattaatcttgtgttttaacaggatttctctggctttgtgggtggcaaaaaggaatcagggagactattttaataatccagacaaaagagtttagtgggttggaccagaatcatagcagggaggaccaagaaaaagggtaggattttgtttaactgtattttgaaggtacaggtaactgctttacctgataaattacatgtagaatacaagacaaagggttgaatgaaggtgtctccaagagtttttagcatgtggcagaatgtagctgtcatttactgagttggaagaatatgagagatgctgatttgaaggtgaaaaatcaggacctgagttttggacttgttattttctacatggttattcaacatccaaatggagaaagcaaaggggcaaatatgtatgagtctagcttttctagcagaggtcttatctggagatatatgtggatgctgccagcctctagaaaatactgagttactaaagcacaaacggggaagagaaataccaagagcttgaggcacttacattttaagagggcagggagataaggtaggattatcaagagtgttcaagagaaaagggccagagaggtaggagaaaagttaagagaaagtgatgtccaaggaagccaagtggaaacagtactgatgcatgaaccaaggcaggcatttattatgaaactgagcatccagaaaacagggtgaatatttaatacctgttttgtcttcatttatgaaatcatgacaaacagcgttcatatcttgagtccattctatatgcaagtacaagtaaaaccttagcaagtattctcaattacaagtgcaattttagatattgatgaaggatgggcaagaatttggaacaatttgctagggatgatataaaattgtaataaataaaaagtgttactttttggctgtgtccccacccaaacctcctcttgaattgtaataccggtaatcctcacgtgtggttggaggaatctgatgggagacgattggatcgtagaggtggtttcccctatgctgttctcgtgatagtgagtgaattgtcatgagatctgatggctttataaggcagttttccctgcttttgctcatgttccctcacctgccaccatgtaagatgtgcttgcttctccttctgccatgattgtaagtttcctgaggcctccccagccatgtggaactgtgagtcaattaaacctcttttctttgtaaattatccagtcttgggtagtatcgtttagcagtgtgagaatggactaaaacaagaaggaagattgagacaacatgctttggcctcttctctgtttgttgaacatcctggggaatccaccaccataatatctcttctgttttaactgaagacttttgtgcaggacactgaattcgcaccaatctttatgttcatattgacaactcagtgattaatagggataccctaatttgtttcatatgctacatggtcacaaatttagatatgtaagctgcagaaatgaattggttcaacctttctgtaaactggggctttatacaaggaacaattaaaatttctttagttggcttttctctgcactatttccccatttgtctatctaaatctaaacacagatgccatagtcctgttattctacccttaactgtggtgatgcaaaatataatgcaaaagctcaaaaatgatgcacaataatagacatgcgcaaccagctttgtaaacaaaagtttgcagtgaggtccccaaagactggaaactaaatgtttccttttcaaatgaacagctaatatgtctcacggttagaatgtaaaacttgcttcattactcatttaacgacctggggaactaaaaccatcctttcctcttccaatgtttgaaagataattttaaattttaaatttcatgtttttctcattattaaggattgataatggacccaatgcatgggaaaactaatctaacaaaaaatacattggaggtgtcaaggcagtgtgtattagtggatgacacttaaatgagctgctaacagggctcagaaagaacctgacaggcaccatgattgatctattattggcctaggtgacattattggatttcagaaatttgaattaaaaatttcacctaaagaaaaagaataagtttgaattcaggcagataatttagtatagtcattattttaaaaaacttgctgaagtgaggcagtgtctacacagtcaagtaggctttggtaaatattttaaatattgtgatttttacctgcaatatatttgtatactgcaatgcctttgtacaccacagttatattttaaatataccattttaagttattttcgtttgtgtgaataatgttgaatatctgatttcgtagttaacctggccagaggcttttttttaattgaacttttcaaaaaatcatcttctggttttgttgatttctctattgatttcccatttttatttcatttatttctactctaattttaatttattttcctatgcttactttggatttaatttgcttttgttctagttttctaaggtgattaatttttttaattttaataagtttttgggaaacaggtggtgtttggctacatgaataaattctttattggcgatttctgagattttggtgaacccatcacccaagcagcgtacactgtacccaatatctatgtagtattttatccctcaacctcctcgcaccctttcccccaaaatccccaaagtctgttatatcattcttatgcctttgcatcatcatagcttagctcccacttatgagtgagaacatatgatgtttggttttccattcctgagttgcttcacttagaataacggtatccaattccaaggttgctcaaatgtcattattttgttcctttgtatggctgagtagtatttcattatatatatatatatattttatatatatacacacatatatcgatatcacattttctttatccactgttgattgatggcatttgggctggttccatatgtttgcaattgtgaattgtgctgctataaacatgtgtgtacaagtatcttttttgaataatgacttatttacctatgggtagatacccaggagtaggattgctgaatcaaatgatagatctactttcaattctttaaggaatctccacacagtttcccatagtggttgtactagtttacatccccactaacagtgtaaaagtgttcccttttcatcagatccatgccaatatctatttttttttattttttgattatgacattcttgcagaagtgaggtggtatcgcattgtgattctgatttgcatttccctgataatcggtgatgttgagcatttttcatgtgtttgttgaccatttgtatatcttcttttgagaattatctattcatgtccttagcccactttttgatgcaatcgtttgttttttttcttgctgatttgcttgagttccttgtagattctgaatattagtcctttgactgatgcacaggttgtgaatattttctcccactctgtgggttgcctgtttactctgctgatcatttcttctgctgtgcagaagctttttagtttaatcaattcccatctattcatctttgtttttgttgtgtttggttttgggttcctggtcatgaagtgttttcttaagtcaatgtctagaagggtttttccaatgttatcttctagaatttttatggtttcaagtcttagatttaaatctttgatccatcttaatttgatttttttataaggtgagaggtgaggattcagtttcattcttctacatgtggcttgccaattatcctggcaaccatttgttgaatagggttcctttccctattttatgtttttgtttgctttgtcaaagatcagttggctgtaagtatttgggtttatttctgggttctctattctgttccattggtctatatgcctgtttttataccagtaccatgccgttttggtgactatggcctgatagtatagtttgaaattaggtaatgtaatgtctccagatttgttctttttccttagtcttgctttggccctgtgggcttttttttggttccatgtgaattttaggattgttttttctaattctgtgaagaatgatggtggtattttgatgggaattgcgttaaatttgtggattgcttttggcattatggtcattttcacaatattgattctacccatccatgagcatggtatgtatttccatttgtttgtgttgtctatgatttctgtcaacagtgttttgcagttttccttatagaggtctatcaccttcttggttaagtatattactaaatttttttgttgttatatttttgtggcattttgcagctactgttaaaggggttgagttcttgatttgattctcagcttggttgctgttggtgtatttcagcgctactgattcgcgtacattaattttgtatcctgaaactttactgaattcatttaccagttttagaagcattttggatgagtctttaaggttttctaggtataagatcatatcatcagcaaacaagaacactttgacttcctttttactgatttggatgccctttatttttcttttgtctgattgctctggctaggacttccagtagtatgttgaatacaagtggtgaaagtgggcatctttgtcctattccagttctcacggggaatgctttcaacttttccccattaagtataatgttggctgtgagtttgttatagataaggtgattaattttaaatatttcttttctaataaatgtattcaatgccataaatttctctctaagcactgctttcgacacatcccacaaactttgtaagttgtattttcattttcatttagttcaaaatacttattttgttgttgttgagattttttctttaatccatgtgttctttaatagtgtgttctttaatcataagacagtcagtagatgtcagttatatccagttaattgacggtgctgtgtttactcttttttctgtctgcttgatatgtccatttttgatagaggggtgttgaagttaccaactatgatagtggactcatgtttttctccttgcagttctattagatgttgcctcatgtttttgatgctccattgttaggcatctatacattaaggattgtcatgtctttataaggaactgacccctttatcattatgtaatacccatctttagccctgataactttctttgctctgaagtctagtctgtttaaaattaatatagctgttcccattttaaaaattagcatcagcatagtatatctttcagtatgtgctcctatagttaatgcatgtttcttgtaggcaacatacaattgggaaggtttttttaaatccatttttacaatctttgccttttaactgatatatttagaacattgatgtttaaagtaactaatgatttagttgaattaatacctatcatatttgttagttttatatttgttaccctttttctttgttcttagtttgtcttccactattttactgcctttcgtggctttaattgagcattttgtatgattccattttctctcccttattattagcatatcagttatgcttcttttttacatttctcagtggttgcactagagtttccaagatacatttataactaattcaaatccatgttcaaacaacattataccacttcacaggtagtgtgtgagtaccttaaaataataaaataatcataattcttccctcgtcacttttatcattgctatcattcactaatatataagcatatataagtgcttatatataagcactcataaaataacataatagtagcatcaatatattttattacataatcacatgtgtaataaaatgtatatatgtaatatatatgaaatttatatatatattatatataaaagcatatgtaataaaatgcattgttgctactattttgagcacacttctatttgtagatcaattaagaataagaaaaatattttttcttcgtgaccccaggtgtcatggataaaagatctatagatataattttcaagtcagtgcaagggtattttttctgacaccgaagtgatattaaagtggactgaattctcttgggaagtatttaactcctaattctggagctattccagtgcttgataaaccactcagtgaagatactctcaaatgagttcttagtatttttgtgttaaacagaaaattttccagtgttaggataattggcagggatggaaggactcaaaattgcactaattgtattattcataaagaataatggagtcaccaccaaagaataacacagtgtctgaaaggcatccacggatatcactgtcttcatttgttgagtcttcatcatcaggttactgttttaatagagctatttacttccttgggtacactctcagttgttcactcagatatgttatcataagttcagataaataaaatattttcagaatcatcttgaaatttcactatacctattatttgcaacaaatgttattccagtttccctttgactcttttagcttaatgttctgtgtaacagccattgctgttaatatacgtatttggggcaaaaaatacaatatcctttgtgatatcccttggattgtaatatctgacctttgaccccacatgttttaattatgcaactaattatcatgtaataaaggaaatacaacttcaagatggtagctttgtattttatatttaaaatcttagaaagttttattattgataaataaaaggattcaaaataatcctgaagtataatgatgttaaacatatagtttagaactagattaacaaaataataccatttgcataggtagggtgtctgatatgcttctaaattaatttgatttgtatattcttgaaaactcccacaagttatttgcatgtactaaatagatgttgctttttattctgaaagaatgagaatgaagataaaacataggttcatagattggtcaacatgcagaaaaaccaatattgattatttttacagttcattacatcattaacatattgggatttcccttttactacagacagtaatatatttcactatgcatgtttattgaaatacgttttaaatagatttgcataacaaagtatatattagttcaagcagatgtttagggtcataaccgtcaagaaatttgagctgcccaggcgtgtggcaaaatcagggttactaatgattgttttattgtttctgcatttcagtcatagagtctggcagattgcaagtgtactgttactctgtaggaggtataaaatgttcatgatgttatcttgggcgaggcctccagcctggaagatcagcataactctgagttgctaatctggccagttcagtctttgtttttatagagaaaatcaaagatatatcaattgatgctagttgcaaattatagaaatgttgtgattagtatttttgaaagtcttatattaacaacacttcattagttgaaaattcttctcctaggctccagttactatcttcccagcttaaatccagaaaacaacagcaatgtctttgccagctacctcacatttggagaattgaacactgtagctcagcttgaggaaagatgatagcattggaactgatttcactttctgagcctttttttgagggtatttactaataatacttctgaactgtaaaatctgtgggttagcatccccctctgatgcaagaaacctggagtttactggctagctagcaaatgcaaaattagacaattttgctgggagctaaatatacacggttaagtgtgtttgactattatatggctgcagaaagttccacatgccaatttatttgcttatggtgttttggaaaatggaatcctttagagaaagagaaagagaacacaccaactttcaactccattgattttaattaagctaactgtagattggcaagcactgcaaaattcacaaacctgatgagacaaaagagattacacaataggtacaggaactaatggctagtccttaattatctgaaactgacaagacaatgacctgtcaaattaatggaaattatcttccataaagccttggtggaatggcagcataatattgaacttcagaaggaaaagaagcctggaccaaaaagaagttccttgcccttaaaaatgagcataccataatagacacagacatgggaagatgctcatgatgtattaagtagaaaaaaaaaatagaaaataatatagtcagcctgttcccgttttggtaaaattgaaatacaccaaaccacttttacctgttctaccaacataggatgtgtacctggtcactcctgtttcgttttattgtatatatatgtattttttttcaattaatattggaaaaccccattttctcttctgggaaaaaaaatctaatactgtctctaggtccttctgccaaacccagtgagacagatcccagatgccaatgccattgcttatcaatatcacatggtatcactgtcagatgcacatcatgaaaaacttcatgcctgtctgctgctactgggatacccttgctagtagaagcctgtgccagagtggtgctcatgaggtatcaaggatatagcccattttacatcatactcccatgttccatccttattccactaaacaatcatggagctagtaaggctgtgtttggatgagttactgcaagctaattttagtaggccaaataatgcatacagtaaactagagaatatttgcttgaaaatattatggtgacttgtccttattttagactcacctcgtaagtagtaactaaaacagtaaatgaatgaatgcaagctgtctggaccagcttggtaataaatatcctgaagttcatctttccatttttaaaaagtcacccaacttatgtttgataaatataaacaaacttttttatgtcatcattttaaatgctttaggaaatggtttcatttccttttgttttgtccgatgttcatatctttcatgctttgcttatcttttggaagtgtctgtccaactagagctcttccaaagagatatttggcaaggacatcttctgctcccaggtataaaagggagtcaaacaccattattatttttatccttcaggaaaaaccttctgtgaaaatcctgattgcatttccttttataagattctgtctcatatttattaactgaaaggttgggtcaaatcagccacttgtactctctgtagtttatcagcagaaggattctttgaaagattaaattgcacagggctgacttctaaagtgcagtgaaaaaaataaaaaagccacttggtaaaaatgctaaaactgttattttcttgggaaatgttgtagaattttagcaaattaacatgttacatttaaacccatttgtacttgagactggattgtttatagatgcttgaaagaaccattatttgtgtgtacagataagcaaattgaaaaacataattactcataaccgtgtttcatgttttccagaatcttaaagaagtcaaaaatatcagtgaaatcaagcatggagaaatattgcattattaatattatactgaaaagtaaataagatttttgaatttctttataaatcatttttagttatcataatccttcaagcatcaattcactgtgttttaaaatgcacatttattatctctgtatgtgatttttcacatctttcatttttttctctatatttatgtttggggaagaacgtggaatatagaatgcagacatgatgtctctgaaatacatgtctcctctcccaaagacatagtcacattttatagttaaattttggtttgaaagttctaatttctcttccattaacctttctgattccaaatgctaccagtctctgtggccaagagaatgatacaccatctttctccatccccaacaacagaaagctcagtttcatcttccattttccccagcttttccacctcataccactcagaaagtcctggattttattttcttttgagtttcttgaataggtttaccctttctccatttctgattcctgagtcctttcattagtctcttattattattattattattattatactttaagttctagggtacatgtgcacaacgtgcaggtttgttacatatgtataaatgtaccatgttggtgtgctgcacccattaactcgtcatttatattagatatttctcctaatgctctccctcccccctcctccgaccccactacagaccccagtgtgtgatgttccccttcctgtgtccaagtgttctcattgttcaattcccacctatgagtgagaacatgcagtgtttcgttttttgttcttgcaatagtttgctgagaatgatggtttccagcttcatccatgtccctacaaaggacatgaactcatccttttttatggctgcatagtattcaatggtgtatatgtgccacattttcttaatccagtctatcattgatggacatttgggttggttccaagtctttgctattgtgaataaacatacgtgtgcatgtgcctttatagcagtatgatttataatcctttgggtatatacccagtaaagggatggctgggtcaaatggtatttctagttctagatccttgaggaatcgccacactgtcttccacaatggttgaactagtttacagtcccaccaacagtgtaaaagtgttcctatttctccacatcctctctagcacctcttgtttcctgactttttaatgatcgccattctacctggtgtgagatggtatcttattgtggttttgatttgcatttctctgatggccagtgatgatgagcattttttcatatgtctgttggctgcataaatgtcctcttttgagaagtgcctgttcatatccttcacccacttttttatggggttgtttgtttttttcttgtaaatttgtttgagttctttgtagattctggatattagccctttgtcagatgagtagattgcaaaaatgttctcccattctgtaggttgcctgttcgctctgatggtagtttcttttgctttgcagaagctctttagtttaattagatcccatttgtcaattttggcttttgttgccattgcttttggtgttttaggcatgaagtccttgcccattcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcaaatggttgtagatgtgtggtattatttctgagggctctgttctgttccattggtctatatctctgttttggtaccagtaccatgctgttttggttactgttgccttgtagtatagtttgaagtcaggtagcgtgatgcctccagctttgttctttcggcttaggattgacttggcaatgtgggctctttttttggttccatatgaactttaaagtagttttttccaattctgtgaagaaagtcattggtagcttgaaggggatggcattgaacctacaaattaccttgggcagtatggccattttcatgatactgattcttcctatccatgagcatggaatgttcttccatttgtttgtggcttcttttatttcactgagcagtggtttgtagttctccttgaagaggtccttcacatcccttgtaagttggattcctaggtattttattctctttgaagcaattgtgaatgggagttcactcatgctttggctctcagtttgtctgttattggtgtataaaaatacttgtgatttttgcacattgattttgtatcctgagactttcctgaagttgcttatcagcttaaggagattttgggctgagacaatgggattttctaaatatacaatcatgtcatctgcaaacagggacaatttgacttcctcttttcctaattgaatacactttatgtctttctcctgcctggttgccctggccagaacttccaacactatgtagaataggagtggtgagagagggcatccctgtcttgtgccagttttcaccggaattgcttccagtttttgcccattcagtatgatattggctgtgggtttgtcataaatagctcttactattttgagttacgtcccatcaatacctaatttattgagagtttttagcatgaagcgttgttgaattttgtcaaaggccttttctgcatctattgagataatcatgtggtttttgtctttggttctatttatatgctggattatgtttattgatttgcatgtgttgaaccagccttgcatcccagggatgaagcacacttgatcatggtggataagctttttgatgtgctgctggatttggttggccagtattttattgaggatttttgcatcgatgttcatcagggatattggtctaaaattctctttttttgttgtgtctctgccaggctttggtatcaggatgatgctggcctcataaaatgagtccgggaggattccctctccttctgttgattggaatagtttcagaaggaatggtaccagctcctccttgtacctctggtagaattcagctgtgaatctgtctggtcctggactttttttggttggtaggctattaattattgccccaatttcagagcctgttataggtctattcagggattcaacttcttcctggtttagtcttgggagggtgtatgtttccaggaatttatccatttcttctagattttctagtttatttgcatagaggtgtttatagtattctctgatggtagtttgtatttctgcaggatcggtggtgatgtcccctttatcattttttattgcgtctatttgattcttctctcttttcttctttattagtcttgctagtggtctatcaattttgttgatcttttcaaaaaaccagctcctggattcattcatttttttggagggttttttgtgtctctatctccttccgttctgctcttagttatttcttgccttctgctagcttttgaatgtgtttactcttgcttctctagttcttttaactgtgatgttagggtgtcaattttagatctttcctgctttctcttgtgggcatttagtgctatacatttccccctacacactgctttaaatatgtcccagagattctggtatgttgtgtctttgttctcattggtttcaaagaacatctttatttctgccttcattttgttaggtacccagtagtcattcaggagcaggttgttcagtttccatgtagttgagcggtttggagtgagattcttaatcctgagttctagtttgattgcactgtggtctgagagacagtttgttataatttctgttcttttacatttgctgaggagtgctttacttccaactatgtggtcaattatggaataagtgcgatgtggtgccgagaagaatgtatattctgttgatttgggtggagagttctgtagatgtctgttaggtctgcttggctcagagctgagttcaattcctggatgtccttgttgactttctgtctcgttagtctattaacactcacaccgtctcccttacccccccctactccaagcatagatactattatccaacttttaagtatgaaaaaactgaaggctgctcagggcttaaaggtttaaattaaggctatgatttggatccagatctgcctctctctaaagcatgagcttttcaacattacaataggctgtctcacttttcactgatatcagagtaaccttttttaaaccatggtgctgaacatattccatttccctgcataagtggattgcaactggtgtaggtttaagtacagatttcttagcaggacatcaaagtttttaattacctgactctcacctgcatttctggcctgttatatttgcaatcactttctcaatgacttcttatattgcaggttaatcaggaatatataatcagcctgcctagaacatgactccatgtcttgcctatgttagactctcagcctggaaacccttctacttaaaacttgtcttcttatctcacacccttagctaggaaaagttttctaacttctaggtagagctggttcctccgtcttccaggcatcttcacaccttgtactaggcaatgagctcttcaacaagagggcccacttgttttctactttcttattctgcagaatctattgtagagccttgctcatactgggactaaaaatacatttaaaaaataaaattaagcacacttattttccataggaatttttgagtcattggttccctgaatagccctactccccttttccattttgaagaagtacgtatagttttccaaaacgttcttgtttgaccagtgcgatcagttcatttagtcaaagcgtttgcactgttcctaacttttctaccttaagaagcatacttttgctcaagcagagcgtttagtgcacgtctcctttaacagattcctgctgagagctaacagctggattattgaatcttctccttcaaaaccactctttgacttattacaagattatttttctcagttacatttgattctttataggtaccgttttctgcccctggccttgtttaaaattgaattgtgatggctcttcccctgacttgtcttttaaagctattatcatttacttcattttttttttaggcctttactggaaaatttctggctgtaacactttcttataatttctatttctattccaggtttctgcttaagcacagtgttgcattaataagggtcaggcaaagtttcaacagcatttaatcttacactttaaatttttgttcacattttatggtcttgacacatttactgtaataaagggaaatcattaattcactaagaaacgtgtaaaaactatagttttgcttttgattaatttccacattcatcattactttgctactaatttaccatgcattgaagagactgagggtgcaaaatatgattttttttctttgtttaaaaagaactgtcttagaaaccaaatgaggctaaaaatgtacctgtgttttggctgtcaaaggggagaagattacttcttcttgaacgtgttttctgtctcatcctcatgtttcctttatttataccaaatacaccataccgttctctactttttttttttgaagtaaaagaaagctatagccgtagccactgtcatattaactctgaaaataggttttttcctttatgaagaggaaagaaatcttaatttacttttggcttatggaaggaaatcatctaaaattttataatgccagctacatcttgaacatttttgaatactgttgttatgaaacaaaatcatacttgagcctagaggtcaaatatatcaccaatattggcagcaggcaattgaataacgattttttgtttttgttttgcacttggataattgatactaaagtggtagtgactactaaaattaatgaaaaggaagctatagtttttacactataactaggccaaattgggaaggtatcaaaattatagttataaaatgagactgaaagtttaaaacagatcactacctatgacgcacacaattgcaagccctttttcgtagatcagtcaatgaagtctttgcaaaaacccaaagagggttattttggattttaggggaggagaaaactgagactcataaagttaaataaactctcctcctttattgtattgttttgttaaatatagatttttattcgtatttttaacaacacaaatatttgtagaaaaatttagagaatgcagaataagcaagagaaaaataaacacaatgtattgctatccccccagttttcttaactgtgtattacgcatttttgtgtagcctgcttttttgctttaaaatgtcatgaccttttccaaccataagtatgttatttttcatatgtcagttttaatggctataatattctcctcagtgtttttgagggtctttgagagcactcagtaagtagcacctgtcttttctacccaattcagttgaaaaatagacagcaagtggagaaccagaatatcaccctattcctaattaaggcacaattggcaggcacagcttacaatgagagaaaaaattggcttgctcactgcatcccttggaagtttgttgagctgtgagaagaacccacttcagggaaagcttaaagccagggagcaggaaatccctgcccttcactgtccctggctagaggaaggaggaaaagaagcaacttctccaagcagagaaactttgatcatgtctacccaatacctgtaacacaccaaccactgtaaagctggtggtcctctgctctggggatgaggaagtggtggaaaaggaagccaggcagactgcggaggatgccacaaaacaaaggtgaggaaggaggcattcccctgtgatatatgaagttcatattactcatttaatcaatcccctattgttgtacacttaggttgtttcaaaacaacaatgaaattaaatgcatttgtaattaattattgtgtacattatagaaattttctttaaatgaaactctataagtaaaattcctgggacaatgtttttaacatgtttaaaggttttaatgcattttaccacattttactcaggaaagttttgtcaatttacattaccactcagtaatgtgtaacctcatttatttttaataagtgtatttgaacccaggaaagttggctctggagcccaaattattaatcttaacaaaatcctgctagttactaaataaaaaaaaaactgtaaaattcatgaaatttctctgactccataaactttcaatggataatttctatatctgtccatactgcctgggagtggagaattataatggtcatgaaagtggcctttggccttggactcctcctggctttgaattctgaatttgcccttaactagagctgtggcaagttatcatagatgttcaagcaactctgctcttcacagtgctaataaagacatgcgcaagactgggtaattcataaagaaagaggtttaattaactaactgtttggcatgactggggaggcctcaggaaacttacaatcatggcacaaggtaaaggaagcacatccttattcacatggcagcagcaaggagaagtgccgagcaaaaggggaaaaagcaccactcactatcaggagaacaggacatgggaaacctcccccctgattcaattatctcccactgggttcctcccatgacatgtgtggattatgggaactacaattcaacatgagatttgggtggggacacagccaactcatatcagcatccaccacatcaaacccactaagtgagctacatttttgctgcatggaatgaaaatgtccacacagcacagagaagaatatgtgcttcatagagtaatgatagtcaggttaacacaagatgcttctgtgagaggctgatggtcagccctgagatcagtaaccagaagccgtggcttccagaaggctgcctggatctggttagtgaggatttcagtagtgaagtgaccagcaataggagtagctccagtggcagcagcgaacttcagcacagcccactggccaggattcctggacgacctgacattgacatcagcagggttttcaagggcaacaatggcataagctgtcagcagaagcttctcccaggtcctcttcagatttaggatgtagatgccatcagttttccttttatagatatactgttccatttggaagggttggtgccacctagcaggttccagctactaggaactagagggcatcctcctccttcatttgcaggacatcaaggactcccgacattgtgaaagtttccatttaagttaccatgggaacccagagcaacacatgtggactcctgtctggatagtgcagaaacctaagcctgctttattatatccacccacattttcaaatttccagcatttttatccgacctttaaagatagtaaagaagtcagaatattttttaagtatataaaagtaaataattaccttattaatcagacaagactttactataaaaccaaatacctctgagttaacaatattgaatattaacatggtaaaaaggcatcaggatgagttcttttatggagaggtcctaaaaatatataatattgaagtgtatgtgtgacacaggtaagttatattgcactcagaagtgttggaaattctgtgagagattggtttatatttgagaacctgcgtgagtctaagatggctctcgtcttcttctagaaaagaacaaatgtgaaataagacccctattatttctttaggtcttactgagatttcttcttttgcaagaggatgtgagttttctgtagtaacaccatacttcgcattggatcactaggtagttatggactaatctagggctgagggagagatttttatgacacactttataatagactttcagcgtttttcagaaagaaaatcccactgaggatacaaagtttatatttttctttgactgtaacacatcacaataaagatgatactctgctgatatatgagattcatgttatctgcaggaaaacttaaagtgttttgttctatgtgacagtgacactgtgtctaagaatgctaaggcagagaaaaaatggagatttaggtaatatttatatagataagaaagaaagtttaggctcatagtccagaaagtaaactgctaattcttgcctagtatgtttttttttaatttttttaattccttgagtctcctcagttttgcatgattttgacactgtttaccagacaattctacattatctctccttgtcttttggtttgaattaaaagtaatttaggataatttcagtttacctaaaattaatgaatctaattctttacctggtaaaaaaaaatttgttctttgtcttccataatctgtccctctgtaattattaattttacatgttaaggtccagatatttggtcaaacactattttgaattctgctgtgaaggaatttttaagatgatattaacatgtaaattagtagactttgagtgaagcagattaacctccataatctaggtgggcctcatttcatcaggtgaagcccttaatggtggggggatggaaagactgacctctcctaacatctttctctcctgaggaagagggaatctggcagcagactgccttagacttgagctgcaacgttcattctttcctgggtctccagcttgctggtctatcctgcagattttggacttactagcctccacaatcacataagccaatttcttaaaataaatctatttctctctctctctgtctctttctccatccattcatccattcatccgtctacacattttttattgtttatttttctctggagaatcttgacggatacaccatctgtttatcaatcattcttgaaacagaaaattctacctgtgtatgcaccttgactggaaagagtttttgccaagtctgtactgtacctagttaaggcatatttagaaacatggccgtgggaaaacaaaaaacagcaagattaaaacatggagatatggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccaggcgtggtggcggcgcctgtagtcccagttactcgggaggctgaggcagaagaatggcctgaacccgggaggcggaacttgcagtgagccaagatagtgccactacactccggcctgggtgaaagaacaagactcggtctcaaaaaaaaagaaaaaacatagagatatattatatatcctaattctacaaggatgtttctggctttacttatgtgtgtattaaggtttttcttctcttcttccacactattttcttatagttgacatatggtaatatagtaagaaaaaatacacatatatttcttcttgcaatatatattcattgggatgtttaacactgagtgtcaacctgattggattgaaggatgcaaagtattgatcctggggtgtgtctgtgagggtgttgccaaagagattaacatttgagtcagtgggctgggaaaggcagacccaccctcaatgtgggtgggcacaatctaatcagctgccagtgtggccagaatataaagcaggcagaaaaacgtgaaaaggctagactggcttagcctcccattctacatctgtctgccatgctgaaaatcggactccaagttcttcagctttgggactcggactggtttccttgctcctcagcttgtagacagcctactgtgggaccctgtgatcgtctgagttaatactacttaataaactccctgagaatatatatcctattctttccctctggagaaccctgactaatacattcatatatacatagttttatatatatatatatatatataatatatataatatttatatataatatatattatatatttatataatatatataaataatatatataataataaaatataataatatatatattatatattataatatatatatttatatataatatatataatatataatatttatatattatatgtttatatttatatataaatataatttatatatttatatcatatatagtaatatatgtgtatattgcaatacatgtatacatatgtgtgtacattgtatatatgtatattgcaatatgtatattgcaatacatacatatatacatatgtatgtataatgcaatttatatattgtatatacacatgtacatattatgcatgtatacatacatatatgtgtatgtattgtatacacatatgttatatgtgtatgtattgtatacatatatgttatatgtgtatgtattgtatacatatatgttatatgtgtatgtattgtctacatacacatacgtgcatgtattgcaatcagatgaaagcacacactgtttcagtctaataaaggcaaatgctagcaagaaattaatttcactgttaaatttccaattattttctagatcctgtagctcaggagcagcaaaggattacaaagaaacaaaatgctatgtgggggagagagtatgaggatataagagagctagcctcacaaaagatgttttttcctggcccatgagaatagcaacttgaaaggagaataggaataaacagaataagctaaataaaccatactggatttctttcattctagagatgaagttttatttggagtattaggattgaacctgaaattaaaaaataaaataaaggttatttccctggattccagtcagttgtgattaactaataacaaagccatttggttgtagacaatgtcacttatcactttcatgacaagtgatgacaatttggaatcatgcaactgtaaatgtatgcttgatatacaggatgcagtggtgaagaaatcagtcctggctttcaaggtccttatcaaacttgtggcatcctgctatttattgcaatcatttgcatccctcttatcccctatttttggagttctagctcattgcagtctaaggacagtaaattatatatattcatacaccacacaatgttaagcagataccaaacacacacacgcacacacacacacacacacacacacacacagagctgtataattttgctattggcacaaaaatgctgcaaaaccaatcctctcaaacctagtagcttaaagcatgatcaagtgaaatttttcatacacctctggatcagctgtggatggactggtctgtggctgggctggatagctttgctgatctatgctgagcttcgctgggcggtttgattgtgtctcttttactccaagcaggataacttgacattttctcatcacagagacagaggtactaggaaaacgagctccatcaatcagacatttcaagcttctgctatgtcatacctaacaacttcacattggccaacgcagatcacatgactatgtccaaggtcaaggaggaagaaggtgttgcaaagtcacaggacaaggtttcgatatctaatttcactacttggggaggagaagtaaggggctgaaagaaaataccgcaagcacacttcaagaatttaaagtgcacgcatgtttcttcaaactccatatatgtttataggttctttagaataacttataaaagcaagagttttggcctttattattacattgattagatgatatgcagagattcgaagatatcttcaatataaaaaccaccaagcatcatttaatgaaaattaaaagcagtatactccatgaaaaaatgaagcaacttttataggaatgctacaattcacagctgtgtagagtgacaaaattgttctcatgcccctcctagcatgcattaggattttcgttatgtgaaagttttcttcagagtgaatgcaaatcaaaaaagactgtattcacagcctttagtgggatgtactagagaaaattcactttttatacctactaactcaattttccaccttactttgtatactacacatctggcaagagcagacagtatgacttagtaaagtcaaaggacccaaaaaaacccctgctataacaaaatgctgtctttgagttgcaacttttgattcttaagggaaaaataaaactgtttttatttgtaaaatagaaccttacatgcattaaaatctttactaaggattttcacacacatatctggtcagatattcctacaatatcattaatatagcagagatttgttcatttcacaagtgaggaaataaaagctcaagtcaatgaaataaaggcttgatcttaatatatgtaatagtaaggatgcatttgacagcaaataacaaaaaatctgattgatgtggttttaaacaataaaaataatttattgttgcatgtgaactgaaggccacagttaggttgggataacccttggtttaataagagcttgacttttcagtgattgtcgtaggtctttctttttccatactttgaccacattcacaaaatattgtgcagaactgaaactgtgtgcatgcatctctgaatcggagcactgggcttcctgctcttggaaacattcctgacccaatctcaagggccatggaattctaggtggtgattgattggtgcctggattacacaaaccaatccctgtgtctgtgaactcatggagcacgttttagccaaggtctaaccctttgcgctagagaagaggaccctcacccaccattgaatgagcagtacacacaaaataaaatatgagggttcaaccaaaggagacggtgaagggagagttttaaccctcataaataacaggtataagactaaaatctgtcatttgtaccccttcctcagtgctctttcctatctaagataatgtatcctgtgttaattaatacacatttttataaggggttgttttataaatcttacctcttttctgcattatgtgaatagtaagatggagaatgttgcttattataataaagtgataactcagctaatattcttatttcttcaccctcattgagattttctatgaaatatcatttggagaacatttcttattataatgaaaagtgataactcagctaattttcttatttctttacctgtcattgagattttctatgaaacaccagttaaagcaaaagcctagccacttctaagatactgtattacaatattattatatattctgacacattcagatataattgtttacttgtctttttttgctgacaaaattcctgcatcagtgtaagtggccatttatttttgattcatgtagacaaatgcttagctctttaatgggagcttgatttgaaagacatatcaaatcgtacattacagagccatttcccctgaagattgctcctccacgtcagcaaatgcacatttggttaggaataaatcacgaaaatgtttatggctacgtatatgttatatatgaaacattgttaatggctaccatctttgtgccaacatggttttatgctggacaatttaaggacaatttccagtccaaagattttggtcatttttcagaggctccattatattttccaggctacttagaataccatttagtaaattgctgcctcagagcactagatgatgattttatcatttaaatagttaatacacttaaattgcctgacaactaaaatgcctaattacacacacacacacacacacacacacacacacacagaactagcctaccataacctcagacactacatttcactgtaggtcagacctagggtccctaagccacagtagaatgataatagtttagtcttcaacactaaaaggcctccagataccatgttatcaaacttcttcattataaggaaaagaaaagcaagtcaacggacctatgtgattaccaggtttttgaatattttggagagatatagctatcaaaactataaaaatttaagcataatttgaggagtaattgttgttccttcttttcataaaataacatgcttccaaattatgttggaagatggaagactgataattcaagggctaggggaagctgtgtaaaattgatcattgttgtagaagataccagcatttcatacatttctctgtttttttaatctcatttagcttcccaaaacaaggtgtagttattgcacaggttatataactctcaagtcagaaaagatccaaatgtcttttaaaacaatctcttaaggggtgactacgtcaggctgtaattggctgattgagtttcggtttaatattacaccttgcccctagcatccactcctgctgtctctaggcactgtccttttctttcacagatttgacattttcttttgaccttaacttcttaatgttccttcattttataaatgcttcatttttcatgcttgcaaaaatggagtctcttatataaggacacctgtcatgctgtcagttcatagtaaaaccagcaccataacctagatatcactcttctcctctggttacagtcattttatataataagatttaaaacaataaagttagtgtcattaatgtgtctcaaaattcaagtttttcagcttcctctaaacatttcttttctttgaatctataagtcttatttctcttatcactaaaaatacatacatcaaaataaataaaagctttcttctccaattacctacctagctaattctctttctacttcatttatgtcctacattatttaaaaattaatcaatgttctcttccttttttgctcattcatttctgcctgaccagcctcctaaaaccagttccattgagtcactaataatcttttatttctcagacctaatggatgcttttctatccttgagttatgttgtctccttcatgaatgttcatgaaacattctcacttttagaaagagcatgttttcttcgtttctctcctacctctttgactaaacttctttagcttctgtctcccccacccctgccaagcataccctgtagttttgtatcctacaattctttatatgtttaaccttccttcttgcttctctgccacctatacacctatgactttggagtctatgtgcctacaccagtgcttctcaaactgagtaatttagcccccgaggatctatctggagacatctttagttgtcactgctggatgatggggtgggaatattaccgccatgtggtatgtagagtatggatgctctaaacatcctggagtgcacagggcagcctccaataacaaaggaataaccagctagaatgccaacaatgtcacgctagaaaaactcttctgtagaccgtactattcttcaattcccaacttatattcacttgcttagttgatgtctttacaacaaacagaaagatctttcactgaggctttgaatgaaacatttctatatataaatcaaacataatttgcaactaaacaatttattttcccacattgccttgtgttagataatgaacttttctttaactccttctaagtatgtgacacatcttctccactggaaagttcttatttaatattataactgtaatgtcctttgatttcttctttttgtgataccatgtataatcaatactgtatgaccttttatacactttggtcactttttttgatgaggcaagggatgtattcacatgcatgatatggtcgtcacccacatacttactatatgtgtaaatagagggaaaaccaccttgggaaaatgttctctacttcatcatgttacttttaatatgtcaattacggcctatcatattttccaataatcaagctaatttttgccgctttttcacaaaggaggactttgaaaagttgttaatgaagctcagaccaccaacttttgcttttgggtgttgtcttagtctttttgggactgctgacacagaatacccaaggcaaggtggtttataaaaaatacatatttctttatttttttaaaaaatatttcgacttttattttagattcaggaggtacatatgcaggtcagttccatgagtatattgcatgatgctgctgttagtatgattgatcctgtcactcaggtagtgatcatagtacccaatgggtagttttttaacccttgtcccactctgtcccttcccaatctagtactctccagtatatattgttcccatcttcatgttcatgtgtacccaatgtttagctcccacttataggtgagaacatgtggtatttggtttttggtttctacaaagaacagatatttgtttcttatagttctagatgctggggagtccaaaaatcaagtgacccacttctggtgaggaactttttgctacatcaccccatagtaggaaagcaaaggagtacatgctcaaaagatcaagagactgaactcacagcccccaactcttttataattggcattattaatccattcataaagatggagcccccttcacaatcacctcccattaggccccactaccccacactgttgcattagagattaagtttccaatatatgcttttagggaccacattcaaaccatagcattccaaccctggtccccgaaattcatgtcattctcacaagcaaaatgcattactttcatttcaatacccccaaagttttagtttgttccagcaccaactcataaggccaaagtcgagagtctcctctaaagagaatggtggtgagagtcaaggcatgattcattttgaggcaaatgccctccaactatcagcctgtgaaacgaaagcaagttatctacttccaaattacagtgatggaactggcatagagtagacattctcattccaaaatggacaaataggcaagaaaagaggggtaactagtcccaagtaagtccaaaacccaatagggggaaaacagtaaatcttaaagctggagaataacttttttaactccgtgtcttgccttctcagcacactgggacaaggattggacctccaaagcatcaggcagcccatccctatgactttagcaggcttactccacctagcagctctcatgggttggagtcttatacccgtggctttcccaggctggagcagcatattgatggttcagcagttctgaggtcttggaggctactccactctcatgactccactaggcattgccctagtggggactttctgcagtgggtttgcctctgcggcaagtctttgccatggtctccagtctgtctgtaacatgctttgaaatctaagtagacgttgccatggtcccagagctcctgcccgctgtgcacctgcagaattagtaccatgaggatgctgccaggatttacagcttgtacctttggtggctcaagcctcacttgggtccacttgagccaagactaggatggccaagaggcactgcattcagagagcagagtcctaaagcaaagggcagtgaatcctgaggtcctgtagccacctctctgaaaactttgctctgaaaacaaggcaagtcctatcttgccttgaaggtctgtgaaatgcctttaaggtcgttcttctattgtcttaatcaatagaacctggcttgcttctacccatattaatctcattagcaaagagtcacttggccacacacttaatattctctgctgaacacactttttaattctttacatggccaggctgagatttttctaaatctttctattctgtttcccttttaatgataaattccatcattacattattgtctccttctcttattttactgtaagcagctaatagaagccatgcagcatcttgagtactttgatgcttaaatattacttctgccagacctgctagctcatagctcttaaattctaccttcatgaagtcctaggacatggacaggattctgccaacttcttggtgactgaataacaaggatggcctctacttcagtttccaatactttgttatttccacctgagatgtcatcaaaatgatctttactttctgtatttctcccagtattctgatgatgaccacttaaataatctgtaagaagatttaggttctttttacaactcttcttttcttctgagccctcagaagatgcacccttaatgctccctgtatagtaagctaggcttttatagcctgctcttccaaattcttccagtctctactctttaccctgtttcaaagcccttctcacatcttctggtatttgttatagcaacagtcccacttcccagtaccatttatttatcttaatctgtttggggttgcatagcagaatacctgagatggagtaatttataaagaacagatcttaaggttctggaggctgggaagtccaatgtcaaagatcctgcatgtggtgacagtcttcttgctgcttcccatggtggaaggacaaaaatgcacatgcatgagaaagcaagtgataggacatgcaggctgaagtctttcataaacagtattattccatttataagtatggagctcttctgaccaaaacacctctcgttaggccccacttcccaatgttgttgcattggttattaaatttccaacatgctttttggggaacaccttcaactcatggcaggtatggatgtatgtgtgtataaatacataacaaacacaaatatatatatgtgtgtgtgtgtgtgtatgtacatatgcacatacacatttatataaatataaaaacatctatggtttcctggggatattatcttggaatcctgcattttttaataagtacaaagtgattaaatgtgagctcatattcgaaaaccacttcctttgccaaggcccaggccagtcacaaaagaggttattagcatttcattagttggattttctctgttgcgtctattaaagagcctccatttcccccattaatacagtgggtttgttgtcagagggtggcagcattataaataatgtgtgcacttttaggttaccagtttggagactaggcctatgttctgaatgttttcctgagaccatatggataatcttttggcatcatccagactcaaaccctctgactgcttctaataatgctggtgctttcagtggtcacaaaatagatcacagtctcaaggatcaatgtaagatttgaaggtaaggacatctttatgtgtagagggacattttctgatctggtaaataacttatcaagctgaggtgatttttttctcagttgtctcccttcccttatcaacacacatctctatttcaattttactgatttatgtactttactgctgtttaaatccttcattgtagtgcttggagcatctaggaacatatgtgcctcaaagcatcagtaaagtgtggtaggtgtctttgagggtgcctttaactgcaaggatggacatgcactggtttagctctgattctggtatcatctagtgatatctagtttgtgtctacgttcccccattttgtttttaaaaaagaaaagagttaaagaatcctgagcttactaaaattgtttggctcgcacagtggctcaagcctgtaatgccagtactttgggaggccgaggcagatgattgcttgagtccaggagttcaaaaccagcctgggcaacattacaaaaacctgtatctactaaaaatacaaaaattagccaggcgtggtggtgtgcacctgtgctcccagctactcaggaggctgaggtgggagaatcatctgagcctagggagggccaggatgcagtgagccaaaatagcgccactgcactttagtctgagcaatcagagtgagaccctgtctcgaaaaaagaaaaaagggttggggcggggggtgcggtttgatgtttattaagctttgaggaaggattcctactgtgagcatggaaaggcaggtggcgataagtgtgccaattttttcaccatttctgacctggaagttgtgaaatatttactttatgcaaactttactactgtatagaaaatgttacatgtccttaaagttgtgtagttaaaatactactaggtataaagggggtgagagaaataactgacatgaatactatgagcctattctaaatacactatttcattcagtcttcaaaaccaccctatgaaaaatgtattgttattcttatttagtgatgaggagacaaaagttcagagacagtgaatggttttcttaaaatagttcattgtaatagttggtgaaatgtttaaatccaggtctgcttgtttcaaagcctaaatgttttctcttaatatgttacagtctagaaacaatgattaagagaatttgagagtatgaagggaatactgtggtaacagcaaagctggaaagatagaaaggaccaagcaatagtagaccttgaatatcagaacaaggatttaatttttttaaatattatgcatttatgtatatgtatgtgttttcatatttgtaccctatcaatagtagaaaaatattgatgagaaaaggtcaacttattctaataaaaatatttgaaatgaaatatttcaaataatgaagaaatgtgtacacaaatatatgcatatatatgtacatatacatttatgtgtgtgtatataaaaattttgagtggggaaatgacagcacatgaagtttgtttcaagaagtttgtcctggccacacaacgtgagagatgttagtagatagatatttgcgagactagctaagggatgcttgagctagctcgaagaaataatgagagtctaaaccaaggtagtagccttgggaatggagagaaggaatggatgggagagattatgagccataatgctagttgacataatcagtttctctggacagtttccaaatgagacttaccttagtgaaaccacattcttacacactcataaattttctaagtaagataacaaaccaggttcctatgtaggtgctaaaaggctataattaaaatcaacccacttatttaaaaaaataaaggttaaggaggtgacttaattgggccacaggagagctatctatttatggtgagaacttcctactcaaaggatagcacatccaaaggcagtgctagtaaaacatttgagagtttggaaatacgaatctctgaactaggttattctaattccactaattggctgccaccacctgcattaattgacatactgacatcttttccctgctagtcccaaacatatgtggccacattgcccaaagtacacaaattacccactaaagtcagtgaaacttatggctcctgccgacatggtagctggattattattattatcgatccacttggctgcatcttgtcactatgtcacagctggcttgcagtactaggaaagaactattgcatatgcagaatcttgaaagccatgggaaaaaaaagtaagtggggaaaataacaatgttaatggcctcataacgtgctgtgcttcggtttaggacaaatgctggtgagaaagtccaatccatagtttggcggagagagtgttggctggcattaatgcaaaaattttatttaaattttaattatcggtggataagtgttttagattttgtgaacatccaatttgtaagttaattttggagtacctaacccagaaatcacataatctaaaatcattctaatgagtttggccgtgactcaattcacagttaaaggagagacgttactccaaatttagtctcatttttggatcatgaaaattcttagattgggtcatacacaccatggtgccgagtagtgcttaattaacttaataggccaagacttcattccacatgatcctgtgggatttgtgaaagcgttggtagccgagatagaagccaaatcaagaatgtaccaccaggtggcgcttaaggacttcctttcttcacatgtcactcagtcaatccaggatttattgatgtgagaaagtgtaacactagatacgcatttccagaagggtggcatgaaacttctttaaagatttcagaaataatatagtgtttctaatcataggattgggtctatctatttagtgagcgagaccactctctacacacacataaaggagacaaatgttatcaaacaacaatgataaaattacgttttgtgagacaactgtgttcattaacgcatttttttaaatctcaaaacatacaacattatttcatgttcaccatctcatttcttgcaagcggcctatcaagtaagtagtatttattattgtcattcttttcctagaagaggaaataaacaccctaagagattaatcaacatcacacaattggttaataacagagcttgtagtgtaatccaatgatctactccaaagcctgaaatcttaaccaatgtgtccatctgcctctgatatggcactggttaaagtgtagatgattgttctagttttcaacaactggtgtttaaaatttaggggaaattttaaagttttagttgacattaaagttgcattgaatttcctttctggtaaaagaaagaagcaaaaggtggtggtcaagtatattcagtaatagacacagaaagactataatagcaagtataatacacttgggccgcctttgtgaattaatttaaaaatgattgcatgcctggaattgcttaatatgaacttcccaatagaagaagctttgagttaccctttcttgttaataggattgtcactttttttctttccaactctgaacagcagataacactgtataatacttgtcccaacagaggctccaaatcagtagaggatggaaaaacactcttattcagagacccattttctttgttttataaaaacctgttgggaagaaggttaatcacaaacagagatgtaattcggcatagggaagacttccttccctattttgacaataaccttaatcttaattacttgattcactccaaggaagagtcagattaatgtacctgttagaacaccacctagtttctctaattaatgtaaattgtaaaatgttcaggaggtgttagaaatcagaatgtagtttgttcctataatttgaaaacatcctaatcaggatgtgttcttggaggaaagggctctttgtgtacctctaagaaaaacagtgaatttttcaagaaaaaaacaaaaaggcttgagctgaagtcacattggggatgttttgtctttctgagcacaggcatataaaataaaggaacccataactgcacaggggttggtctgcagatatgatgaactcctctaagtcatccagggcttataaaacaaaggaagtgcaattcaattctctgaaaatactaaactcaatgtttgatcgttagcacacagctgtcttcatcaccacccccactgccacaaccatcatcatcatccaaagtcattataattgtttaagatgctgcaaaagtagaaatgaaataaactctgtccttctcacctgagagttgaatatgtagatgtagaagataaaggaaagtatttattttaatgcacattttgaacacataagttttattatctttattatggtattgggtaaagtgatgtatgcagaaatattattagaggcaaaataaaccctttttctaataattttattcacttattgtcatagcccatttattgttactataaggaaatacctgaggcttggtagtttacaaagaaaatttggcttccaattctgcaggctgaacaagaagcatggcactagcattctgctcagcttctggtgagggtctcagtttgcttccactcatggcagaaagtgaaggggagttggcaggtgcagagattacatggccagagagggagcaagagagaggggagggaggtgccaggctctttttaacaaccagctctcatgggaactaacagagtaagagctcacccaccctataggaacagcattaatctcttcatgaggaactcatccatgatccagacacctcccattgggctccacctccaacattgggatcaaatttcaacatgagatttgatggagacaacccatcttcaaactataacgcttcttttaggtatattatttatatataattaatatgttatatataatcatatatacacatataaactatataattatacatatataatatatatatgtatatataaactgtatataatatatacataaatacacatatgagtatatatgtatatagtatatatgcatatatacacatataaaatatttatataatattcatataaatataaactatatatgctctatacgtgtgtgtatatatagtatgtgtaattttttacacacatatgcacatatacaaactatctgctatttactaaaacactttgcttggtagaaggaatatcaaagtcaacaagacatatgaactccaggaacattgcatctaataaagaagacaagaaatcagaaaaaactaccacctgtgaaacatgttatgctacagttaagtataggtagctgtaggagtatataagagagtcctccaacctatttttttgaagtgtttgtaagacatgatcccaggaaaaggtgacttataagtcaaagacagaataagcattaactgggcaaggggggaagttccaagcatttcagtctgcaaagacccagagataagagagtgatgagctcaccaggaatcctgagtagctttctaaggtttgagttaagacagtggaaagagactggggagagaggaggctggaaaggtaggcaggggctcatcataaagggccttcttttgctgtgaaaagtttaggctttatcctgcaaggtgtgaaggacacattaaaggatttaagcaaaacacctttgttctttgtgaagatcactcactccagatgttgtgtggaggaggaataggtgagtaagaggggaataaagggttcaaggtggtgatagctatttgaggcagagatatgaatatgctgactgagggaacaataatggaggtggacaaatttggatggcatcaaagtttagtacaggaatcatgttaactggattaatggctgaactcattgtgacactcaaaatatagaatagggttcttttgagacctaagtaagatgtgtaatttattcttaagataaactggtggtttggccctatattttgaagaaaaaacaatttgttgctgcaaaaagatggtgataagaaaactgggagttttagaaatgctggaggtcactgaaattgtaccgacagatttctaattctcttatctgggaatcatgtcttcagcaacttccaaaattgtgaactcacttgacctcggatagacaagcaaacattgattttgagttttcttaatggaggagctttgcatcatgtactttacttggggagattctcacctctatttgcttgctacgtctgttggcttctctcttagacgtggtcataacatcatcacttagctggttctccagcttgaaggggactagaagtactaaaaatgaagaggaaggtgggaagcaggccctctgacagcaggcacctgaagaaatgatggctgatatttattgtttgatgaagtctccatcatgtgctttctagatgcctggtaccaggtgtatcgcccatctgtggcatcaacacttggggattcagctggcaaagaaaaaaagggcattctttataatacgggtgcaagatctgaagagaacagacaaatttgaatcatgcaacattatcataatctcatattttactacccacatagtaaactggcaatgtgcttagtgacaaaagtgttaagaatagaatgaggtgtactagatgccacttcttagagagaaaggagtctcagatatttctaaagcatcacatcagaaatgactgatcattaaattggtcaaatatggattaaaaaaagctttgcagttcttaaagattttatttagttgaagaggagtagctttactgctttatggaaaaaccgtagtgttcgtttttcttcgttttcttcttcccctttgtttaatatctaaaagtttacctcaaccagacaaattctcaggtgtaatgagattcatttttgtggattctagagacgttgagaggtgctttattagctcagtttcttgaggattgcagggggtgtttgggcaccttttcttgactggttttatgaaagatgtgggggctgctttcccatggaaactccacctgcctgtagaagctctggcataaaatgatgggatttccagaaaagattccaattttaacttttcccactcaatggccaaactcctaaaaaaaaaaaaagggaggggggcatcaatttactgttccaatttggtcatgtttcattcacattttaccctgctgtaacttggcctcacagccatgccacccttggaacagttctcttcagattcaaactgattcctcttaggttactcccagcttatgtggcctcttggcagcattcacctccctttactataactttttcttgaaacaatggcagtgctctattttttccataatatttattatagctttaagggcatgtttgtgtggtaatttggtcagatctctctcctccattagacaagaagcctgctaagagaaggctcttggtctgttttacttaccattgtatgactggcaactgctggttgccacatagaaagagctcaataaagtgtattgatggcatgaataaatgaagggctcactttaggctagctttacaaacatgaaactgaagcaaagagaattttctaccttctaaaaattgaagccaatctccctatactagtttaatgatacaagtttgataactcagtagaaaatgtccagtaataactttaacttctcgtattcctgtcaagttctaccttaagacaagaagtaggcacaataatttcaatatctcaattataatgaatgataatagtaaaaatatttaatgatggatataacatgggcaatgagaagtttaaacaactattggctggaaacaatttatatggctctaaagctagtatacgctgaatattagcctgctgtggactgaattatgtccttcctaaattcatatgttaaagctctaatgcccaatgtcactgtatttggaattaaggtcgttaggcgtgaattaagattaattaggtcataaaggtgaaaccctaatcctataggattggtggcctcataagaagaaatagatctttctctatctctcttttcccatcccttcccctatgtgatcagaggaaagaccatgtgaggacaaagtgtcccacctgcaagctgacaagagagccctcaccagaaactgaaccctgatagatatgatattggacttttcagactttagaatggtgagaaaatgaatgtctgttgtttcagcctcctaatgtattatgtatttttatggcatcctcagaccagttcacagctctaattaatcatatcaggtacctatgtaacagacaaattggcattgagcttattattttttttaaaaaagccacaatgtttccagacagaaatcttctaccatttttataacatttatttaaaacttaaatatccattgacagaaatactcttctgatattgcatacccggtactcacaatagaaagaaattactttttctagtatgtgtatcctggaaaagcccatgtggttttctttcataaaataaagcataatttgttacaggaatttgcttttttttagaaatgctacagtacaccagttgtcacagtgtagtccttgaaggatagttctgcaggtgctccaaaaaggtagtcttgattaagtaagtgtgggaaatgatgctttattaaaacagtggtaaatgggtttattttattgctggaccttttagactctttcacaactagtgtgttgggtgaatttatcaataatgtttatgggactctcaagggtagatagatatataatgcaggattgtccaaagtcatttgacaaggagatccttgcttcacaacacaaattaaaaacccatggaactgatgtttttcaagatacgtatattccacagtaaatcgtagtgtaaaattaagaatcattttgcaaaggaaagaatcactgtatcaataggtttcagagcagaaaaaacaatctaggtatttccagctactaagtaaatcacaatgctcctcagtcccaaatatgacacctgtcaaagagatcaaaggacatggagtctgctgtgctcatggtcatatctgcagagaccaacacatcagcctccactgctggagaaagatggctcactctctctctctctgtatcttccacattttgtgcaaatgcatcccattggcagatagaaattgaatccagagccatggtagtctatgaaatataatacctagacttccagcctcagagttatagagttgtgaattgtacaattctggatttctatttattttgtcactgaaactcactgtaaatcatattctgagacttcttacatcctgtttccacactccttttccttattccctcagggaaaatagacaactaatctctttaacactttcttccctgcttgaagaaattgtaggcacacagtaggggctttgtaaatatttgttaagtgaataaataaataaaggacatataagttgttatgtgattcagccaagaggaaaatactgtgaaatcagaagatagttaataattgattggcattgatgtataggcttcagaaagtgtcacagtggtttcatgaattgactttattgatgacctatttcagttaccgtaagcatacctgtacaataaaattgaattaacgtgtatttactaccaggtactcaagaaaaacaataagcatattgaatatgagactaaaaaggataagacaaaaagagtaacaatcaatcatgaagcttctacaatttcttcctttcttttctcctaacaacagtggtcaatgactctcaggggacctgacatacttctactcagcatagatgggtcttacagatgatggagtctcaatgagtcctcctggaatgtggcttaaatatgcaggctttcatctatccctctatgagaagccagagggcttgaagtatcagataaattgtataaatgtaaggccaaccctatcagccatcaatctatgtcaaatttcaaaattatcatgtctttctaaacgtttcctatcaatgaagagttacatttcttctggctttgttagcccacattattacctcagcagtgtgtgtgtgtgtgtgtgtgtgtgtgtgtgtgtgtgtgtgttggagaggaagggcttatatctcaatatattattttattttaaaatacaggcaaagtaggggggagtctatatgactaactcaaatactgtcactcactggggtgaacattctaagaaatcaaagcattctcctgagtgtatcttcttaatcagcaaagtattatatttggattttttcaagaaaaacaaactccctacctaaactctgaatgttagtatggccttggtctctctgagagagagagagagagagagagagagagagagacagaccaagaaggagagagagagagaaagagaaagagagagggagagggtgattgatctctcatacatcagtcactgtgtcagagtatcaatgaatttcttagagtatccctctaaaaaaagggagaggagagttagaaaaagagaatgtacaggtaataaccaaatatttaatcatcttgtaattttctagatcctcttataggttctttgggaacatctgactagttctggtcaatgggttatgagcaaaattcacatcaacattcatggcctgggggtgaatgattttctctctcattttgccaacatcatttctttctctgattctatgaacttggaggccacacataccaccagtagaggctagaaaaatgacgtctgacccacatcagatttggtgaaggagaagacaagaataacaacaaaacacacacacatacacatacatatacacaaacaaacacatattgtgttacccctcaaacatttcaagatgtattttagaaaggagtatagattaccctcacaaatgaggggacagagggtgtcttcttaataaaaattccacagacaggctaaattccatttcaccttttttgaggcaaactcctagtaagataaacagaaatgggattaaaaatatccatgaatatatcctggaaattgtatacaatacttcatgcacatgtgcttttcatttccctggagagaggatagataacttacattggagcctctaaaaggtttagggtccagaaaacatcaaggaatacaatgtgaaaaatcgcccttatttagggaattttgagtatctgtggaatttgaaaatcatggaggcagttaccaaaaggcaagaagcttatttaaatctaagatagcctctttgggctattgcatgtctatggagcctgtgcatttggaatttgggctgcaagaagcaggcatgtggcaagtgatggacgcaccagtgatgaggatgaatcatttgaagccaagaggcctgttcaataatgtaacacaaagggattaaaagaaaagaggaaagaaagcactgagtagttagtctttgtgcttgcaagtcttttgtttccttgtaatctccttaaatgtgattgctgtgatggtgaaggctcttatatttaatagactcttgagttactttggagatgagacatattttccacttacataaaacacactttgtaccagaacacagatgctacaattgatacccccacgtcttaagagaaaatttgaaaaagagtccccaaagatttcagaactgcctttactataaatgaaagaatgattgcagttatactaaactccagtattaatgcagcagaaatagaagaaccaaagatggtgctatttattatttcccctcttggagagtatcagcaaaaaatgtttttttttttttaaatgcagttaaccctggcaaaggtaactgatgcaggtacacagatttgtagtcactcctcaaattgtcaatacattgtgctgtttgctcagcaggtgccctaaattgtgaattttgttaacgaagagttgtcaagaagtattggcttcatttagaaagcgatattcttctcagtagccttagtcttactttaggaaatccacaggggatacgtaacttaagggttcagattgggaggcgcctattattattccccaaatctttgcaggtgtccccaaaagcataaaagattaaattatacgtttttttatttgtcgactgtttcaaagtacaaacctataaaaggggaacactggtactcttttaaaggttatagggcatgaaaccacctttaacttacacgaaatgctttgaatttgtataatttgcttctcagatctcaaaacacttggtcgtatttcactgaatttgactcatccctttgggcaagaaaggttgaaaaaaagaaaatatcttgcactacttgctttctaaagccactccaggatgaaaaggagatactgaatgtctttgtggctgtataatttttagcaggggccattttctgtgcattcttattagaggaatatgtaggaatggtctgtttatacaaagacaggatggattatatgatatgattttgaaaatgaggaatatacctcttctaaaacacccatccagtctaaaacagtgtctgaaatctaagattcaaaaaaagccacttttttttttattttagggaattgtgagcttctatagagttgtcaaaacatggaggcagttaccagtgtattagcagcacattacccagatgctttctgaaccattaaatagggatcacaaaaagttattacttcactgaggacttttaaggattaaataagatgagacttgtaaagagtttaacatagggcatagggcagagtaatctcagtaaatgttaacaggcagtactagcagtggtggtagatgtcaaagtcactagttgcacccaataacatttttgcacctgttactgcatctatagatttataaaatctgaacgttagagacaatcaccaggtatgcagagtaattagttcatttcttcctcacttccttccttactctttccttctcattgtctcttccttacttcttctctccttgtttgttcatgttctttaattcatccaaccaacaacatgcagtgagcacctatttacaggcattttggataaagtaaagatcgaattaagcacaatcactgctcatgtgaaatttacacatgagagaatagaggcaaacagcaaaccacaacattcagaaataattattgctgaatgtgacatgcattatgagggagttagcataggaggcattaacgggctgaaacctagacatctaaccagaagaggggttggctcatgtatttgttcatttcacagattagtataaagctttaatctgattatttcctgagtttcttgctaagggatgggcaaacaatagtagtaaagacagacaggtatttttcctatttaagttctcattttagttttcaaattttgctctaagaaactctaaggtctcataaatgctctgaagtgccactggaagctctaacacctctctgaggaagaggatatgagctgagactataaaaccgcaaactcacttgaattggagtacagccaacctttactttgcacagatcatgttaacacaaatctgtgtgtgtgtgtgtgtgtgtgtgtgtgttggggggaacctagttcttactttacccaatccccacatgttctgatatgcaatagtttcagttagtagggtatcatgcaatgtgtggaatacccatatgtcttcttatatatgcttggcaaaaagtatgctgctagaaaaataatagcagccattgattaacttccattctggggcataattttcgagttcaagattgttacaagaatttatagctttaaaggactatcctatttcccctatacttcctgggctaaatatcccattctcttaaatttttcttataagaatcagacgaattgccctcactaccctggtcacttctttgcacatgttttttcagtgtttgccaatgttcttcttaatgcttgggacccaaaacaaaaccatgcccgttttgccattagaaattcatctgtatcacccttaagttggtttatcagagtgggagacaaatctatgtaattttttattgtaatcttagtactgcagtgtagtacctagtttctaattagtactcaatagttatttcattaatacatactccaaatgtggtgtaaccaaacacaacatagatatctgcttttataactatgacactatcacattaactttcatctagccacatgacacagttgattgattttatgtttcttatcaatttatcaaatcagcttcttctcatttgtgaaagtcctgagggaattgacacaagataggtaaagtttattgggaaggaattatgagaactaataggtgtgaattggaaaagtcagatctgagtaagattttaaagtgggaaggaagcagttatgaacatcatgacctctctcccataaatactttgtgcttggagaatgaaaagaataaggaaatcagaaatacaactttcacatatttctgaaaatgccaaggcatgatgcagatgtttaatgggtttatattttaaaggttttgcattatagtattgatttgaataatttgaaatttcatacaaaatttcattacctgttaacttgatgaaattcactgaagaaagaaagaaatgttacagaaatggactacaccataatgactttcatattcatgtgagattgttaatgtagaccaattgggacttcaaatggtgtggtagaaaatgctctttaatgccaaatctgggcaaagcaacttgtcacatatgggaccaagcttaaaacattcattctcaaattataaattatactcctgagaatttatactacaaaaataatgcgaggacatttaaaggcttaggtaaagatagtttatcataacattcttgcgattgttagaaaagagtcgatattcattaatatggggcaagtaaaacaaaatcatggttaaatctatgtgatggacaatcaattagacttccacaaagaggcagagcagtatgtatagtaagatacctttaaacttaaaaaatgcccggaagggtaaaattaaaactaataataatggttacctagaggaggaagagagaaaggaagaaactagaagaaacagccttgattatttattttcaaatttggaaacaagcaaaagtttttgtcttgttttgttttgttttaagatggagtcttgctctgtcacccaggctggagtgcagtggtgtgatctgggctcactgcaacctctgcctccccaggttcaaccgattctcctgcttcaccctcccaagtagctgggattccaggcgcgtgctaccgtaccgagttaatttttgtatttttagtagagacagagtttcaccttgttggccaggctgtctcgaactcctaacctcaagtgatccgcccgcctcagcctcccaaagtgctgggattacaggcatgagtcaccactgcacccaggcaaacaggcaaaagttttctattaatcacataatgtgtgggaaaaaatccttaaactccaaagaaaaatgaaacagaagaatctgtgtataagttagtagcttaatggtacaaagaattatttgaggatactttgaattttagtaatttgtgcagctttgtgaaatatatcttcatgacaatgagatatgcccacaatattaaaatttgtatgtttcaatatttttacaatatatgttgtttttgaattatcatccacatacttttgcataaagcaactgaatactttttatgtcattagagaagacagctaaaagaaatataaagtcaatgaagttaagcaaaaatcttataattcaacatttgaataaaaatgatcaaaatgaactcatgacgtttcttatcttaacacagtattttctacatctgtccactgaaaaagtgtagaaatgatgactatcccaatattactgaatagccccagcatacagattatggtctctaaatgccattgcccagttaaaaggaaatcagacaccttagacagatggttgatcccaggttttgggggaaataatatcctataaaaatgagcctggaatttctttcaaaaaccaaaagcagcaaagccgcctggacatggtggctaacacctgtaatcctaacactttgggaggccccagcgggtgggtcatccgaggtcaggagtttgagactagcctggccaatatagtaaaactccatctctattcaaaatacaaaatttagccaggtgtgatggcccacctgtaatcccagctacttaagaggctgatgcaggagaattgcttgaaccctggaggcagagtttgcaatgaaaaaaagcagcagagccactattactgtaatcagatcaaaggaaattatagtcatttttaagagcataatcccatcccagaaaatacagaaaatgtgaacattagaaatagtaataagattgaaatgtatcaaaatgtaaaatatgtaagtgcataatgatacaaaaaaagatggataaggaaaaataagcaagtttttctttatcttttctatgcaaacaatacctcaaggtagctaaagagtttctttatatagaagtatttcagataatcaatgaaaaataatgacaaaattagattattacaattttgtactcactaatacaaatatataattaataattgctaaaatccaagttttggaaagctaatggaaagctttaaaatggataggtcaggttgtcaacaccttttaaccttaggaatacacatgtgtgcatgcgcatgcacacacacacacacacacaccccacacacagaaatcagaaaagacctgcctactgatatgtacaataggaatcattaagcataacttacatctgtaaattacccatgccaaaatattgaacctcagcctgatcaaaccttaaaatgtgcttatcagtttgcaagacacacaaaggagagagcagcattaaaacaaacaaacaaacaaagaaacaaaaaatccccacattcaatcaatcaacaaaattcagaatgtgagaaattctttaggacaaatgactgatttatttaacaaattaatggcaagaaaaacaaacaagagtaaaagatgaaccaagagataaagagacttaagagatgtcaaacaaattatatgtagtggatatttttctttagtagacatttgaaaactcaaaatagtaaaacacttcttaaaaagaattagagaaaactgaacattgactacatgatataaaaaatcattttctggctgggtgcggtggctcacgcctgtaatcctagcactttgggaggccaaggcaggcggatcatgaagtcaagagattgagaccattctggccaacatggtgaaaccctgtctctattaaaagtaaaaaaattagctggacgtggtggcacttacctgtagtcccagctactcgggaggctgaggcagaattgcttgaacccgggaggcggaggttgcagtgatcggagattgcactactgcactccagcctggtgacagagcgagctccgtctcaaaaaaaaaaaaaaaaaatttctaatgcattaggtgcgattatggtattatagccagattataaaatagatcattatttttagatatgaactgaattgtttatgcatgcaattaaatcatatctcagatttgacttaaaatagctcagtttagtgggaaaataatgggtggtggtgtggatgaatcaagattggacatatgttggcaactgtccaaattgagtggagcgtataaggtgttttaatataatattctaattttatatatgcctgaaaatttccataataaaaagttaaaataatatttttaaatgatagaagagcaattagttctgggttatataatttatggattttttatttttatcattatactttactgtataattttcttagtgagggtatattactttcatcttaataaagaaaagatatataaattttaaatgaactcaagactgaatctgagctgatatatccaggagcaaatcccttgacatttgccaagaataactgtgttagttttctagggctgctgtaacaaagtgacacaaactaggtgtttcttataacaacagaaatgtattcttaatagttctagaagctgtgagatccagaatcaaggtggctgtagggccacatttcctttgaaacctgtagagaagaatcactccttgactcttgctaatttctggtgactgctgtcaatcattggtgttcttgatcttgcagttacatcactgcaatctctgcctctgtcatcatgcggtgttctccatgtgtttctttttgtgtctcatttcctcttataaggacaccagttatattggattagctcacactactccattgtgacagcatcttaattaatcatatctgcaaatatctcatttccaaataatttcacattctaccttactggggttaggacttcagcatatctttttaaggaaacacagatcaacccaaagcaatcactaaatccacccatgcatcctgaaataactgtgatgtactaggaaagtatcagacatacaactgaccaggatttaaattttaaataagcccttcattccttgtatgaactcaggtttaattctttgaatcatactcaccttggctgatcatcatcatcatcataatcatcatcatcatcaccttaattgtcttagatcagattatctataataaagcctaaggtagagtttgtgtgctaaatctttgttgagaggtaaaaccagacaccatgctgaggagaaacttgcttcatctgaattcaaaagtggaaaaaggaggcaaagtctttggtgggtagggtggagatggataatggcagataaaattgaagatgtttccaaatctagcccttagtattttaggagactgttttaatagatgtggcatatgagggcatgtcctgaaattttcactgggaaacagctgaggttcgggagcaggtagactcatcaaatctggagtagcacataaactgggttcaataaaaactcgttaacttatagatcagttgtgatgaatatatgagataatacatgaatggattctacacttctatgcactgcctggtttaagtcaggcactctgtaaatggttattgctgtttacttagacgggccacatcccaactttcagagagcttacgaagcaaaaaaatttcaaatttcttcaagagttcagcctaagctgggaaaagagggggcacaccatgtttaattgagaatattttattttaaagccattatgatttgaactcagtcactgaactacatataactaaaagacaactgatttcacaatttaataggagcatgaagagaagtgtgccttagattaaagtttgtgcctttgaagtatcataaacaagggttcactcattgatgaatgactcatttttatttatttatttattttttgcaatgaagcaaaactcttttcatttaccatctcttctcccgctcctccccctcatcctccttaattcttcttatagttaaaagcctgggctttggggaaaaggagatttaagaattcaaatcccagctttgaaactcaaaagctaaatgcaaattgtttaacttcttaagctttagcttcctcaattgtaactaacaagttacaaggattaagtgaaataacatatataaaatgcttagcatttgctatccattaacagtgtccactgttcatctccattttcaaaatctttcatgtctttctcgtctccagaagtgaccacagcagctgcataacggccacctttctcccctaccttgtaatctctctcttctctctccttgtatcgtaacaagagagagccctctcgaaggtaattctttccatttcattcccttccttaaattcactcagtgacttctcattaacagaagaccaacaccaagtttctaagttcgggccttacttcttttacttcattcctcattatctccataacagacacatggacactatctgccatagacacttggatctttctcctggacctcgacacctgcaatgtccttgacacctgcccttgatacctagctaatttctgcttgttattcaggccttagttgatgttgctcttccaagccttcaaaacgccctgtgccatggcatttatcacatcattttagtatcagtcctctgtctttcctctctactatattctctatggtatctttcatctctagtgttctagatacagagatataggagataaccaataaatactgtagaatgaatcagtaaattaataaatgaatgaatgaatgaataaatgaaggaacccacacaagctcttctttgcaaatatggtcaatagagtattgtctaatttgcaaaagccttggagtaacattaactgaaacttatagcaaataaacatcttgaaaaaataaggtaataaaatatcttaataagaattaggtttgacataacctaggctctgggttcaccctggaagaacactccagtggaagtacttagtgcccgaaagttggcaggacctcctctaacaggggtggctgcacagatgttctgggaagcagaacactgaagctccctgctttaggataaatggtgaaggactcaaccaaaaaatccactcctttcctacttacctctgaggccctggagaaggagcatccttagcagtgacaagggtatattgatgttctaatgttttccttaaaggcataaaacccaggatctaaatatttaccagcctatggaagagaaccatggaaaatgaccactattaaattttttactaatcttggaaactagtctttcagtatacaattttaattgattaagaaaaatagaaaactatgacttcactttcatggtcattaagtatcacacaccatccatagtgtttacacatttagttttgcataattattcatatcagaaagtttgaagaaattctgtcccctgtgtttgcttatgataacttcataccagcgcacagcaaattccatcatgttcctttaatttgattatctcagtttatcgccatcatatttctgaaatataagtgctgggattattgacttagttttcttacttgtcccctgccatttcctttgtcttttctaagttccctttgtttataattctcacataatgttaaggaggaataaaatcaaaggatggaaaggagctaaagttgatttttagcatagacaattgaaccaaaggtagtctgttattggggtaaacttctactttaaagtatcccaatcaacccactccctgaaattaaaaagtgtcttaagatatggtaactactctagtagatttttttcattggtatgaatttgttcatattaattttaccctttggcttaggacaagggcaagttaagggaaaatactcttccgtcttttcctttccatttgttcatcctgaaagactattttcagaaaggaagtttttattattataattcttcaactacagggtgaatgtaaaatacactctgtgagctagtttgagaagccatataccccacataacatactttctaaatgatgctgcactgttcttccccaaacactgagttctcctaagtcagaggctgattgtgaaagagaactccccttacctaaaatctacttctgaggcattaatctagggtttccaatttatgtcagctaattttatgtattagaaccatcatccaggtattctccagcctttccttgaagtgtcatttctgaataataatcttagaatccactttcttaagcatgtttctcctctccttgaatatctcatagcaatggcacctgagttcagtatgttgcatttattttaatgtttgtatttgaaaaactgtgaatgcacaattcctctttgaggataccacatttcttctatgtaaatcacaccttagaaaatattaaagattttaggtttttaacccattctaagtgttcctatcatttaagaatatttccacctcacaccttaacccagacttaattgtacagtgtacaattacactgtaagtggctaattaagaaaatgctcaatgtactgtagttgagagaacttcctattcagggaattcgttctactctttgttaggagttgcaaataaaacaattcaataacctgaatccgctccaaacaaaatactaaccaggtatcttcacagaggcataattccagctagaataaatgtgcatgaggattatttctccttcctcctactgcctcatcctattattatccagttccacatggcagagttaagaagcacagcatctgcatttctcagattgccagtcttcttatcctgtactggtaggatgacatctatttttgccagcggtgttgctgcaaccgttacagcgggtcttcctttctttataaaatgaatcaaattacaggtgcgcagcatggttgagttcagctgtatatctccaagttgcacgaaaactaaagctgtctttaacttaacatagtattggaagttctagccagggcaattagacaagaggaaaaaataaagggtattcaaacagaaaaagaggaagtcaaattgtccctgacatgattgtgtatttagaaaaccccatcgtctcagcccaaaaactcctgaaactgataagcaacatcagcaaagtctcaggatatgaaatcaatgtgcaaaaaccacaagcattcctatacacaaataatagacaagcagagagccaaatcatgaattaacttccattcacaattgctacaaagagaataaaatacctaggaatacaactcacaagggatgtgaaggacctcttcaaggagaactataaaccactgctcaaggtaataagagaggacacaaatggaaaaacattccatgctcatggataggaagaatcaatatcgtgaaaatggccatactgcccaaagtaatttatagattccatgctatccccatcaagctaccattgactttcttcacagaattagaaaaaactactttaaattttatatggagccaaaaaagagcccatatagccaagaaaatcctaagcaaaaagaacaaagctggaggcatcacgctacctgacttcaaactatactataagggtacagtaaccaaaacagcatggtactggtaacaaaacaaatgtgtagactaatggaacagaacagagtcctcagaaataatgccacacatctacaaccatctgatgtttggcaaatctgacaaaaacaagcaatggggaaaagattctctatttagtaaatggtgttgggaaaactgactagccatatgcagaaagctgaaactggaccccttccttacatcttatataaaaattaactcaagatggatgaaatacttacacctaagacctaaactataaaaatcctagaagaaaatgtacctgaatgtaccattcaggacataggcatgggcaaagacttcatgactaaaacaccaaaagcaatggcaacaaaagccaaaattgacaaattggatctaattaaattaaagagcttctgcacagcaaaagaaactatcatcagagtgaacagacaacctacagaatgggaggaaatttttgcactctatccatctgacaaagggctcgtatccaggattgaaaaagaacttaaacaaattgacaagaaaaaacaaacaaacaacttcatcaaagagtggccgaagtaatgaacagacatttctcaaaagaacacttttatgtagccaacaaacatatgaaaaaaagctgatcatcactggtcattagagaaatgcatcaaaaccacaatgagataccatctcatgccagttagaatggcgatcattaaaaagttaggaaacaggctgggcttggtggctcatgcctgtaatcccagcactttgggaggccgaggcaggcggatcatgaggtcaggagtttgataccagcttgaccaatatggtgaaaccctgtctctactaaaaatacaaaaattagccaggcatggtggcgcgcacctctagtcccagctactcaggaggctgaggcagaagaatcgcttgaacctggaaagcacaggttgcagtgagctgagatctcaccactgcactccagcctgggtgacagagcaagactccatcaaaaaaaaaaaaaaaaagaaaaaaaaagtcaggaaacaacagatgttggagaggatgtggagaaatcggaacacttttacagtgttggtgggagtgtaaattaatttaaccattgtggaagacagtgtggcaattcctcaaatatctagaactagaaataccatttgacccaacaatcccattacttatatatacccaaaggattataaatcattctgctataaagacacatgcacacgtatgtttattgcagcactgttcacaatgggaaagactgggatccagctcaaatgcccatcaatgatagactggataaagaaaacgtggcacatgtacaccatggaatactgtgcagccatagaaaaaggatgagttcatgtccttctcaggtacatggatgaagctggaaaccatcattctcagcaaactaacacaggaaccgaaaaccaaacatctcatattctcactcataagtgggagttgaactatgagaacacatggacacagggaggagaacatcacacaccagggcctgtcagtaggtgaggggctaggggagggatagcattaggagaaatacagatgatgggttgatggatgcaccaaaccactatggcatgtgtatacctatgtaacaaacctgcatattctgcccacgtatcccagaacttaaagtataataattaaaaaaactttaatttttaaactcctttgtcagcttacaatagcagccataaagaaactcagacaatgtgttccacttaccactctgcttcccttctaaatatcaagcagttggttgtaaactgagctgttagggcacttctgttgcaaagcacacttaaaaataaaaggaaaaatttggagaaaaattgttttaatataagaaaattttcaggcacctacaaagtcagggttgtggttagtgaagttgaggtaatttactgaaacttgtacaatgagtagactggaggattggaggaatctatggatttattttaagatatagagagcatttttttgttttgcagttattagattcattctgataaaataattttaccggaaaacaccaacaacttagttgcatgaaattttgtaatacatggggctatatgatccaaacttggctatctaaattatttttcccaggattttgagccttgaatgtagtcatgtaggatcgaaaaaatggttggagctgatttactgctgcagtgaagagacttcctgatttggattgaattgtgccccactcaaaaatatgttaaaatcctaaccatttatacctgtgaatgtgacctgatttggaaataagtaattgcaatcaagttaaaatgaggttatactgaattaggatgagccctaatccagtgtcactcgtgtccttttaatacgaagagtagaggcacagacccagacacagacagaagtccgtcatgcgaggttggaggcagagattgcatttatgctgccacaaaccaacagatgcctggtgctactagaatctagaagagggaggaaaagatcttctcctagaggttttggagaagttctgccaacaccttgatttgggactcctaggctttataactatgagaaaataaacatttgtggttttaagccactcagagtgtggtaatatgttatgttagctcaagaaaatttatacaccttccttttgcttcttctgctttcatctactgagatgctctatttctagttcctttccaatgctaattattttgtttttccttttttttgtttgagtcacactataatacttccaataaattccctttaaaattaagttgacccaaatagattgctgttgcttgcgtcattttgtcctagctgataagcaaatatttcttgctatcattcctgtgtcatttggtattggtagactagactcagtttgttagaaaaaatgaccaaaacttggaagtctggtgaagggagggttgcatatactcttagagccatattagatcacaaacattttttaataagcccacgaaaggagtgcttagttatctatagtataccattgtttgacttaatatttactataaagttccagcttgtgtgaacttacatgttaacttgtggatttttgtctagcagagatacaagtcattatttgcttgtagaaaaagtatcccaaaggttatgttagccatcttatgcctacatccttttttcactgtgtatataacccttattctaataattctcctttgaatcaccttttcattcctgttgaccacttcattaatgaggagagccagtgttataatatttgtataaaaatcatacttttaactatttgaatattattattgttattattgtttcttagggacagggtatcagtctgtcatccaggcctgaaagcagtgtcaccatcatagctcactgcagctttgaactcctggtcccaagtgatcctccgacctgggcctcccaaagctctgggattacaggcatgagccaccactctcggccaactatttgataattatactttgatatgtggcatgcgcagacaagattatttgagaacactgattgttccagattagctgaataactgtgagcacatccacaaggcagaatttaggatgttgacattaaattgaaaataaaagaggacttcagaatgctgagagaaaagtatgattttttcttcttaagattgaaaaaaataacatctattagtttaaataaaacctatccactcaacaaatattgatttagagactagtaattgtttcttaaatcgtaagacaacttttcactgaagatctggtcagagagttgggttaaatatcttcaaatcaaaactatttcatccagttcttcgggtgaaagcaaatcaggacacagaagcataggaatattacatatacattatattgatatataatatattatttattatataatatacataatatacaactgaattccaactgtaaattatagaaatttgataagaaaattagataatttcacatagtaagatcagactttagttttcattgcattattgaaacatgaatgaaatataacaaagaatgagtacaaccaaatctcttaacaaacttaatgtaggctcaagaaaacatttttgaaaaaagcccggtatctccccagtggaaagatagagttgtgtgtgtgtgtgtctatgtgtgtgtgtagtagtaaatttgggacaaaatgatgggtaggaaaggaaacacgaaggatactgccaccttctgagtgttttatggccacctctgcgaggagttcttaaaaaaaatcaagtatttaatacttactatatgaaaacatacattattgtcattaacacagataaagctaagagaggttaattttctttattagggttatgcaacagctgatgcagagccagaattcaaatttatttctaactccaatatttgtattttaggttttctattaaaggatattgcctctcaaaatgaaattgacattattggtggatattcagaattctggttgatttcacaagttgtaagttacaactatgacctttctgggatagcacatggtttgatgggaaaagtatagaacatttatttctagtaccgcattgccctgaaaacaccatgtgacctttggaatgtcactttttgctttttaggcctcagttaccaaatctataaaatgagtttatcagaccaaatgaatagactcataactgtggttcatagtattggttttgcggtaaagtagttcaaccgtatttcattcaaaagacatttattggagtgtataatgtaaataaatctgagatgcccttatttggaagatggcaattactttctgtacccctaagaaagaatgaaaatttattacttaaactctgacataatgccttattattggtgttttatttcataccttgtaaggaaaacttttaaagccttatttagaaatagatatttttactatatatcacctgttcctttacaaatagaaaagtaccagaaaaataaatttggttaaggttttcttaaaacatctttcccatttagagttcaatttttctggataacttttagactcaacttttacgtatttctccacacattagcatcttctaatgcttcacaactgttggtaataaagcattacttaaatgaatgttgtattatgtccttgaggttttcttagaagccagtgatatattgtactcaagttttgatgctgggagatatgtaagtatgcatacacacttatgtgtttataaatgtgagttgtgggtatatatgttctatatttccacattatgagcaactaagggagaacacttggatatcgttcacgttgatgtttcttccaacactcactacattattattcacataaaaagaactaggaaaattttgatggcagaaaatagagctaaaatatcttattcttattttacaagtttctaactatttggtttcatgtgtaaaaataagccacattaactagggtgaattttctatatctactgaaaatgtatttctaaatgtttaccatatattaacaataaaaacaattaggatagtaaatggcaaacagtatcagtgaaggaaaatttttccttagaaaagatcatttaaaactacattatttcatgaagttctgctgtgttatttgttgatatctgactaattaaatgcaaattatcaaggaaccatctgccaggctcattcccagcgatcaattgggtaaataaaggtaacaaaacggtgtgtttggttttgcatctaacacagtatttgttttattaccatcattttaaagctggatttttattgccattttatgtgccttgtaatttgtacattaaaaataagggtttcaaaaataatgatcattttgcatttaattcaacagaaatgaagtgcataaaagcttgttttgattgaatactgaatcagattccaaaattctaagtgtcccaacacaggccagtctccccaaacactcatgtaataattctgagttacattggaaataatttgcttaaccatgtcaagcacatgagcttgtgtgttctagaacaagttgtcccaaatggctatacttcagcgtatcaaaaaaatcatttctctcaacttactggtttataacatggaaagcagagtcagccttctacctggtgtacctgctattattaattactttgtccaattctaggaatttcgcaatgagtcctctgacgtgaatgctatttttgacacacacacacacacacacacacacagagagagagagagagagaaagagagagagagaaagagagagagagaatattttaaagggatggtataacataagaacccaatggagagcataatgtaacatgaggttataagagcagactctggagcgaatttctgagttcaaatcgtgtctcaaccatttactagctttttgaccttaggaaagttacttaacttctcttgtcctcagttttcttatctgtaaaatgggttaattaatagtacctaacgtataggagtgcttcaagagaaaactaatatttataaagcacttagaattctacctgctacatattaaataccatattatttgtgtaatttaaaatatataacatatatttattaattgagttatgttttcttactattgatttgtttctaatatgttttagatattaaccccttctcagatgtttagtttgcaaatcttttcttccattctattgtttgtctcttcattctgttgactctttcttttgccatgcagaagcttattagtttgatgtaatttcatttgtctgttttttttttttttggtgaagacctgtaggtcacaaatggccgaaaagtatataaaaaatgctcaacatcactaattatctgatactttaaagttaaaaccaaagtaaaatattccctcacacctgttagaatggctattataaaaagatgatatttaataagtattggtaaagatgtggagaaaatggacgaattgtacactgtttgtgggaatgtaaattaatacagctattatgaaaaacagtatggaaatgcctcagaaagtgaaaactggaacttccaagtgatctggtaatcctactactgggtatccaaagaaaatgaaatcagtatgtcaaataagatatctgctcccctacgttcattgcagcattattcacaatagacaagatatggaatcaatctaagtggccatcaatgtatacatgaataaagaaaatatggtgtatatacatgataaaatactatttagcctgaaaagttgtgaatcctatcatgtgtgacggcatgacataacatggaatacattatgttaactgaaataagtcaggcactgacaaacaaatacaacatgatcccacttaaatgtgaaatctaaaaaagttgaactcttagaaacaaaatataatggtggttaccagaagcttacgtggatggggttcaaggagatattggtcagaggacatgatattttagttagactggagaaataagttcaagagatatgctatacaatatcatgattacagttaataaccatgtattatatgcttgaaaattgccttgggtgtacattttcagtgttctccccacacacacaaaaaatatgtgaagtaatgcatatgttaattagcataatttagccattccacaatgtatacatatttcaaaacattatgttgtacaccataggcaatttttacctgtcattaatgataactcacacacacacacacacacacgtgctcacacacatgcatttctatgagaagtcccatcacttgctggaagattttgcagatccctgatgaatatgtgacagaatatctacctgttttattctctattttcttctcttacctcctataaataaacctttttgctatgactcaaaaactttattacaatgcataaatgtgtatataatgtccattagctgattaattcaatgaaacctaaatctagccatacacacattgaaagtcaaactcactgagaacaagtagaattgagtggatatcaccaagtttcagtaggaagccagtcttacctaaactgtctccctcagatattcctattgagaagtttctgaggaaggctacagtaatgaaagtattcacaaagtcctaaaatgttgccagtaatcagtcagcatagtgaccactgatccagctcaaactcagttatcttcactagctaaatcctgttacatggcttaacaaggagcactgactttgaatctgggtcataaagggaattcacagtgaacttttacaaatgttgcagactcagcaggatccaaataaagaaagtcatagattatgtctctccctttgaattggaaaattggtacaattttccgtattgcctaagtatcctgatacttgctttcttttacgaatagaattgatttccaatgcaatttcatccacctttgtttcttttatcatacgttaaacatggataagagtctcttaagagtgtacacatttttagaatggaaagacaattcagtacttaataggtgaggctactgggtgtcttctcattgacctcagagtgtctcattagttcccattagtctccagcctcattaaagtaatggatataatgcaaatagatttcacggaacagctctgcaaaagttcaattgtcccattttactattggtgtatttacatattaagttacacattaacctgtatagtagtgtgtgttttccacactgtataccttggagtattagttctgtgtaatatgaagaagtgttatgaggaaaaaatgcagtcacatttgtttgaaaaactgagttcaatcaagagatacaggtttttttttttctattgttattgttgtttttactgttggacttctcaaaaccatgttaatatgcatggtcagtcttcaatgaagagatgcagtaagccgtattcccaatgttttgaccactttttttttttttttaacttagacgatttctcagaactggtgttctcttgtacacagtttgggaatgactgcttggtacacttgttgttatttctgaaaattgatattaaaataataatttatgtactaccacttgaattcttttatcagttaatccttcttccttcttgcagatagtggagggctaagaaaagcaggaagtcatgaatgattgagaaacaaataaatgccacttatctcattcctcccctgggaaaaaagaacagctttgaaatttactgtatctgtcaccaatggagaaattgatagtattgagtatatttaaaagaaaagctattagcaagatcagttaggactgcctgagtgaatttccaactgttttccccatactaatgctaagccattgctagaattccttctatgtggcagtgaaaacgtaaaatgatgtcttcccattacaaatcaaatgaggacaagtgagtagttattgtaggaagccagcttcgggattaatatgagggaaagtttgcaaacatagaagaacggacattgttaaaagatgtaacagagtagattaaatgctatgactgtatgatccaaaaccaggcaaccatatccatggctataaaatattccaattggaagggaacttaggataatagtggatggatttcagcttttataccaagtccaatcaattgtagaagctttctgagtgctatgttgagggaaatccatatctcagtgggaatgaatagcatgatcaattagcaaaagatcctatttttaggaattggagatttggcagcatagggatcacctacttgccattcttgatttagttcaattgtgcattttgcaagtcggctgttgtgatgcacagaagctgtgtaacttactcaaagttatagcactagctaaggttagagccaaaatttgagccaggtgtttgcatcccgagtctttttcaaaaataggctttgctcccaggcgcggcagctcacgcctgtaatcccagcacttcgggaggccgcggtgggcagatcacaaggtcaagagatcgagaccatcctggccaacatggtgaaaccccgtctctactaacaatacaaaacttacctgggcgtggtggcacttgcctgtagtcccagctacttgggaggctgaggcaggagaatcgcttgaacctgggaggtggaggttgcagtgagccaagatggtgccactgcactccggcctggtgacatagggagcctccgtctcaaaaaaaaaaaaaaaaaaaaaaggctttgctcaatatttttctcaaaacagctatcattgccctctttgccatttaaaattttaaagaagacattcaatgatacaacactaacattcactcatcacattagggctgttgagaatgtcttcttggaaccaaagcagtcagtcacacaacacatatggagctgtaggctgaataaaactgcaagagtcattctgacttgcagagcaagccagggtggaaattggacatgttattatatttgataaagaaggcaatgttgaaagacagagaaatgtccttgtgtagcaaaaaaaaatttgaaatatcatatttttgcttttgccttagtgctgtctttaaaattttagactcttgactaaacaattaaaaatgaacttgataccccttatagcagctgtgcatacacaacaggagctactcagaaatatgccttagaaagctttctttgaagtgtttctttaccactttctttttctttgggttcaaattaaatagaatatcagccgtccacttatcttaatgacaattattgtgaattagacactgagtagaatacagtgacaaagaattgtaggcttttgccaaatggagtggaaaacagtaggaaaatatgatattctggccgggcgtggtggctcacacctgtaatcccagcactttgggaggccaacgtgggcggatcacgaggtcaggagatagagaccatcctggctaacagggtgaaaccccgtctccactaaaaaatacaaaaaattagccaggcacggtggcgggggcctgtagtcctagctaatcgggaggctgaggcaggagaatgtcgtgaacccgggaggcggagcttgcagtgagccaagatcacgccactgcactccagcctgggtgacagagcgagactctgtctcaaaaaaaaaaaaaaaaaaagaaaagaaaagaaaagaaaacatgatgttccaagagcgaggagacatcttatatatacaaatatagtgctcagtaaacattaatacaatgtgagttttctaattaataattatgccttttccagattgtccaagtcactagaagcctgaattttcacaatgactgctattgtcttttgtcatggaatcgaaaccttagttttaatctcattaactccctggcccagtcttctactaataggataaaataaagcatggttaaaagaaaaaaagcggacagaaatatctcacatatagaatacataaggccttatccataacattagagaaatttagagctacaatggactatttaaagactaatttaaacttttccaaataagtaaattgacaccgcagaagttatagggacttgtgctaagcgcttggttcagtgtgctgaagataaagctgaaacttagtgttctttccatttacccaataggatgacctaaaatgataaaatcataaaatggtgtaaacaaattccatcctcatagggcatctgcactggcaataatttggaagatcaaaatcacattttcttcttcattattctacaaggaatgtgaactgacaaaatgtgaaaactttttagaatataggctttctattacaattgctgaaatagttgaacattcaggttgttaatttttgaagacacagctatttccaaactgtttttatttttgttatgttttatcacttagttttttacacatcatgaagattaaggtctttgtaatttaaaaattatgcaacagctgctgaaaactgcctcttacactggaacatgaaatttatattaggaaaatacctattacttgctataaaatatgtatgaggctctgtagccaactttgtaaaatggaatttctcctcaaagcaaaatggaatggttactttgcttgggggatccactgttaaaggagtatggtattgatatgtgttaagtattgttctatgacatgaataaagaatacaaccatacattgtgatactcagtattgtggaattatttctacaccattttattatttagatacttatacactgacttttgcagctgggcttgtttttacggcataattgtttagatacagacgacaaaatgtatatttataattaatttggttctgtgtgcttctacaaataccacacccacaactactgtcaacaagaaaaaaattagaatatttagggtatttgatttttatgacacatgacaaaaagttggctgttgtcggtgatttaccttaaaaagttgtttcttagagcatttcacaaagatagaaaaaaaattgttttaattacactttgtcccagttcttaactgtataagatgcagagggtttttattactatatttgaaaccaagactcaggatggttaaagaacctgaccagcttctttccatttcttcacaaaacaagcaaatcaatctttctaaaatatgtatcttaaaatgtcatcgatacactgtaaaattttcatttcttattgccagctgaatggaggtcaagtaattaagctcactttcatatttaaagtcttcttcctcagagagacctcaaaaactttgcagctctttctaactctgtttctgtagatcgacctcacactccacacccccagctagacatttatttttgtcttatcttttcttctttgtttgcccaggaaagaataaccttgttcatcatcatcttttacagttattctcatcatttcaagggcatctcaaatgttttgattcttcaacagtctggttcattctcatcatatgtgactagatatgtttttggagtgtggtagtggtgggtagcatgctcctgataatctctcttcattcctgaattccagtacaaggtactggtcaacatatcagaggtggagtcccactgcctgggtctaaatcccaaatctgcgtttgattagctgtgtgatttagggtaagttattttacctctttgtgcctcagtttcctgaagttgataaaggggatactaacagtagctattttacatattttaaagatatgtaattgtagtgcgctgcccacagtcgatgatcagttaatgttagttattatggtggaagaataaaattaatacttattatataatcataatgatctagcatgcttcacctcctggctgcttttaagaaataagatacccttatatgtgtgtcgctaagcagaatttatacattcttttcattcctatagattgaaactactattttaaatttaaatttagtactttaaataagtaccatcacatgccttaagtcacaatacttaaaatcatagccaaattattgatctcatatacaaaagtgagaaagactttctcacttctgtctacatttaatctgcatcattttcctttcattatatgcttagaagactatgtcagtaatgcctcctgtttggagaatttccagcaatatattaaggagttcatgcaaaaatttacagaaatatttaccatttagtgatatactttcagttttaaaataaaacattgtgttgatggaaaggcttgacgacttcttagaaaacaggatgtgctatttatcaaattccatttaagtttagctatttggtaatggattatggattctgaatgatgcaaggagttatattcttcactggtagaaagtcattgggtcaatatatttaccgtaaagcaggtaatagatgtcctttattatctataactatgccagtttgtctctcgttctcatcaagtgtaagcagtatcattgggcaggattctgatatgactttatgatttaggaaatcagtaataacacaattaaaattacatcacacacaacacgaaaaaattatgcatcactttgtttataatgtttctaaaaaacttccgagtttgggttaattgaaaaaggtatttaataaaggggtgtcaaatttgcaaaatgttctcaccacttaattggtggaaggttcatataactactgattattaggtaaaatgtatagtaaatctaaaaacataaacacagcattatgcatttaattcaacttttattgttgtcagaatatgtgccagaaatattccaatccattaacaaggttccaaaatatctccagctggctgaatagtggggtcattcaaacccctaaaaagttactacatactcctgtctgttttggccttcttattatgttttttccttttattatactttgtgcagagcttaatttctgctctattggacttaaattgttgcactaactttaaatatgtgctaattttatcagaaactagatgtaaggtgattttagcagagaaacgtagcttgttaataaaattcgtaccaattctggagtacaagtttgatcctcttaaaataacaagcagtttgtgtggaatattgaagtatattttatcatcagcgaagttaataactctgcttagtttgatattttctgtgtatatatacatttttatagctttaccaaaacagagcttacactagaccgtggtttctttttcctccttccaattactatgtgttcttaaatgtgacaaaaatacctttgctttttgagttcagtaattaagaggtttaactacttcaagctgacctccctgcaacgagtgcaaattagtgagattaaaatgagattgcttctctgtgttctctcggtttacatgcaagttttaccacacctcattagttagatagttcattgcagcgaagtgctatcttgtacgttttcagagaaaacctggcttgatcaattagtcttggtaggtctttctgatctcttaaaaataattttgaaataaaactggcatgtgtgaaaattatccattgatattttattaaatttctactacatgtacgtactttaactcagtcattaactctttctttttaaatattatttaagaataaagaagaaacttgtttaaaatatggtgtcacagtcagagtacactgatttatgctacaatttccaagatctcagtggtttgaaactcttaaaatttttctttttctttctcaagcttcatgtacaacaaagggtggcaaggtagtctgttctcatggtagttactcaaggactcaagagaaaactctttatcttacataattgctacagttggaaaaaaagattcatggttaatcaatactggctttgataattccacctaaaaattgatacatgtaacttctgctcccattacagtggccaaagccatgcctaatttcaaaggggctagtcaaacatacttctactatgtgtttgaaaaacaaacaaacaaaaacctacgatttttctcattgatcaccaaataaacaatacgcctttctggccatcatatatttgatatactctctttttctcctaaataaatgtacacactcacacacacacgcgcgtgcgcacacacatacacactgacacaggcacacaccactgccaccgccaccaccaccaccaccaccatcaccctgaataacaacacttcctggtcaataaaggaaataactcaccaataatacccagccacaatattaagattaatgtcttatttatctcagagttttagctatgattatagcataaaagttagaaatcattccagaaaagggtgcagtaagaatatttccaaaggtttgggtgcattgtataattaatgcaaccctgtacaaactatgtttacagtaaattaaatctagaaataatatgaagaactatgtacaatggccaactaagatttattccagttaagcaaaactggaaaaatcaatcaatataatcttgaaaaatatgatcacttgaaaaatcaaccagtataatctctcatatctataggttgaagaataacttatacagaataaatcatttgacaaaatataattcatttataataaacactttcagtaaagtaggaataaatggaaatttcttctacttaataaagtgcagctacaaaaaaacctaaaactaacgttatagttaatcatgaaagagtaaatgctttcagctcaagattgggaacaaggaaaggattgctcactctccacattcttattgaatatagtaatagaaagtctacccactgtaataagaaaataaagaaaatgtgtacagattgcaaaggaagagataaacctttcgcgatttatagatgacatgactgtccaagtagatcctgaggaaactatataaaataaactcctaaaactattgtgtaaattcagcaaggttgcaagacacaaggttaacacataaaagttaattacatttctgcatgctaacaataagcatgtggagactgaaatgaaaaacacattaccatttataactgatacaaaaatgaaatgcttaaatatgagtctaacagaatacctaaaaaatttataaactaaaaattacaaaattataatgaagaaattaaagacacaacaaataaatggagagatataccatgttgatggattggatgactcaacatgcaaagatccccatcttgccaagttgattgaactatttggacacttgtctattttcttcctttttttctttttttgagacaggatcttgctctgtcacccaggctggagttcagtggcacagtcatagctcactgcagcctccatctcctgggatcatgcaattctctcgcctcagcctcccgagtagctagaataacaggagcatgccacgatgcccggctaagtactttatttttattttcttgtaaagatggagtcttactttgttgtccaggttggtctcaaaatcctgggctcaagtgatcctcctacctcggcctccaaagtgctggcattacaggtatgggccaccacgcccagcccatttgtctattttcagtaaagcctgtatgtatcagtgagatttggtataatttctattaaaatcctagcacggtttttttttggaagcaaagacaaacttacaatgaaatgtatgtggaagttacagggcataaaatatttaagccaatctccaaaaatttaagtggcatgaattactttatctgataataaacctggtatatagctataaaacatcaggtaatgtggtagtggccaaggcataatatagattaacatagatcaattaactgttaataattaattaataatatatattaattaataattaataatatagattatataatttgattaatataaattaatatatattaatagaacccataattagacccacttaatgatgtctttttttgacaaagatgccaaagcaattcaatggctaaaagatagccttcccaacacatagtgatagagaaattggatataggcaataaaaattgaaccttaacctcacctcatactttgtgcaaaaattaactcagttggattacagactcaaatataaaaggttaaattataaaacttaaaaaaaacacataagaaaaattttcagttctagacgtaggtaaaacgatcttagactgacatcaaaacatagcccatagaggaataattcataaattggaccacataaaaattaaaaacttgtgctctgtgaaagcacaggttttcatcctgttaaaaggatgaaaaaataagccaattagaaaaaggcaaaagatataaagaggcatttcacagaagataatgtacaggtaaatcatagatacaaacaattttcaacaccagtagtcattggatagaaacagactaaaaacacagtgaggtatcaatacacaccttctaaactgagtaatctttttaaaagtaacaaagccagatgaagatgaggatggagaaaagttggatcatctctacattgctttttggagtgtaaaatattacagcaactatgggaaaataattcagtagtttttaaatgaaatttatatgcaattataatgcagtctagcaaatacacgcttaggcatttatgctagagaaaggaaaatgtatattgacacaaaagtctatacacaaatgttaatatcagctatagtaataatagactcaaactggaaataatccagatgaccttcaattggtaaatgactaaacaaaccattgtttatccatactatggaagagtacttagtaataagaataagcacagatacaaggaacaacttgtgtgaatcaccaaggaattacgctgagtgagaaaaaacagggcaacccccaaagcttatgtaccatataaagctatttaaattatactttaagaaagataaaattttagatctggagaagagattagtaattgccaggtattaggagagaagaaatagccagagagagggtggtggagacggttacatagggcagtataaggtgtccttgtggtgatggaactgctctgtgttctgactgtgatagtagatacaagaacctacatacatgacaaaatttatgtaaaatatatacatacagacaaatacatatacacacaaagtagaaataaaactgaagagatataaataaaattgatggagtgcgtgaatgtcaaaatcctgtttgcaatattgtactatgaagtaacattagggggaaccgagtaacaggtatatgggatctctttgtaatatttcttatggttgcatgtgactctacaattatctcaaaataaaaacgctaattaaaattaattttattcatagatgatattatatatagaaaaccactagagactttatcaaaatacagttagaactaattatcaaattcagcaaaattgcaggatacaaaatgaacatgcaaaaatcagtagcattttgttgttgttgttgttgtttgttttgagatggagtctcactctgtcaccaggctggagtgcagtggcgctatcttggcttactgcaaccttcgccttccaggttcaagcaattttccaggttcaagtgaatcttctgcctcagcctcccgagtagctgggattagaggtgtgcaccaccacacccagctaatttttgtatttttagtagaaacaagatttcacgatgttggccaggagggtcttgatctttgacctcatgatccacctgcctcagcctctgaaagtgctgggattacaggcatgagacactgcacccagtctcagtagcatttttatacactatttatgaactgtctgaaaaaaaaaatcaagaaaatagtcttatttacaatagcattaaaaatgtatatttaggaatagatttaaccaaagaggtgaaagaacgttacactgaaaactatgaaacattgctgaaagacaataaaaaagacaaatttaatggaaatacatccgtattcagggataggaagattaatattgttactatgttcatactacccaatgtgacctacagattcaatgcaatctgtatcaaaattccaataactttttatagacattgaaaagatgacctaaaattcatatagaaccataaaagatctgggataaccaaagcaatctggagcaaagggagcaaagctggaagtattacactacctgatctcaaaatgtactacaaagccatagtaatcaaaacagcatggtactgacacaaaaagagaaagagagactggtgaaacaaaaaggagagactagaaataaatttgcacatttatagccaactgatctttgacaaagtcaacaggatcacacaccagggaaaggagtctcttcaatgagtggctttggaaacctgggtatccacatgcagaataataaaattggaatctatctcaccccatctacaaaaatcaaccaaaatgaatgaaagaattacattcaggaccttaaactacaaaactgcaagaagacaacagagaaaaaagcttcttgccattggtgctatggtttgtagatgatttgttcctccgcagcaaaactcatgttgaaatttgatccctaatgtggaagtgttgggagggaccctagcggaaggtgtttgggtcatatgggtggatccatccctatggatggcttggtgccgttctctcaatcctgagtgaggtcttacaagactggattggttttcaggaaatagatcagttcctatgagagttggttgttataaagcccggatgcccctagggtttttgcctcttcatatgtgtccacttcccctttgaatttctcccccgcgacatggcacagtacaaaaggtctcaccagaagctgaacagatgctggtatcatgcttcttgtatttccaagcctgctgtattgtaagctaaataaacatattttctttataaatttcccaatctcaggtattctgttatagtaacactaaatgaactaaggcaattagttcaggtaatcattttttggatatgattcaagaagcacaggcaacaaaagcaaaaagggacaaatgtgattatctcaaactaagaagatgatgcacagataaggaaacaatcaacagactgaagagacaagttacggaatgggagaaaacattttataaccatgtatctaataaggacttaatatccaaaatgtggcaggaatacaaacaactcaatagcaaggaaacaacccaattaaaacatgggcaaaggatgtaaaaagacatttctcaaaaaaaaagtactaatggtcaacagttatattaaacaatgctcaacataactattcatcagataaatgcaaataaaactcacaattagatatcacctcccacttgttgagatggctgttatcatgaagacaacagataagtaagtgttcgtgtggatgtagagacagggaacccttgtgtgctattgctgggaatgtaaattagttcaaccattatggaaaagagtatggaggttcctcagaaaactagaaatagaactaccatatgatccagcaatctcatttctgggaacatatccagaggaaatgaaatcagtatgttgaatagatagctgcaccacaatattcattacagcattattcacaaaacctaagatatagaatcaaactaagtattcatcaatgaaagaatggataaggaaaatgcggtatacacagtagaatacagttcagccttaagaaagaagaaaatcctggtgatttgtgacaacatggataaactgtgaaataagccaggcacagacaaacaaatacctcatcatctcatttgtaactagaatctaaaacagccaaactcagagaaatagagaacaaaatgctggtcaccaggggtttggggacagtaggggttgaggagatgttggtcaaaagcatacgaaattttactgagacaggaagagcaggttgaggagatctactgtgcaacatggtgactacagttaataaccacataatgtatacttgaacattagtaagatagtcgattttaagtgttcttatcacaagaaaaaagtatgtgagtttgagggaacaaatacgttaattagcttgacttagccaatccacagtgtatccatatagcaaaacattatgtcgcataccataagtatgtataccctttgtcaattaaaaaataaaatatttaaaaattaatttggcaatatatcacagaggttttttttttaataacaaacataacttgaatttccactttgggaaattgacttaaaaacaaattactgaatattgcctagttgtagggaagtcttattacacataaacacacaaaatgctgatgtagatctgtatcagtagacatttggaagtaacttccaagtaaactaattgataaatagcaagtctcaaacatatgcatagttagacctcatttatataaaacaaaaacaagttctgtggatctagtctgtgtctgtgagtgtgtagctagatggaaacactccaaattattattggttctttccagtaagtacaatatggggtactgtaaagaaacaggaagtttattttatattcaatgtaattatcattgagattcttataatatacatgtgtaactttggtaattaaaatattttccttaaaagaaggatatgtgtgctcataaggaataatgtttattatgtaactgaataagacagtacgtgtttgttcattaagtgtggtgtactatatattaactccttcaatatttagggaataccttttattcattcttgaacacttagtgcttagtacagatgaagggatcaataaatatacagattatgcttatatgaagaaaaggagactaagaaaattcaggagaatataaatttttttaaattatgtttatgggtgattttcttatttgttttaattttgactgcgcaagatgttaaaacttctatgatgaaaaaaacagtagtcaaactagctcgtggtgatcccagttaccaaagtatgcaagaaatatccagtcactttatcattagttttattttaaataaatcatcatacatatcctcatgtatatatcacacagtgaggattatcgtattcaaaggacacactggaaatctagtaatattaaacttggctttgcctggagtatagattggacagcagacaaaaatctacatgttaaatcatagtcctctaaatgacgtttctgttgttcgacatgtcatggcacttcgctttaacagtctctcatttaacttgcttcttcaacatatgtgctcatcttaatcattcactcatccttgaagtagccaaatttaaatgtcatgtgtttttattcacagagcatggaatcaatctcattatacccttgaatgcacagctttcactaggagaccctccttctaagccaaaaaatcaatttatgtttaactggaggaatgatatctttttctgattgttggcaaaatgagagagggagggagagggggaactactccatttattatatgttaaaatgtcacttcatggttacctcccatgtgcatggtagatctggcagctaattaacattgtcaaaccacgttaatctcacctacaaattcatttattattttggataatgtaactgaagttgtacaagagaagattcaggatcacattaaatgcattgaactattaatgtattagaacgtagtatgatcaagcagtagctcagtactcattacgatcctcagtaaattcttcatcatacaattgggaagagttgctttgtaattattaactcagaagacaatacttctataagatcatggactagtgtgataggaattattcagggaacattttgaacatgaagcttctcttcgtagcttcatagtaagtttatattcagtttgctgttctccattgttagtatgctaaggttcacaaaagaattatctctgagatgtctcttgcatgattgtactgtaggtcagagagaatttgagaaagtccagtgtttcagataacaatttaagatacaaacgtgttagtacagatctttatggcttaacaaatcacttttacatggttttagctgatcctagcaaaagtctcataagtaagcagatattactaactctaaaaggttaaataacttgatcaagagtacactgtgggtaaaggacaaagttgagatgataattctgcttattgatggaatgaatacatgcataataaatgaatggatggcaaaatagacaactccaggtattcttacagatagtacatcattgcagctactcacttataaggcatataccatatgcattaatattgcatgttcacccaaaactttcagttaatctttatgcattttggaggtaatgtcttaaaaaagtgatgtgaacaagccccaataaaattattgttttttgctaatgaataataggatgcatcagtttagacagaaaatagattctagtaatttacacagcttaaaactttcagatttgtctctagctgataaaaatcagcggcatctggtagtacaggaagggggcagtagaaattctatgctgtcagggctacaccatcagtgtgagtagtgattttaccagatgatatgaaacaatattcttgttatcattgtggagcctccaatacataaaaatacaaagaaaaggggaataacgattcttaaaatattttttaatcaagcagcacaaatttgaaatttgccatattcattcacttcctgaattgaatatcatccatatgaattatgtatcacattgatgtcatttttatgaactgctacattggtgactaattgaggtatattttagttttaaagaatatgttgctgtgcttaattatcctgataaacacattttataacttctagcacatatgctatttcattaaattaatggttttcagaatcattgatttaattgacagtttgcaattcatgaagaaattggatgaataagtgaatgtacattttatattttacaaattgcagaatacaagttcatgagtctttttcacttatgactttcattagttaatggtatttccatcagttttattggacacatgtcatgacagtaggaaacaataggattgtctgcatcaagaaagaacaagtagtaagtcatgaatcttttttttctctgttgtaagcaaagcttaagcacagatattgctaatcaaggtttggtcttgttcaagttccaagctatcatcaactcatcgtaactattgcaaaagtctcctagttggaatatctgcatccactttgcctagtctcaaattccatcttcagtctgtagccagaagaatatctttctaaaatcaattaaattggcatctattttattccttaaaactgctcaatggctccaaatttctcttaggatagtcacattagttagaaaaaagtagcttccataacaaaaaaaactacattttattggcataacacaaaagattctctttcattcacccaacggtacaaaatatatttctggtatgtgagatgcagcctaattatgacacaagaaccaatgttctgtcgcttaatgacacagagttctctgcattctgataaaagaagttaaaaagaatgaaggagtcacataaaatcttaaacatgttattccagatgtgcacatcatttattttactttcaatttttatggatacataatagttgcacatacacgtggaataaatgtaatattttgatataagcatacaatgtgtaatgatcaaatcagggtgattggtggatccaacacttcggacatttatcatttctttgtgctgtgaacattccaaatccactcttctggttattttggaatatacaatagattattgttaactatatcccctctattttgctactgaacacaagatcttattcgtactatccaactgtgtttttgtacccactagcccactcctctttaaacatgtcccactattctcagtttcgggtaacattctactccccacctccatgagatcaattattttagctctcacatatgagaacatgtgatatttgtctctgagcctggattatttctcttaacagaatgtccttcagttctatccatgttgttgcaaattacagcgtttcattcaggtggctgaataatattgcgttgtgcatatgtaccacattttctttatccattcatctgttgatagacactaaggatgatttcattatcttggctattgtgaatattgctgtaataaacatgggaatgcaaataacttttcaatatgctgatttcccttcttgtggatatatacccagcagtgggatttctggatcatatgatagttctgcttgtagttttgaggaacctccatactcttttctatagtggtttaatactctggattggccagaatcagcctgatagccatatatatctgcatttatgtctggagatattttccttcaaatggtagtcacttctcaggaaaattttccactgtaaatggtggcacacggtttttagtaaacagttaattgtctctgctgcaaacctacctcttaagatgtcaggtaagacctgcatttctggccatatcaagcacactgctcttcttcagctgatacaagtgttccttctatctcttgagtgccatatgtttccttctaaaatatagtttttcacatacttttatgttttgcctactattctattcttccttctggtctcagtaaattgtgatttccttataaaattcttacccagcttatgtgagtcagttttctgtgttacgtattctcatagtcacatcctacatgcacctgtattctgcagcacttgtttctgttgcaatttttacatttgtttattacatgaagccttcaatacagtattagctttatgatggtggatgtttgcttttgctcatcattttatttttagcctattatgaagtgcttagccacagtaggcactcagaagtactgcataaataaatgaatcaattgcctgatcttgcactcttcaaagccttttacattgctataattgtcttccaaatgcaaatgttcatcaaaggtgttttttctccattttgaaaaaaaatgaatgctttagtttgggctccctcagaagcaaactctaattttaatattcaagtgtaagtattttatttttgttcctaggcatgggaaacgagagaaatgggaaagtggtacaggaaggaataggcagccaacaatgtgataataaaccacatttgctgactgaataattccatagtgaagactgggaaacaatgtaaaacactacatcagaaatattccacttgatggaaaatggacttggagtaaaaatactccttgacatcatcattaagttacaactcatgtggaggactgctaattttccttagagatttagcaagcgaagtgaccttctggggaaatattctggaccaggagatgcagattttggtagctggaagactgttgttcatccaaaaagaatatgtataagggatgtgggtattcacagcatccaacacagttcacccgaggcttagtgccactgtcatcacacactgcaagcctttctctctctcacgtttgactcttcctcttttggctggtcttcactttgtgctctttcccagtcttcctgaaaggacactgacagatgagtattcttaaagcacatcatctctcctgttatgtgccttctccacagtcctcagtgagtattcttttactctaagattcagcctaatccttagcttacattcaataatgtgtaaaagttagtctattcatgctttttttcactcttgacattcactgtcaaattctctcctttggtatttacttgtgcttttctacataacttcctacaccccttctacctgggataatcttgtcttgttgaattcccatttattcatcaatgcagagtttaaatctaggcttttaaaattttactttaattgaaaaataataattgtacatattcatagggtacataatgatatttctgtatatatacaatatatagtgatctgattggaataattaccatatccatcatctcaaaagtttatcatttctttgtgtgggaacattcaatattctccctctagctatttaaagctatataatatattaatgttaactattgtcatcctacagtggtatagaacactagaacttattcctcctatctagctgcaattttgtatcctctaacacatttaaatctaagcttctttattggaatattgaatctcacagctgctcaaatgacttaccttaacaggtgaagtatttgccactcctgtatgttgttatgtgtgagtttggcaaaaatgtagtagagtaacccagatgagactgaatgagtagtgtcatgtatatagacctgcaaatgcctccttattctgtaatttgatgaactcatttctaatcggtcccaccactattgataattttgtaaaatgcctatgacatgcatggttttaactatgctttaggacctaatcaaaggtattttttattctataacaattgtcatacgtcaatgtctcatattccctactagattataaattctaagagggaagagatgtgctgtaattcaatctgtatatcagagtgtctgtattttccttgtgataagcactgaaattatctagaatgagtcaatagatttttcagcaaccttcaggaagtttcatgttcctttctttatcctaaccatcacctatcatgtactgattatgtcatgaccctagccccactgaccctaagcttaggcactgcggtgattcacaggcctactcttaaagtgaatagcttctttagaaaataaagtataaaaacctctttgattatcttatttctagaaatcatgttaggaggtttgatgttgatgaataaataatgtatgcttactttggactgattatgcaggtgaaccaaaaaggttatatttatgtgcgaggaattttgagggagttttgcagtcctcaagccatgctcattatctgataattgtccctgtttcaactgtgaatatcctgtggacatgtttgtattatgtgtttctatccattccagtgttcacttattgaataggggatatatatttgcaaaacagacaaaaatcatgtaatatttctgctgtcaatatactatgctgcatgcaaaaatgagtttcagttatactgagagacatacaatagaaaaaccgaatatatttttattgagtggaaactcacttcttaacacttcctcttttgatctttgaaatattctttattttttagttcatatacaaatttaaatttttcttctcatccttttgagtatgcactcacccacataccacctctccataattttatcctgcttcttagttcattagttaagattaactgtctcagtggtaaattacatataccactttaacaatgagaaaatatatcccaaaattttcttgtatagagtccacttatttctaattttattcacaaagcacgtgctttattcgtgagttctattaccaccattactaacatcctacacacaaggaaaaaaaaaggcgaaccaaagagcaaaaatattacttaatatgaacacgggctccttccagatctggttcaatagcagttcttctaggtaaggcatagcttagaatcttaaaagtcaaagtttggcccttggattatcagtattgacaccaattagaagcttgttaaaagcataacctctgacactatctcagacctattaaatgacagcctgcatttgaatacaatctttaagtgccgttttttgctgttgttcttgcaaattttgaacctgtgggacccagaaatcacaatagcaaagatggctagatatctaccaaaaagtgtcctctttttgtttaataatagaacttcctaattttagctggttaccaggttacccatcaaaaaatgcacaacctagttttgcttgcactttggcatagccaagggactaaattctgaccagaggcatgtgagtgtactgaagtctaggatttccaggtcacacctagaaagtaaatgtatttgaactttctaggtccttttcccacttgatgctgtctcgtagatggtaaaaatttgagcagcaaaattggacccagaaaagggaggcagatgttaaagatggacaaactattttgaactgttctgtgagaaagaagaaaactttcatcttgtttaagcagctaaaactttttcatgtcttttttattgcaattacatggctaatatatttataagttaactgtgtctccatcactctattttaaccatgtctacagtaacacaaaataaggcacagtgaattatatgtataacctcccctcattgatgttttcaacagctggatcattgcactacaatccagtgattaattcaagtcaatggccatttttgtctcttttgcaacttccaaattcatacggtttagtagcttttgaattaaaaatatgtcactctttctaatgggtaaaataataaaaatagtaccagaaaaagccacaaaaatgtcctaaagtgtgcaacataattaaacaattatttatctttctgattttgaatgttaattttggtcttatatcctaaatcccacataattgcatttttttctgattatacagttttatacttggcaaaacaaatgctgtttaacttagggagttatctttctacagcaggatcccctagagtttcagaatatattccttgcacactgctctgtgtagagaagacgttcgtttacagagcctgtctcaacttcctaacattggtctgagcacagttttgttttgttttttaacaactttttttagaacagttttaaatttacagaaaaattaagaagataggatatagagagttcctaaataactttcactaaattgtcactattaacatcttgcattagtgtggtgtatttgttaccattaataaaacagtattaatgcactattagtaactaaataccatagattttttcacatatccctattttttttacttgtttttctatgttggaggatcccatctagtttcatttagttgtcatgtcccctacacgcttctaggttgtgacaatttctcatacttttcctcgtttttgatgacattggcaattttttttttttttaagtattggttaggtattttgttggatgtccttctattgcaatttgtctgatgtttctctcatgattaaactggggtgaagctttcttgggagggaagatcacagatataaagtgtaatgttcatcccatcatattatgggtatatactattaacatgatttgtaacttcatattgaccttgcttgcctggctgagatagtgtttgtcagttttctctgctgcggaatcgttcttttttttttttttgctgtttccacaccggactctttgaagtgtagccacacgtacagcccacactgaaaaagtagggagttattacctcttctttgagggtggaatatctgcataagttgaggagtttttatgcacattttctttatttttaatattcgtcttaatgtttatctcgtaagacaatgctgtttctgaatatttggcaaacacattttagagaagccaaattatccatatcttcaggcaattaatatgtttaaaattatactgagaactgatctaaatttctgtgtgatttaattatgaaacccagttttgtgtctagtttactggttttgaaaaagtgtttcaacaaaataacaactaaaatttattggttgctcattgtgtgatacgaactgttctaagaggtttgtatgtattatttgatactaaactcagtgtattacaaggaaatgtgtcttattactaatctacaattacagcttcaattattaaataactttccccagtttccacaattattgagtgatggatcagggaatttagtccagttttattcaagtgaggccgtgatgatagttataaaactggtattttatgttcaataattgtattaaatctaaggctaaaacaatgtattcagtaaaacttagaacacagatcttctgaaagttttggttctgaagtgttcatttcaatttcttatataattatagttgcatgatcaaatgaaatcatccccaaataactcaatgttcaaatgctagactacccatataacataggatcatctgagaatttcaactgtcaaaaaggaaatatgtctagatttggacttaggaagttgcagataggtgagtcatattctctccaaaaaaccatctttttggtttgttgaaaaacttagggagatttttcaagaatccataactaaaggtgatagagggtaggtaagtgttattttttccttttgttgatagaataagaacagaattttatgcccaattaaaagatttcatgatatgagttgttagaatatacaagtgtttcctattttcactgcattaattttactaggatacaattgcataacaaaattcacaagcagctgagaaatgttatactaatatcaggcaggcatagcagcctgggagcattttgcacgtgtgatactttagtcatcaaatttgtactctgaattaagtgtacttataactggtacttggacaagacactggtcatttgtacaagtttccaaacatagtgacactgattagaaatgcccttgttccagagacagccaatagaaagatgtgtaagattttgttttaatgcaaatagtaataatgcatttgataggcattgtacatagaaaatgacttagggattattttgccatcatttcatttcttataagaatggtgaccccttggctaaatttcatgttaacaatgtttctcatttactttggtcttataatttcagctgctctaaaataaatcttagataaattcattgcctactttgacatacatattttaaggcttcaaattctggaaagatctaaatgcctttaaatatcttgtttttagctacgctatgatcacactattttatcattttaaaaggatcagtgttatctaactgaggtcaccggcagaatgaaaagtcaaggtattagcatttatattttcaactgaattgacagagatctcaacaatgagtcattgaggggttattaagttcaggagctaataatatttctctaatatgattgctaaaaagtcaatgggatttgtaatttataacacaatcttgataaaatacaaaatagaatagctgttcccttaagacatcaacagttagtgtatgaagcatgtcacttttgtgttccaaattttcactcatattaatttgctcttattgaaattttgaaactgacttagcttcagtttggtttcacagatatatgtattaggcactttatcctttagggggactcaagcctctgaagatgatgatgccattgcagccaaattttacattcaaattctagcccaagactactgaacttataaagttgaggacactattataaaatattaatgattcaattctacttcaaaatttcatcttaagtaaaacaaataaaaaataaaaattatatatagctatcttaaaacaagcataattcgatatcccatggatatctaatcaatgaaataccatgtgaccatgaagagttttctattaatcacatggaaagtgttcataatgtattttacttggaaacagagtttatcacacctttagatctgaaattcaaaaagaaatgtttgaaaaatataaatagtcataaaggcagacaagtaaatacatggagcagagggggaaaagagatgagaaatttttcaacagaacaattttatgggaatagtcataaaggcagacaagtaaatagctggagcagaggggaaaagagatgagaaacacaaaggataacaatgttattatcctcaatttatttatttgtgctttttacagtttttcaaacacttaacataaattgtattgatatatatataaagaacaaaacgatgctataattattaaaacaattaggaattttaagtcatcttatgtttgttccttttatttttatttatttattattattattattatactttacgttttagggtacatgtgcacaacgtgcaggtttgttacatatgtatacatgtgccatgttggtgtgctgcacccattaactcgtcatttagcattaggtatatctcctaatgctatcccttttgtttttaaagaacctgaaatccaaagggcaatgacttaccacaaggagtaaagtgtcagtgtgggtgcagaaaccaaaagccagggcttcatctcatggtctagtgttgacttcactcgacctcaatgccttcctccttccttcccctgccagtttggttccttattagtagttcttttctaggtatcttaagcttggaaccttcgtaagaaaagggacttgaaatgttcttacacagaaggtaagaagaactttacaaattctctgagagtttgaggagaaagaaaaaatgttaaggggctggccttattaaaggtgggttaactttgagctgtatatttgcacagtaatatatactgtgaatcttagaattaggagttgtaagaatggaaacttaactaaaggtttattttgtgtgacactctaagattgtagtgtcacgtttaattccattttgttcctaagttaaagtgaaagggcatttttaagagctttgctgatttatgaatagtcaagcacatcacatattaataggatgtgtaatatggaagttgctattcactgttaaatatggtggagaaattagtgaaggaatgggtagaaattttgataaataatccattccccccccccacttgctggctttcttgaattgatagccaggaaaggtagaaaaaaaagaggtatgtaaagtcagactgaactggttgcaaactggacttcatgacttgctacatgtgatcttgatcagattacctaaattctctgagtttaacataagtttgcatttaaggggatgagggcgggagagagagagagagagagagagagagagagggagaaatataccactagtcttttgtctgtggtaagtgttgcaaatattttctcccagttcattggctgtcttttgattttttgtatagtgggtttttttcctgcaaaattttaaaaaatgatatagtcaaattcattgacatttttcttttattgcctctgaatttgagtcatagttagaagaccttttcttacaccaaggttaaagatgaatttttcaagtacttgtttgattttattttttacaccagaattccattccttttgcagattattcttgcatatgatataagatatggatctaaatttaccttttccaaatggctactttgttgtcccagcagcagttattaagtctatttttaagtggtttgaaatgctgctgttgtcatatactaaattctcatatgtatttagttttaaatttggaccttctattctattccactgctttatctgtctattcaatatgatgctagtataacatcattttaaatataaaggctttgtagtatcttttaatgtttagtaaggtagtcttcctcttatttctttttttacaaaagtattttccttgctattcttgtatgcatgtgattccatgtgaactttagtcaatttacctaacttcataatttgttggtatttttattaggtttgaatgaattataagtcaacttatggagaatttatgtccttatagtgttgagtcattttatccaaaatacagggtattttcctaatttttaaagtcttctttagagtcctttgtgagtgttaaaattttcctttcacaaactttgtacatttttattaaatttatttctaagtatttagtgttcttattgcttattcttattatagtgttcttattcttattcttattcttattatacatggacttactcttaagttctctaaatgttcgttgttaaagagtatataaaggctactaatttgttaatgttaattcagcattcagctaattcactagaatatttgatttcttgagatggttttatcattgaccctctggaattttcaaggtttattatcttaacaactgcaaatagaagtagttttacttcttctttaccaatttttatgcttttcaagaatttatctcatctaattgggttggctctcatcgaagaactgtagaataatatgggatcgtattaatcataacatgtattcttgcttcgtctcaaatcttaatgaaaatgcctctagcgtttcttcatcaaatagtataccggctttaagtttaaggcaaatatatttcattatgttaagaaaggatccctaaattctttttctttgagtttttttaaaacaataaattagtgttttttgttgttgttgtcaaaggctttcttagcatctgtgaagataatataattatgcctttaaattgtcaacatggtatatatgaaatgaattgggtttataatagtaaaccaatcttgcattcctaaaataaatcctatttagttatcgtgtgttattttcttaatacagtgttggattaagtttgctattttttattttaaaattttacattattttcttcagtgatattgacctgtagttttctttcattatactgttttatcagatttaggtatcagtgttatagtttcttcatgaaaggaattaagatgttttccttccctttcaatgttctgaataatcatacagcattatgactatctgccatttaaatctttagaataattaccttgtgaaactatgtgggcttggtgctattttgtgtagtatttatctaattgtttcctatatttcttctatgaaattggttgatttaatctttctaacactaataagattaatttgagtaaacttcatttctctagaaaataattaattcatcaaattaaatcaaatttgaaatttgatttcaaatttatttgtgtcaaagtaaaggaggtttcctgtcattttaaaattctctgttgttttaatagtaacttgtttcttattatttataactttatatatttgtactttttccttttttatcaaatgaactgagttttaacatcgcatttaattttaattatctaatctaaatctaaaagctgatatttgattcaattgtcagaaatctcttaagtatattgggatcaacttggaaaagtaaattgactttaaacagtacactttatgaactttaaattacagatcagatatttttagtaaaattttatccaaactaagatgcaatatgagtataatcactgattcaaaaagcttcctttagtgagcatgaaatatctcactattttaattttaatattgattgtgtgttaaaataataataattgcattatattattgataatgtgtattcttgtcatgtttccattcttactggaaatgcctccagtgtttctccatcaaatagtatactggctctaagactaatttaaaggacaagatggccaactagacacagccaggaagcactgttcctacccccaaaagaccaaagtttcaagtaaaccaacataacttggacagatcttcaaagagaaaatgcccagtggatgaagatgtgatgcagatgtggaggctgaggaggtaggaagctgggaaccttgttcagggtaggccaatgcttgagccaatcctgacctcaagtggctcctgggaatgggtgaatgaagaactgcaggactgcctaccctagccatggaccgctgggatcctggctatgggggccccacatctgccatggacatttgagctggcagaaggatccttccagagagtagacagagatggagctccagccagcatggaagcatgggcctttgtgcacagtgaggctgtgtccaaacatggacatagccacctattccccagggctccccactcaccgtctgagaagctctagctccagttgaccaccaggctaggaggaagctgggctgatttctctgtgggactggtacgtgtctgttctttaggccctcttgcccaccagcccctccaagggccactgtccagctgctctccaagagagtatgcatggctcagcttccactgcccagcctggttgctttgctccacctgattatgttcccggtggcctgggagcactttggattcccattacacctggaacctgaatctaggggtccagaggatggagctgcaagccaatcctggtgccccagagctgcagtgtgcagttcagaagcgcagagctgaaatttgtggccagcactcaagtgggagaagagcccaccctcttagaggactaagaggggtgacttgtgtcagttcatgagctggaatagaagcagaacatgtcttcttcctcagggccaaccaggaaagagtgttacctatctccctgctacgttctttgcccagggagcctcacgtcccagaacagctaaagaaagtaatgcaggcacagtgccagtgatcagaaggggctccaccaaggcccaagttcagacttggtgaggaattacctctctccccactgcactgcagagtgtggctggaaacatgaggaaatatagaggagctgggtggctaagtaagagactatttactgtccattattcttaagcactatccactggatcacagcccaaacaataacaccaaaaatgttttgctgatataccctgctgtaaaaccaaggacaaaaattcagccacaaataaagacctgtacagagcctagaccatctgaaaacattcagaaacaaagccaattggctatactcaacttatactgtagttaaaggaacagcaaccctcccagatgagaaagaatgtggacaagaactctggcaatttagaaaggcagagtgtccccttaccccaaaatgagtccactagctccatagcaatggtgcttaaccagtgtgaaatgacataagtagaattctaaatctggatggcaagaaagttcaagaatcaggacaaagttgaactaaatctaaggaatctagtaaaacaacccaatagctgaaagatgaaataacatttcaagaaacaaccaaactgaacttctagagctaaaaagttcactacaagaattccattatacaatcagaagtactaataggaaaacagaccaagctgaggaaagaaaatcggagcttgaagaccagttattcaaatcaactcagtcagaaaaaaataaagaaaaaagaagtttttaaatgaacaaattctccaagaattatggtattacataaagagatcaaatctacaactcactggcattcctgagaggggagagagaataaaaaacttggaaaatatatttgagaatatagtccatgaaaatttccctattctctctagggaggttgacatgcaaattcaataaatacagacaagcccagctagatactatagaagatgaccatatccaacgcatatagtcatcaaattcaccaaggtcaacgcactcacacaaaaaaaggcagctagagataagggacaagctacatacagagggaacctcattaggctagcagcaaacctctcagcagaaactttataagccagaagagaccagggccctattttcagcatccttgaagaaaaggaattccaaccaagaatttcatatcacaccaaactaagcttcataagagaaggagaaataaaattcatcacagacaagccaatgctgagaggattcatttcatttagaccagctttacaaaaataccttaaaggagtggtaaagataaacacagaccaggtacagtagctcacacctgtaatcctagcactttgggaggccaaggtaagtggatcacttgaggtcaggagttcgagaccagcctggccaacatagcaaaaccctgtctgtgctaaaaatacaaaaattagcccggtgtgctggaatgcacctgtaatcccagctacttgggaggctgaggcaggagaattgcttcaacccaggaggtggagattgcagtgagctgagatcttgccgctgcactccagccttggtgacagagcgagtgtctgtctcaaaaaaaataaaaaataaaaaggatgaaataaaacaatgacacctgctaccacaaaaacatacttaaacaaacagcccacaggcactataaagcagctaaacagtcaagtacatacgacaactagctaacaacacaatgacaggatcgaaatcttacaccaacactaaccctgaatgtaaatggtctaaatgccccacttaaaagcttggagtggcaagctggataaaaggacaataccctatcatgtgctatcttcaagagacccatctcacatgtaaggacaaccacagactcaaagtaaaaggatggagtgagatctaccatagaaatagaaaactaaaagagcaggagatgctattcatgcatcagataaaagactttaaaccaatgaaaattaaaaagtacaaagaagagcattacataatgataaagggtaagatccaacaagaatacttaactaccctaaatatacacacccaaactttggaacacatagattcataaaacaagtttttcttgggctagaaaacacttagacaaccaaacaataaaagtgggggacttcaacaccccactgagagtattagatcactgaggcagaaaactaacaaagaaactctggactacatttgacacttaactaattggacctaatagacatgtaaagaacatctcacccaacaacacagaatttgcattcttctcatctgcatatagaacatattctaaaatgcaccaaatgcctggtcataaagcaagtctcaataaattcagaaaaattgaaataatacaaaccacacagtgcaataaaaatagagatcaatatcaagactatctctcaaaactatacaaataacatggaaattaaacaacttgttcctgagtaactcctgggcaaacatttaaattgagaccgaaattttaagacattatttgaaattaatgaaaatagggacaaaacttaccaaaatctctgggatgctgctaggaaagtttatagcaccaaacaccatcaagaaattagaaatatctcaaattaacaacctaactttgctgctaaaggaactcgtggaaaaaagaactaatcccaaagctagcagaagaaaagaagtaactaaaattagagaagaaatgaatgaaattgagatgcaaaaatttatacaaaaatccataaaaccaataactgtttttttcttccaatagtttttggggaacaggtggtttgtggttacatggatgacttgtttcatggtgatttctgagatgttcgttcccccgtaacagtagctgtgtacactgtacccaaggtgtaatcttttatccctcacccctctcatcctttcccctgagcccccaaagtctgttatattattattatgcatttacatcctcatagcttagctaccacttataggtgagaacataacgatatttggttttccattcctgagttacttcaacttgaatgatggtctccaactccatccaggttcccgcaaatgccattattttgctctttttatggctgagtagtatttcatggtatatatacaacacattttctttatccactcatcgttgatgggcatttaggctggttccatattttttgcaattgccaattgtacttctataaacatgatgtgtgtgaaagtgttttttcatgtaatgccttcttttgttttgggtggatactcagtagagagattgctcgatcaaatggtagttctacttttagttctttaaggaatctctataccgttttccacagtggttgtactagtttatattcctaccagaagtgtaaaagtgttcccttttcaccacatctacgctaacatctattattttttgatttttaaattgtggccattcttataggaataaggtggtatctaattgtggttttgatttgcatttccctgataattagtgatgttgagcattttttcatatgtttgttggcatttgtatatgctcttttgagaattgtctcttcatgttcttttcccagtttttgatgagattatttgtgtttatcttgctgatttgtttgagttccttgtagattctggctattagttctttgtcagacacatagtttgtgaagattttctcccattctgtgggttttctgtttattctgctgattatttcttttgctgtgcagaagctttttattttaattaggtcccatctatttatttttgcttttgttgcatttgcttttgggttcattgtcaataaatctttctttaagccaatgtctagaagttttttcgatgctatcttctggaatttttatagtttcaggacttagatttaagtctttgatccatcttgagttgaattttgtataagatggaggatgatgatccagtttcattattctacatgtggcttgccaattatcccagcaccatttgctgaatagggtgtcctttttccacttcatttttttttgtttgctttgttgaagatcagttggctctaagtatttggcttcatctctgggttctctactccattccgttggtctatgtgcctatattttataccagtaccatgttgttttggtaactatatccttgtagtatagtttgaaattgggtaatgtgatgcctcaagatttgttctttttgtttagtcttgttttggctatgtgggctctttttgcttccatataaattttaggattttttttttctagttctggaagaatgatgtgaagaatgatgatggcattttgatgggaattgcaatcaatctatagagtgcttttggcagtatggtcattttcacaatattgattctacccatcagtgagcatgggatgtgtttccatttgtttgtgtcatctatgatttcttcagcagtattttatagttttccttgtagaaacaaggagttttcacctccttggttaggtatattcctaagtattttattttattttttgcagtggttgtaaaaggcattgagttcttgatttgatcctcagcttggtcattgttggtatatagcaatgctactgatttgcatacattaattttgtatcctgaaactttactgaattcatttatcagatctaggtgcttttaggatgtctttagggtttcctaggtatagcattatataatcatcagacagcaacagtttaatttcttctttactgatttggatgccctttatttctcttatctgattgctctggctaagacttccagtgctatgctgaatagaagtggtgaaagtgggcattcttgtcttgttccagttctcaaggagaatactttcaacttttttccattcagtataattttagctgtgggtttgtcatagacggttttgattactttaaggtatgtcccttctgtgccaattttgctgagggtttcaaacgtaaagcgatgctgaatttcctcaaatgctttttctgtgtctagtgggatcaccatgattttggtttttaattctgtttatgtggtgtatcacatttattgacttgcatatgttaaaccatctctgcattgctggtatgacgcccacttgatcatggcgtattatctttttgatatgctgttggatttggtgagctagtattttattgagaatttttgcatctatgttcatcaggaatattgatccgtagttttctttttttgttatatcctttcctggttttggcattagggtgatactggcttcatagaatgatttagggaggataccgtctttctgtatcatttggaatagttgtaagtttggtacaaattcttctttaaatgtctgatagaattcagcagtgaatccatttggtcctggacttttatgttggcaatttttgtactactctttcaatgtaactacctgttattggcctgttcagtttctatttttttctgatttaatctagaagggttgtgtatttccaggtatttattcaactcctctagagtttctagtttgtgtaaaggtgttcatagtagccttgaatgatcttttgtatttctgtggtattggttgtaatatgtaccatttcatttctaattgcgcttatttggatcttctctcttgttttcttcattaatattcctaatggtctatcaattttatcttctcaaataaccagctttttgtttcatttatcttttgtattttttgtttcaatttcgtttagttctactcttatctttgttatgtattttttcccctgctaggtttaggtttggtttgtttttgtttctctcattccttgaggtgagaccttagattgtctgtttgtgctctctcagacttcttgatgtaaacatttactgctatgaactttcctcctagcattgcttttgctgtactccagaggttttgacaaattgtgtcactattattattcaattcaaaaaactttttaattactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagctttatggggatggcattgaatctgtaaattaccttgggcagagtggccattttcatgatattgattcttcctacccatgagtatggaatgttcttccatttgtttgtatcctcttttatttccttgagcagtggtttgtagttctccttgaagaggtccttcacatcccttgtaagttggattcctaggtattttattctctttgaagcaattgtgaattggagttcactcatgatttggctctctgtttgtctgttgttggtgtataagaatgcttgtgatgtttgtacattgattttgtatccacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatagccaaatgactataaatcatgctgctataaagacacatgcacacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaattttttttaacttccatcttgatttcgttgttgacccacagattattcaaaagcaaattatttaattttcatgtattttatagttttgagggttccttttggatttaatttccaattttattccactgtgtctgagcaagtacttgatataatttcaattttcttaaatttattgagacttgctttgtggcctatcatatggtctatcaggagaaatttacatgtgatgatgaaaagaatgtatattctgcagttgtttggtagaatgttgtataaataccttttaagtccatttgttgtaaggtatagtttaagtccattgtttatttgttgagttcctgtcttgatgacttttctagtgctctcagtggagtattgaagtcccccactattattatgttgccatctatctcctttcttagatctggtagttattgttttgtagatttgggagctccagtgttaggtgcacatatatttcagattatgataatttccagttggactaatgcttttatcgttatattatatccctctttgtctttaattgttgttgccctgaagtctgttttgtctaatataaaaataactactcctgctcacttttggtttccgtttgcatggaatatctttttccatcccttgaccttaagtttatgtgagtccttatgtgttagatgagtctcttgatgacagcagatacttggttggtggatttgtgtccattctgtcattctgtatcttttaaacggagcatttaggccatttacattccatgttagcattgagatgtgaggtactgttctattcatcatgctagttgttgcctgaataccttgtttatttttaattgtgttattgttttataggccctgtgagatttatgctttacagaggttctattttgatgtattttgaggctgtgtcaagatttggaactccttttagcatttcttatagtgctgtcttggtagtggcgaattctctcagcatttgtttgtctgaaaaagactttatctctcctacatttatgaagctgtgctgctgtatacaaaattcgtggctgataattattttgtctgagaaggcaaaagatgggaccccagttccttctggcttgtagagattcttctgagaaatctgctgttaatctgataggtttttctttacaggttatttgatgctcctgtctcacagctcttaagagtccttcctttgccttgctgtagatgagctgatgactatgtgcataggtgatgatctttttgcaatgaatttcctgggtgttctttgagtttcttgtatttgggtgtctagatctccggcaagaccagggaagttttcctcaattactctctcaaataagttttccaaacttttaaatttctcttctttcccaggaacaccaattattcttatgtttggttgtttaacataatccctaatttcttgggggctttatttttttattttttatttctttatcactgttggattgggtttatttgaaagccttgttttgacctcggaagatcttcttctacttgttatattctatctttgaaactgtccagtgtattttgcatttctctaagtgtatctttcattttaaaaagttgtgattgtcttttctttaaaatatcaatttctatggaaactttttcattcgtatcctatattgttttttaagtttctttaagttggttttcaccttgctctggtaccttcttgagcaactaaatattcagccttcttaattctttatctggcaattcagagatttcctcttggtttggatccattgctggatagctagtgtgatcttttgggagtgttacagaaccttgttttgtcatgttacccaaattacttttgtggtttcttctcattagggtagactgtgtcagtgaaaagatctggaactcaagggcttctgttcagatttcttttttcatggggtgaccccttgatgtggtgctctcctcctttccctagggatagagctttctgagagccacactgcaatggttgttgttgcctttctgggtctagccacccagcagggctactgggctacagactggtgctggggaatgtctgcaaagattcctgtgatgtgattcatcttcaggtctccaagctactaccagcacctatactggtggaggtgggaagggagtgaagtggactttgtgggagtccttggttgtagttttgtttagcgcactgcttttcttggtcggtggttatgtgtagttgtcacatggacagacttatgacctctggttagccagggtgttgcaggaggtggaattggctgttctccttctttggagcaagcttgttctgttatgagttacaataatggcttgagttggttggcctccatccaggaggtattaatttcaagagagcaccagctctgttagcagaaggggagtatacaagtgtatattcctgtatattcctggccctatgttggccagggtaagtacttgggtttctcaggtgatagcaagggccatagagctccaaagaggtttttttgtttgtttgtttgtttgtttgtttgtcttcagctaccagggctggtaaagagaagatatcagttgggtacagggttaggctgctctgagctcagactctccttgggtggggcttgctgcagtcactgtggaggatgggagaatggttttctggccaatagaattgtgttccttggggggattatgcctgcctctgctgcatcatacaagtcgcctggaagtggcctcacccagctcccacgcagccagaaaggccagtctcagtactaccaatcaccaccaacagcgctgagtttatatccaagcagcctgagagcagggctgagatctcaccccaggctacaagcatccccactgagaaaacaagcaaggctctcaggcctcacctctccccacctgcctgtaccatcagctgtggcttctacactcatatctgcacttactgttcaccccacccccacccagagtctgctcagaaaaagttgtgctcggtcaaaattattaagaagttcagctcgaagttttcttcaacctgtgacaccttctaaattcttctggctgccttccccaaggacccctgtgaggtaaaaccaggaatggcttccctgggctcaaggtggggactggtagtacctacggggactggtagtacctacagggctcttcctgctgcttcttctgcttttatatttcactctgattcctaaatccatttcagctctaggtaaggttaaatccttctcctgtgacctggacctttaggttccccatttgggatgtgtttgggatcagactttttctcctttcactctggaaacacgttttttttcagctgtctttcaaagtttgcagcagcaagctacttctttcaaagggtctgtgacttttttgggttttcctgatatgttcctgcagtggttttggagcaaaagttcacaatgcgagtcctccacatgctgttctgtccatccaagtgggagctgcaccttagtcttatctcttatccaccattttctggaagcttggaatacaaattcattaacaagctattcaaaggccaagacaatgtgactctaatcttgttttcagtaactccttgcaacactattctttagctatatggagatatttattgagcctcacacaagctcctactttatgccttccacatgctgtttgcactgccttgaattctctgttgcttctaatttgaattgtatgcattttaggatttctcttagatgccacattttatgcagccttttctaactctaccatgtaaaattaattcctgtgcattattttatttgaatctttcttgtgatactcatcattttttatttttcggtttccctaaaagtatgctctttgagtgaaacattcatgtttgtctttcacatttctttctatttacattcataacccattttaagtgctttttatacaaaaattattcattaaatatttgttcactgtatgtaaaaggttgacatctcagggtgaagagaattattaaatatttttgaagttggtttatataatattagcttttacacactttctgtaagtttttcaaagtattttttgtctgtcatatttgcatttatttgtttaaattatatttgtactatataaatgtttaaaaaaatcccttttaataaaaacttaattttatcttaagtgtaagctagagttagcttagctacttattaattgtttctaagttcaaaattactgatttgtaaacatgtattagaagatcacagtgttaacagagtggaatgaattatccacatccctcaagtggtggctgcaacttagacccatggattctgtactagattttacataaatagaagtcataagacagcatgtagtgtaaaggatgtttgttactttttttcatcacttagcatctataccatatatctttttttggataattcaccactttaagagtaagtagatggcagagattgactctgtagaagttgaaattagcacataccaacgttttattcatcccttgaaactagggcaatgtcagtcaatgggatgcttccaactgatcttgaaattaggaggtgatggtgcaaagaatcaccaagctgaaggattgactgagtatctactgcagaggtagacagtggcagcctaaacatgtgactttcagaagcaacagggtaaatggatcactgcggtagctatagctttgaagtctgtggcatatgctcttcagaaactaaatgtagttatcctcactgatttagttttatgaaaagatttttattgtggtcttcttggctgcctattttttcttaatcctctccatctttgagttcagttctctggacttcctgatagtactctgatcaatcaaacatccattcaatggattctctttggctaattctgccatagtcaattactgcagcaactgacaactatgactgttaaaactatactcttttggcaccattgctggatgtatggtatgcttacttcttctctaattttttcccttccttttctagctagataaatatttgtttagccttttcatatattttctttgtatcataatttgaactctcttctgaattatcaccagaatctccttgtacctcttcaatagtggagggccaaaactcagcacttggtgaatcttggtggtttaaaaaatggtaaagacatagtccactctactatttagtagttgtgtgacttttagtaaattaatgaaccattatttttcattgtaattctgtaaaatgaagacaatgttactgattttatgggatttttataagaattaaataatgttagcaaagaccaaagacaatagcacagttctcacacatagtaggcattcagcacagtgaatagtagttatcattagtaattctgtaggctccatattgcctaaggacctaaagatatgatatgtattccctgtgtgtgagataacaatctctatagtcaatttcagtttgacttatataatatccttgattttattttctcaaaattatgcctgtttacttggtacttgcttttaaaatggtattcaccgaagctttaacatccagtgattaacagtgagagagagtaaggctctttttaaaccaccagagtgtgttagggtagtactgagtcaaagtctaagagttttatggttaaaaaaacaaataactttttactgctgctcatttaagtaggattttatgttgttcccaagatgggagtctacaggcaactaataagcgggaagaagtgactgtgaagacaaaccagctgcatcaaactgcaggcacctcaggaatcagcagatcatgcagggcacaaagaggtgaaaccagtcaagtgtacagtggagacgatttctcaattttttttccttggaatactagcatcactcaaaaatgtcaatagtgtttggtgaacaaaataagctttttaaattaaatgtacagaaatccctgcttatcagaatgacaccttgaattttcataatacatattagtatacccaagtaaagaagcctgtctaatttttctgagatctttatttctcccaatttgctggaacatgttttatttttaatttgttttctttgatttgcttttacaggaactttgtaataatctaaagaacgcagttgctataatttgataatgacaaatgaaattatgaaggtaattctgagcaattgcgaaaactcacaaacaacagtctaaatatttggagctttatactctaaatactggggagccactaaagatttttaaagtagaacaatgaagaattggtgcattacaaaaattagttgacaatcatatttagactttatttgaaagataaggaaaaatgatagaggcaagggaatcaattgaccagctattgtgatatctcaattttgaaaaataattaaaaattagaatgaagggatctatgtaaaaggaagccaccaagagaagtaattaattcataggacatgatgattaatggatgtggatgaggaggaaaaaggaggttgaaagaaagtagtaaaaactggcaagagagtccatgtctgaataagaagataaaatgtcacactgattaatactttaactgaccaaatcaagacagtgagattgtttgtggaagaatattgcaaataatttaggagctttaaaattgtggacttattctgatgcctccacctaaattgtctggtatcaaaacttgctgatggttgcatcatgttccagctttccatcttgcattttctaactcagtaaagagttaaaaggtgatttaaaaaaaaaaaaaaaaacttcctttggcatggattatgtcagctttcatctacatgctatgcaaaatcatgtcttggttagtatttttcttatcttttgatggttgacatgcaagagagaattaaacatcaagataattagtgaatcctggtgatatggttcagctgtgtccccatccaaatctcatcttgaattgtagtttccataatccctacatgttatgggagggacccaggaatcatgagggcagtttcccccatactggcctcatgttagtgagtaaatctcatgagatctgatggttttataaatgggagttcccctgtacaagctctcttgcctgccaccatgttaagatgtgcctttgctcctccttcgccttccaccatgattttgaggcctctccagccatgtgaaactgtgagtccattaaccctcttttgctttataaattacccagtctcagatatgtctgttagcagcatgagaacaaactaatgcacctgaatactttagtgttttttagtagaatatgacatattatgagtacacaatgtgaagaaatccggatattcgaaagacaaacatttctgaatgaaggggaaaagtaagctggggcaagacaacgtttctcatccctgattgaaatgttcctatttaccccctaacttataccttgggatgttatgttgcttgtaaagaattgtgcagagacagatggaaatattaaaatatttatcctaaataaatgtttgagttaaacggtaatatcctgtgctgctctagattcaattctatcaataagctattttgagattctgacctcagtttcttgtcttcttttaagttatctctgggccctaaagagacacagctatgaaactggagaatgactgcagaataaccaaaagaagttatccaacagaatttataagatataggatttcgtttcaagagagaaaacaggagtaaaaatataaattttgggattgtccacattagagagaaaaatcatatcttcatatgaagaaatatagaatttcttcaaaaaagaaaatataagggaaggagattggaatattaaagaaaatctcagagaacatccacaactgaattccaaaaacagaggaagaattatcatgaatggcaaaagatatataacaatatacgaatgaagagaatatatccactagagaattataagagaaaggaaatcaatttaggtgaagaaagtctaagaggaaggggataaaggtgactaaatttggtgataaaaaattgaggtaggcaaaataatggcctccaaagattcccacattctaattcttgaaattagtgtttatgttatgctaaatgacaagggagaattaaggttgcagatggacttaaggttgataatcaactcactttaaaaatagagagactgttctgaattatccaaatgggacaaatgtaatcgtaagggtcctttatatgtgaaagaatgtgaaagagggcagcagaagagtcatcagactggttcaaggtgagaaaggcttggttggctagctttgaagatggaaggtttcagaagccaaaagatgcaggctgactctagaggttggaaaagcaagggaatgaatttactagaaaggaacagagacctgctgacactttgattttagctcagtgagatccaatttggacttctgagaaaataagttttacagaactgtaagttacagaactgtaggaaaataagttggtgttgttttaatccactgagttgtaccaatttgttacagtagcaataggaaacaaacatagaagctcattgtttgcgtagatacgcagtgtcagtacaaaggacaaagacctattaacagagttacaaatgagcaatggaagtagcaggtgttgcccatattttcagcagattaggcagtggaataagagaataggataaaaatatctgagaaattgttaattggggaaaaattcaaatacatctaattaaatagaaatagcattgttcaagacagaagctctattatattagctccttctttgcaactaagcagaatatttcttgagaagattatatgagcataattgtcaaaccaagcaaatgaaaatctcccaaactaatggatgtaataagtgagatctagaaactcacagaaagctgtttcatttaccataaagaataatgaaaagtctttcatctctaaattgtatgaagtgagaaattctgccaattataaatgagatgaaaacgaatacttaagaaaaattctggcaacttcataaaaaatgccaattttacatattagaagaaaaaacatattatgctgttgacatgttaagtgcatcaatagagataatgaatatgaatatgctaaatcaaggcatataaaaaatagaagactaggatattctcaaaaaattcagtttatatagaaagccagcctggttttttacaaaggtttgtataaagaagtacagaaatatttaagggtagaagaaaaataagcagccatatgctactctaaatagtgctgagttatatgggccacttttatgcaaaatgaattctattgtaaaacacaaaaataatgaaaaaaaattgtctctatgttgatttgacagaacttacggttaaagctaatgatgcagttttagaataaattttcctaaatctaggtagagaaactcaattgtcaaatgaatgatctagacccgatgacctactgggttccttctaaagtaatggccccaggtatcctagtgcttgagaaatacgtaagcattgcttgaaaagagcatgctggggcccaaggtttggtaagcgctttatgaagttttgctgcttgccttctcagaccctttagcacataaatttctaagaaaatacttctaaatgaatcattttccctgataggtcttttgataacagaaaaggtttttgcccgtggatctcaaaatacttgtgtttaacacattaaactgttagccataaatcaatttagagtcctaaaacaataatgaaaaataagtcagaatcattttgacatactgctttctaaatatacatttttcacagaccctttgtgttataatcaactggtaacttcattcttctacttcctaagattgtacattcaccacttggatggtgtagttatgagcactcaattatttttttatctgaggaagtcttccttgagctgttagttcagatctctgggcactgacatctcctgttcatttcatattcttgattgtcacgttacttttttttttttgaggtggaatctggctctgttgcctaggctggagtgcagtggcgcaatctcagctcactgcaaactccacctcccaggttcaagcagttctcctgcctcagcgtccctagtagctgggattcagacgcacaccaccacgcctggctaatttttgtatttttagtagagatgaggcttcgccatgttggccaggctggtctcaaactcctgacatcaggtgatccacccgcgtcggcctcccgaagtgctgggattacaggcatgagccaccatgcctgacctgtcaagttactttctatacacttggtgacgctttggtcttttctgttaaatcactctcagattcccgaagtgtttttcttatttaggaatagcaatactgttaattagctaagcatccgtgatgccattcactttttatggcttatctcaaccctttcaacaactttgtgctagaggtcaatttaaccgttttgccacagagaaaacaaaaggctaagaaccccatagcttatacatggtagagtcaacattcgaacccacctttgcttttcttcaaagctggtcttaagggtaatgcccaattttcttgccctctctattccctatcgtaaattccaccctcaaaccacctacaatttcagacatatttccattgtttgaccctaggtggacaagagaagagagatattacttaagagactagaagtcaaggactagattttactaggtaatcaccaaacctcacaccagagctaagagtttctgaactcactcatgcccccgggtgctgcgtgactctgaaactcaatgtcaggccttatgaagtgatcatgagctccctttggaagcagccacctctaccatttcctctttcccatctgcttctccatgaggctcttcgcttccttgagaaacttggcttcacacctatgagtaattctctgtctcctttttaaccgtacaccttcaatcaacagcccttctgtttctcttgccacagatctccacagaggcctgaaaaagtgatttatctgagcaaaggaggtcttctttattcagtgccattgctcccagatgttttcttctgattctagaaggcagatttatgtcgttcctgttacctcagcccatgaagctcaggtaaccacaggcaccttctggccgtactgtattaaaattatattctcctgatttacatacattaggtttatgagctattggaagcacctaataactttgggcaagatgatcctgactttatttttttattttagattcagggggtacatgtgcaggttggttacctgggcatattgcatgatgctgaggtttggggtatgaatgaccaggcactgagtaaagtaccagtaggtagttttccaacctttcccttcctccctccctccactctctggtagtccccagactttttttatgtgacaatatcatttttatttttctaacaaatctttcttcctttttttcttttgaagataaacatggatttaataagaatcagataattccacttagaatcatctattgggggggctattttaaaatgctggtgtctgatttaattgctttggagaggacctgagtataaatattatttttaaaagcacccccggtgattccagtgtgcatctgggaatgagaacccttgttgtcggcagcacttctcaggttcatattcttaagtggggcaaccacacatgctagtttgccttaagtgagtcctggtgtaattattcacagtacttcctgctattctcagaatctccactttgggtgataaattatatggctaccctattcatgaaaatcatctgggaagctcattaaaaattcagattatctaatctcaggtcagaagattgagtttctgtaggtctggggtaaggtttgagtctgcattaaaaactagtaaaattgtcatgagttgattctaatgcaggtgatgtacacactccaactctttttaaaatagattatttcttttggaacagttttagtttcacagaaaagttgagggaaaatacagagatctcctatgggctccctgcccctgaatacccacaggctggctgactgtgagagtctcacaccagagtggcagatttattacaattgatgaagctacactgaggcatcattatcactcaaagtctatggtttacattagggttcagtcttggtgttgtgtgttctatgaattttggcaaatgtataatgacatgtatccaccatcgctgtatcggaaaaatgtttcagtgccctaaagatcctctgttctctgcctattcatttctttctctcccctaatgactggaaaccactgatctttttacagtcttcatagttttgccttttccagaatatcatatagttggaatcatacagtatgtagccttttcagattggcttctttcactgagtaatacacatttaagtgtcctccacgtcctttcacggattcttagctaatttttttctgaatgttcatgtagtttatcctttcactgaatgaagaacaactttatttcttccaagttttggcaattatgaataaagctgctataaacatatatgtggagtttatctagtggacatagttttttaacaaagttgggtaaatcccaaagcgcacaattactatattctatggtaagaacatatttagttttgtaaggagctgccaaactctctttcaaagtggctgaaccgttttccattcccaccattgacaaatgagaattcctattgctctacctcctcaccagctttcgatgttgtcactgttttgtacatttgccattttaatagatccctaatggtatctcctttttgttttaatttgtaatttcctaatgacatatgatgttaagcatcttcccatacgcttatttgctatctgtatatcttttttagtgatagttttaaagtaaggtgttttgtctattttttaatcaggttgttcattttctcattgttgagttttaagatatctttgtatactttgaataacagtcctgtatcaggtatgtcttttgcaaatattttcacttagtctgtggtttgtcttctcactctctcgacactgtctttttcagagtagaagtttttaattttatgaagtccagcatatcaactctttgtttcatggactgtgcctttagtgttacatctaaaaagtcattgcaacacccacggtaatttatatttttctcttgtattatcttataggagttttatggctttgcattttacatttggctcgatggtccattttaagttagtttccgtgaagggtgtaaggtctatgtccagattcatttttttgtacttgtaggtccggttgttccagggccatttgtttaaaagactatgtttctctattgtaatgcttttgctactttcaaagatcaattgaatttatttgtgcaggttgtttctcagctttctattctgttccattgatctatttgtctattatctttaaagtaaggtagtgttaggcctccaactttgttcttctccttcagtattgtcagctattctgagtcttttgcctctccatgtaaactttagaaattctctgatatccacaaaatatattgccacactgtccttttaaaacactgtttagggtctgaactttaaaaacatcggaacctataatagtgtgtgttagatattgtcaagttttccgtattctaaagaaagatactcaaaggtgaataatggatctgtaatttaaataataataaataatagttaatgaactctcacaacgttctattttctcctatttgtcctatttgatccttaaacaacatagtgaagtggttatgaattctgttgtatgaattaagaaactgagaatttgaataattttttctaaatgtgtacagttagaaagtggtagaattttgattcaaatttaggttaatgagccataatgctttattatgattgtgtaatgtcatttcccaaacactgttcactgatttaaatctcacaaaatccttctgatacagactgtaaaaggcctgctaatttagacaggtgaaacgactttaccatttatgatgttatactggtagtgtaatgaaggcagaatatgaatatagatcttttaattccctaaccaatatatgttcttctcttttacttaatgtagattaaatgacgatctgcttgttttcatttaaattttaaagacctgtgaaaaccactatacttttgtaaagaaggaaaaacaaacgttcacattttgaggtagatagaaatgtcttattacatgctttggcaactctttctgaaggttaaaacatattagaaagccccatctcttccatttctaacagtaaagccaccctgactagctccccaccttctttgtaacttatctcgtatttatcatattcaaatctgcaatcttgatgctattttcgtgatcgtaattcatgctcaacaatctgcttccattctcaactcagtgagctggcaatcaatttcttagtgctatttgagaagaaagcaaaatctaaaaatgaagctattactatattacaagtaagtactaaatctgttaggtaggggctgacagatcacattagaatgtgtgccctgaggcactgtgaggcatgagaagggacttgtgatgcatgacactattattgacctttgagttacacaatttatcagaaaggaaaaaatagtttcctttgtgtcggtaaaaaccagtaagtgagccctttagtctagatttccaggagaagcaaattggtcattgtaaaagttcactaattcggctgtttattctcccaaacagaaatgggattgttaccacctgaccagcatgcatttagcagagcagtccttagctaaatattacatcagaaaccagggtaagaagcaggctatattgtgagaactattagaagtggttggcctatcctttaattggtgtttcacactgctctgcttccctacttaccattatacatactcacacgattacaaacttaacattacaacataataaacatcacggtgctctgtcattaatagagcacttcctccaatttatgcatgatacttagctctaaacttgatttatctgatttaatccttcaaatagtctacgacctaagttttttttttttgtttgtttgtttttgagacagagactcactccgtcatctaggctggagtgcaacaatgcgatctcggctcactgcaacctccacttctttgggttcaagcaattcttgtgcctcagcctcctggatagctgggattacaggtgtgcaccaccacgcctggctaatgttttcatatttttagtagaaatggggtttcatcatgttggccaggctggcacaatcctagtagtattatgctcattgtgctgttatggaacttgaggctttgatgattaagatgagttgcccaagtttgcacagctagtaagtgccagaactgaaactcaaatctaaggggaaatgggctttatcactgtattcttaagcatttctctgcattgcagtgtatgtaaaatgaatggatagtacttgaaattagtcccggacaattaagtctatatgtgatgtattcaaaatcagttgaaagttctaggatctaatcactgccatagtgcactccaggtcatgcaacaaagcgttaccccttttttgttgttgttcatcattcttatctaaagaggattatattctgaggtctttattgcattcacagcattcctgagagccacatgctatgagaaccctctttttttctcattttaaaaaagttaactttattgggatatatatataatttacatagaataaattttaccttcttatttgttcagttttatgaattcttataaactcatgtaaacaacatgagaatcaagacaatttccataacccaaatggttcatcattaactgtaaataaactttttatttagaacagatttagagttagaaaaaagttagtagtacagcgagttctcatgtaccctccacccacccagtatattccctgttgttagcatcttgcattagtacggcattgtgatctttttctgtgccagcatttcatccaagataccatgtttacgtatagtcatcgtgtctcctcgggctcctctagtctgtgacagtttcatagactttccttggtattgataaccctgatgactttgaggactattggtcaactattttgtagaataactctcatttaggatttatctgatattttcttatgattagactggggtcatgtgtttttaggagagagactacagagataaagtgccgttctcatcacatcatatcgagaccatatgctatcaacatgacaaatcactgttgttgttgacttttattacttaactgacttagtgtttgtcagatttgtccactgtgaagttattctttcctgccttgtctgtaaaatactttttaggaggaagtcactatgtgaagcttagagtggggagttatgccctgccttgtttagtggggaacacctacacaaattatttggagtaaacagaggatttgtctatttccttcatttgtttatttatgcattaatttaatcattaatttatatcactatggactcagatattttatactttgggttataatctaatagcacattttaagtttcgttgctcatattgtgctagctacagccattagaagctctttcagttgactactgtgtccttttgacatatccccattgttgttttctgttggttagtttatttttgctttatttctagcacttgttctctgggaatacaaactatcccaggataatcttatgtattccctgtccaagctcccaaatcaaccatttctccaaggggttctagttccttttagtcgagaagccaagatctgggtgctagaggtgctcactgctaccagggtgttgttccttctatgtcccctcagatgatggagaaagagatgtatatgtgtatactagctcacgtgtgtacacatatcaaaaataattccctgtgtatcatgctaaacgtgaattgtactgataccttctactgtaattcattataacatggcttattctaagttgttctccctttcatgtttctaattcccatcccaacaatgagcgaaacctatcccttgctagctgccattgatttacttacttgctcagttcttgtatacatgtatatgggttcctgaattgtttacttgtatccccatgggaaacaactttcccaactagagtgcgtacgcgcagttcattttgcctttggttttatagcctctgtgtatttacaaaattaattagggccatatatgctgaccttttatgagaaaatattcaaatcagcataaaaaataaagttttatttagtgtatagctacattgtgaacagttttaaaattctagagttacttacaatcatggatgtgtattcatgtaataatagttttaagtctatggtgttcattggatagtctaatattatagcagttatttttcaattaatttttaaagcttttatgtttttggttttctggtctttccatttcatgcatcattaaaaggagaattctgtaaaacaaaacattttatataaagatgaaatatggaaaatatttcctataagctgtctgtattattatgtattttaatggacttaaaaatgtataaaaatatgtttaaatatttgtaactacactccatatatcaattaagaaattggctgcaaatatgtgactttaaggtacgtcttttagaataaataattgtctacattcttggtaataaaatagtattattctgaaaatactaagcaaatgtggctttttatcacctgaaatagaaaaccttgacaatttcaatgctttctcctgctagatgaatcttatgagatcctataactcacccaaactttaaaaagcaatctcatctcaaactattctttccaaagttctcttttggaagttcaagggtatgttttaaaaaataattaagtaaccatgtaaattgagaacaaaatagatgagctgctgtgttttctgtataagtcatgctggatgcaaggttaggattttaagttccataaaatcaattatatacacaagctgaaatagtatctgagactaaggtaaatagaatgagcagggcatcaaggatacagcagtcaaaaacagcaaacctttcactgaatatcagatataaaacatttaggaacctgccttgaagaaatcttcttttgattaaaatttaatgatttatatttataaaatgagtagctctgaggttttatatattcataacgtcaagagtttctcagatacttcaagtacattcaagcttttgtaatgaagattcattttaaattaatgatttattactttcagcaacattttaaagtagtttgtagtatgatgttgggctccaaagaaaaacaattgcctgaagaactgtatcaggtaaaccttctctgtaacagacttcaaaagaaaatggctgagacaaactgggatgctggaaaactgcaggtgtacttttcaggatataagcattaatacgtgtgtaatactgtaatttctttaaaagtgtaatttggggcatggttaaaccacagaggtgtctatgaatttgattttgactcccaactgcagtggcagtagtgtgtgcctttctcttccagagcaataagcattttgctgaggaacttaaaatttgcatctaggaaattgaatctcctaggctagtctttgatcacacaaatctaaactaaagacggacacagtacaaaacaaaaacaaaaacagaacaagtggttcagcctcaatcttcatttttttctgtgtatgattacgagcgaagtagaggtacatcacaacaccacaatcatttattgaatagtgtacattaccccaacatccttattcataatgactttaagatttaataaagggaattagaggaatatacaaacgtatatgacagttaggtacttcacctctaaaaaaaaacaataaaaagtgtgtattcaagggagggagaaaagacatttctttaaggggactgggaacactttgggcatttgttgaatgcccataatattactttaaaaatgcccctcctattcaacatagtattgggagttctggccggggcaatcagacaagagaaagaaataaaggaagagaggaagtcaaattgtctctgtttgcagatgacatgattgtatatttagaaaactccaacatctcagtccaaaatctccttaagctgataagcaacttcagcaaagtctcaggacacaaaatcaatgtgcaaaaatcacaagcttttctatacacaaataacagacaaacagagagccaaaccatgagtgaattcccattcacaattgctactaagagaataaaatacctaggaatacaacttacaaggaatgtgaaggacctcttcaaggaaaactgcaaaccactgctctaggaaatagagaggacacaaacaaataacaaaaaattccatgctcatagataggaagaatcaatattgtgaaaatgatcatactgctcaaagtaatttatagattcaatgctatccccatcaagctaccagtgactttcttcacagaattagaaaaaaccgctttaaatttcatatggaaccaaagagcctgcatagccaagacaatcctaagcaaaaagaataaagctggaggcattaagatccctgatttcaaactatactacaaggctatggtaaccaaaacagcatggtactggtaccaaaacagatacatagaccaatggaacagaacagaggccacagatacaataccactcatctacaaccatctgatctttgacaaacccgacacaaacaagcaatgggaaaaggattccctatttaactttgttgttgggaaaactggttagccatatgcagaaaactgaaactggaccccttccttacactttatacaaaaattaactcaagatggattaaatacttaaacataacacgtaaaaccataaaaatcctagaagaaaacctaggcaataccattcaggacataggtgtggggaaatacttcatgtctaaaacaccaaaagcaatggcaacaaaagccaaaataggcaaatgggatctaattaaactaaagagcttctgcacagcaaaagaaactatcttcagactaaataggcaacctacagaatgggagaaaatttttgcaatctgtccatctgacaaagcgctaatatccagaatctacaaagaacttaaacaaatttacaagaaaacaacaaacaatcccatcaaaaagtggacagaggatatgaacagacacgccataaaaaaggatgagttcatgtcctttgaagggacatggatgaagctggaagccatcatgctcagcaaactaacacaagaacagaaaaaccaaacaccacgttctcactcgtaagtgggagctgaacaatgagaacacatggacacagggcggggaacatcacacgccggcgcctgtcggggtgttttgggggctaggggagggacagcattacaagaaatacctaatgtaggtgatgggttgatgggtgcagcaaaccagcatggcatgtgcataactatgtaacaaactgcacgttctgcacatgtaccacagaacttaaagtataataaacaagaaaaaagaaaaaaatacaattaatttcaggatatgattttaatgaatagcaactagtaacagaggttttaaacatgacaaagggagaattttcctggggaaacatttcatacccaaactctatcttcccctttaaacatgtcaaaggggaagatacagaatgtataaaagaaaagtgccagatattttcacagagcagcactaaatctataattgtaagaaatataaggaaaataataggtgataaagctaaaaataaacattaagaacatactactgaaggccatacatgccagggtgaataatgtgtatttaatatggaaggaacaaaaacattggatttttgtagtctagaaaattaatatagaaatattgtgtataaaatgataaagggaaaagcaagatgtatggatatcaagattgactataataagagaaaaaacaggaattaaactagtttgttaaaattataatgaagggaatggtaagctaaatattttgttactgtgagcaatataatttggaaacataaatatagaaatacaaaatcaaagatgatacagaaattctgattgctaatgcatgggagaacgagcacacccttaacataaaaaagaagataagttggcttctagaaatatgactagggatgggtgcaggagggcatgttctatttttgaacattagaggtcctcaccccaccccccaatattttactatttttattaatcctatagtgcacatattggacataaatcatgttcctcacttatgatgatatctctgggataggttcctagagataaaatcatgctttcaaagactttctttccctacgcattgtcatattctttaccaaaatagttgtatcatcttcagcaatatatgagggagtattgctaactatattctcattaaacttgataattaacatgtctcttgagttttaccagttttagtaaaaatgaaattttgttaatttcatttgaatttctttgtttacaagtggaatcaaatgttaaaataggttatttagattttatattttcctttctggaaattgtttatccaggtattttaccatatatattcacctgccatttgtttctataggccttattgagtttttctttctaactaattgaaaagaatatatctgtttgttgacttttaaatgaatatttgctgcaagttttcattaatttttatttgcttttttcttttcttttcttttttttttttttttttttttttgagacagagtcttgctgtgtcgccaccctggagtgcagtggcgcgaccttggctcactgcagcctctgcctcctgggttcaagcgattttcctgcctcagcctcccgagtagctgggactacagtcacgcaccaccacgtccagctaatttttatatttttagtagagatccgatttccccatgttggtcaggctggtctcgatctcttgacctcatgatccgccctccttggcctcccaaattgctaaaaattacaggtgtgagccaccgcatccggcctttatttgctttataattgtgttcatagttttaatgtatacatatatatatatatgtagttttgaagtgtccaagggaatctgaaggaaaatgcatttttttaaactggctgacatacaggaaggaagacatccttcaaagaaactgcttcaaagcaattacacagggaggaggttttataaaatttgggaggatgagccactctgaggaaaagcagaagaaatcctgagaatgaaaaacagcaaattttatgcattctggcatgcacattttcagcaaataggatgtttttggtgtgaggaagaccaaaagaatctcataacttcctttaggaaggttatgatcactcacttctcagggataaatgacattttccagctggggtcaatcaggagtggggaaaatgtcatgggaatagagggatctaaaatcattcagaaaaaaaatcttacagaagtcaagtcaaaccaaactatcttttcctttatcgtttccagtattctctatctgggaaatctcccggctcaagttaatatctgtatatacattttttctttttttacgactcacatgtggcacattttttagaataggatgcatggagttggtcataagtgacttttcaaataggtgaccaacagatttgtggtaggtagaataataagtacactatcttcccaaaattttcttcttcatcttcagaacctataaatatgtgattttcatatcaaaaagaacctgcaaaatgttgactcaggatacagaccttgagagagatcatctgaatgggaccagtctaatcatatgagttcttaaaagcaaagaaaatgtcccagctggatcaagagaagagaaacaagaagaacttgacctactgttgctggttttgaagatggaagaaggaaccatgttccaagcaatgtgctagatgttgggaacagccctcagctgacagccagccaaataattgggacctctgtcctattgtaagatactgaattctgccaataattcaaataagctaggaaatttattttcccctagactttccaaaaaggagcagagccttgcagacaccttgattttagccctgtgagaactgtgttagaggtctaacctacagaactgtgagagaataaatttgttttgttttaaggggttaactttttggtaatttattccagcagcaatggaaatccaatacggcatacaacattattttttgaataatcttttcatttttaatgggtttaatgtctaccatttattaaagtcttttatctattatggctgtcctggagaatcaaggaacctgggggttagaagagatatgagtgacctggaaagtagatagaaaactgaattagattgtttcaagaagtacagggaattaatgagcagggtgttatagtgagcacctgtagtcctggctactcagtgggctgagccaggaggataacttgagcccaggattttgaggctgtagtgagctatgatcatataatttagtcagtattgaggaagtagaggttacactctaaattatacagtgaaatgaaaggtgatgacatgtaagttgagaaggagtctgagttctggaaggagtaagtttgggggcatggaaaaatcagagcaatcaccaaaacaggaaagatataagattcagaaagaagataaaataattgatagtgaggaaaaaattatatagtatttacttttcttttgagactttatcttctgtttcccttctgttctttctgccttccttctcatcctactttccactgtagaattttgtcttgaattttgatccatggcaatctataaaagaaaacactaataacgttcttaaattcagagagaatttttcctatctctgagagcagttgtaaagcgtgaatttgtctccaaagtggtttgcattctttctataaggatgctaaatgtaaacaaagtactgctattagaatgatatatgtgaggctccccatgcaccttggcagaaaaatgttatataaatggaaagtgtcgcatatattttaaaagaatgcatgagtttattcctcaaggggagttgctaatttatgtactgtgcttgttctaaaggtacgtgcatgattcataagttagtttataagtaattttgtactggagaaagagagctaagaggatacttaactgtttccaagtatctgaaagacttattttatgataatcaactattcaccattttattgtagagaagaaggaaatcaatttaaatttcacctgtaaaagtttgtgcaaaatataaatcttatgtaagcatcctgatttgttgtggactttaagaatacaaaataaatactctttttattttgttttctaattcttatgcccctaaattctctgttcttcatatccacactcctgaattttaccaaatagttttaaaaacattaaccattcccctgctgtaaatttttcctcttgttagtctttttttaaatctaaaaaaaaagacaattagttttattttataagccatctatacctctatcatggctacctaatatctggggttaaatatgtaccatgttcagacagtacgggcataaatacacacagtgtccaacggaacaaaatagagaactcaaaaataaattcacgcatttacagtcaattcatttttgacaagggtaccaagaacatgcactggagaaagcatagtctctttgataaatggtgctgggaagcctggatatccgcacgcagaataataaaattagacccttatgtctcacagtatacaaaaactaaatcaaaatggattagatttaatctaagacatcaaactataaaactactaggaaaaagactggggaaacattccaggacgttggtctaggcaaagatttcttgaggaagatctcaaaaacggagggaaccaaagcaaaaactgacaggtggaatcacatcaagttaaaaagcttctgtacagaaaaagaaatcatcaagaaagtgagagacaacccacagaataggaaaaaatatttgcaaactacccatctgacaagcgattaataaacagaatatatagggagtttaaacaactcaatatgaaaaaataataataatccaatttaaaagggacaaaagatctaaatagacatttagatcaaaagaagacatacaaatggccaagagacatataagaaatggtcaacatcactaatcataagggaaatgcaaattgaagctacagtgatatattgtctcacagcagttacgatggcttttatccaaaagacaggcaattgtgaatgctggcgaggatgtgaagaaaggggaaccctcatacactgttggtgagaatgtaaattagtatagccatatggagagtagtgtggaggttcctcgaaaaactaaaaatgaagttaccacatgatcctgcaatctcactgctaggtatatatccaaaataatggaaatcaatttatggaagggatttctgcacacttgtgtttattgcaacactattcacaatagctaagatatagaatccacctaagtatccatcaacagatgaatggataaagaaaatgtggttcatatatacaatagagtatattcagccattataaaaaaatgaaatcctgtcatttgcaacaacatgttaagcgaaataagccaggcacagaaagataaatatcacatgttttcatgtgggagcaaaaaaaaaaactgatctcatggaggtagggagtagaatgatggttaccagaagtttggaagggtcgggcagagagggtgataaagagacagttaatgtgtacaaaaagacaattagatatttgggataaaatttagtatttggtagcataatagaggataattatcaagaatttgttgtatatttcaaaataactaagagtggaattaggatgtctctaacacaaaaaaagataaatgcttgaggtgatgaataccccaactacctcgatttgatcatcactcattgtatgcttgttcatacatgttatactttgatacatagaactagtatgatacgtacaactagtatgtatcaaactcatgtatacatactcattgtatgcatcaaaatataacatgtaccctataaatatttccaactattgtatatccataataattaaaaataaaagttaaagaaaatatatatgtaccatgctcatgaaagtttgaataaatcacaaagttacttgaaagtaacaccttatatgtgtgtatatctctgtaatattttaagtaacagacttttaaaatattatttgtagagctaattctaatgggcatgagatgagttgtttttattttttgctttttgttttgttttggttcaaaactatcaacttttccttaaaaaggcaaaaggtttagactttttaaagaaacttgtataatacctagattatttttgagagtctcattcttgtcatactttcatgattctcattcctgcttttttcttctgacacaattaaaaaatactaagaaaagtattctctccaagaaggaaggccattattttttattccaaagtaatgatctccttcatgccctcttcactctgcccttgcagtcattagtttaatacgcaaatagaagtgagctgcctaggcatattgcaagagttaatgaccaactaattgttaccaacaccacaatcccctcccatgaaaatacagatactgtgaattgatgactagaatctccatatgtttaatgggaaaataacaggaggctccgttgtactagtgacaaaacatgagggaaaaaataattttcatcacgtgcccctgatttaaaattgcttcaggccatccttgtttcacagctaggagtataataaattaagaaaaagtagtatagggctgagatgaaaccctgtgggatatgtgagtgaactaacaggtagagaaattgaagggaaaaagaaaaaaacgtggatagccttgggtggataatacaagaagcaagaaaatagtgtcaagatgcagcagtaataagctaataacttacagatgtaatatacgttgctacaggtctctcaacttcatgtgtttcatactttaagagtttctgtgaccaagtagaggcttgataaagctgaactttatctattaataaaaaatacatgccactcattagggggcagttcatagtgcagcagaaggcatggtggggactaagaatgagaaagggaagcaagagacaagcaacatttactgagagccaagcattaggcatgtgatactcatttataatctactgttttgcctataaggtaaaatgtatgatttttcattacaggtaaggaaacgagtttggatatatatatatttttccctaaactttgttgacacatttgttcattcatccatttaacaaacgcttatatttaggtaagacttcttgaaaaaaaaatcaaattctgaaataagacaaaaatgtaaatgatttttttcaatatcaggtatggatataagctcatccaaatattaggtaatgtatagtaaatcatttttttcattaaatataggcccatacgtagtgaattgacatattaaattgtaaatgttgctgggcatggtggctcatgtctgtaatttcagcactttggttggctgagggaggtggatcacctgaggtcaggagtttgagaccagcctggccaacatagtgaaaccccatctgtacaaaaaataaaaaaattagccaggcatggtggcacatgcctttaatcccagctactctggaggctgaggtaggagaatctcttgaacccaggaggcagaggttgcagtgagccgagactgtgcctctgcactccagcctggacaacagagtgagattctgtctcaaaaaaaaaaaaaaaatgtaaatgtttgtttggtaaacgtatgcataactgactagtggtaagcatagaagataacggtttattcccctgttggatgttaatcaggtccatatttaacccatcattcttatcctaacatacctttattaaatagtctagaaaaacccatctcttcaaatattttcagaaccagttttaacatcttcttttcttattagtcatgaattgaataatatttttgagacattttatatttgcaagagaagtaaaaatgagtacaaagacaaataagccacaataagacaaatagccacaataagacaataagccacaataagacaaacacctttcccctgtgttcttgatagggaaaactgatacttatgcaactactaaccgcaaataaagagtagagttaagaggaaggtagaagcagtggagacaaaattgttataatacaaatttgacttgagatgaatcttgacagacgaaaaggttttcactaggcaaatagcaatttggaagggctttctcaaaagagacaaaaagtattataggtgacagagggagcacttaaactagatctgcttggctcctagacacatatttttttccatcatgctttgttctttttcatcctttgtggaagactttaatttctagtaatcatctttagcctctctggtcatgacatcccttatctaataaacaaagtcattatgctgaagatatataacatatttatgataactaaagtttcttcttattatgatatccattaattacacagtaataataattagcttttggttattaccttaagaacattaaaaaataatgcaaatacattcctaatgcacattttcttgtatttatgtatagatacacaatagaaaacccatttcttgtgacttgtaagtttgaatcagtttcttccccccctcaaaaaaaattcagtatgtataatagatgatgttcagttttaaatcattgtgccttttgaatttagttcaggtctaaaactagtagaaatagatacttatgttaataaaaaaattgttgttaaagggtggcatatcttctgcgtctctttacgcacccatcaaacctattctttttttaatctcttaaatttaaatctgtatattgggagactgatttatttttgtgaaggaacaaaagacagaggatggcagcaccatactgattttgccttgtttatgaaatgtcaccatgttacatgttgttcaccatcttatctagctatgaggtggttaggaagaatgatgtattaggttcatattaaattaacaacatgtcaagtttcttacttctatactcttggagcaacacttactttttcctcttgacacatatcaaaaatcttaattttccattcattatatggctatttggttaagagctgcctccctcaggaagactattgagtttcttcaggatagaagaatgactgaatgaccggcatgattatgcatacaaagagtgtttgaataaataaacaaattaataaatggatgactaataaatatattaaaatatcaagacatatgtgtatatataatttaaaatcaaaaaacaaaatatttgtaagtaattcagtctcttgtgttatctctctcactctatgtcccatggcattacatgacatgttttattttatattataaggtaaatgttctggagacttttagaagcccatcattttttttctatgcattctgttatttcagacaaaatgttaagtgttgacatttctcttacaagagatagttattaaaatctaaattctaaacactcctgttaaacttttaacatcaacctaattgcactgtcaatggtatatgtcttcctttaatcttactgagtctgttctttgcgcctggataccaattatcaatttgttttggccttcacgcatgctcttcctttctgaatgaatcaagactcacaacttcctaatattcaaaatacattgaggattttccaaatactttacttaattgttcactcattctatctttcatttgttcaacaccattataaaacacccaaaaagttgtttgtgatgttgtcctgaacattgtcaaggttctacagataaattagatacaatccttggtttatgaaacttataaactcgtagttacaataaagtaatcaaatatataataaaattaaaatggagtttctaaattatcaaattagtaggatatacttgcatgttttaattataataccattttcttctacaaatattgtactatatgtacatttcatatagctaatatgtaagtgtgaatgaaatgatacacttctaactttaaatttcctggggagatttgaatacacaatcaaagctctccaaaagcatcaaaatgagatgataatttttgtattgcttttaatgtaccttttatctttagtgtattaaatattttttgtgtctgtcaatgcacatctgtaacatcattttcaatggatggtcacatcatagacgttttaaagcaacccttgtctgttggaaattaatttccttttcaatttctcattattacaaaaaaaatactgtgattgacaatctagacaatgaagatattttaaaacatctaatctaaagtaatttatccaacaaatattggttgttcgcctactatgtgtacattctcctataaagctttgaagagttaaatctctttatactctctcttccttcaccctttccctctctgtctatccttatcccctgctctgtctatctctatctgtatttgtctgtctgtctatgtcagtgtctgtaatattgtggtgtagggacttgtaacatatatggaataagacaaatatttaggaaatggtggttgaatatgtctacatatcagtattttccctattttctttccttgcttccttccctccttccttattccttctttcttttgtatttttctttgcctttcttctatatttttcttaagtattttcattagtgttgttgctttaaatgtatattacacttataataaaattagttttcaaaattaggaaaagctcagatcttctgatgctttttaaatagaggaggagacagaacgtgcacataacacatttgtttactatgaatttgtaacatccatattccctacttttttagtggcttacaaattatactatttttaattaaaatttttaattaaaatgatagaatacctcccaagaacaatgttagactgaattctgacttcatgattatgttttgagatttttgatcattagataattttacaatttaaaatctagttaactaaattctcaggctgggcgtggtggctcaggcctgcaatctcagcactttgggaagccgaggtggtcagatcacttgaggtcaagagttcgagaacagcctggccaacatggtgaaacctcgcctctactgaaaatacaaaaattagtcgagcgtggtggtgggcgcctgtaatcccagctacttgggaggctgaggcaggagaatcacttgaactcaggaggtgcaggttgcaatgagccgagatcgtgccactgcactccatccatcctggatgacaaagtatccttcctgcctccctccctcccttccttccttcttttcttccttccttccttccgttcttccttccttccgtccctctttccttattccttctttccttattttctttgcctttcttctatatttttcttttgtattttcgtttttgttgttgctttaaatgtatattacacttataataaaattagttttcaaaattaggaaaagctcagatcttctgatgctttttggacaaaattggagacagaattgcacgtaacacatttgtttactttgaatttgttacatccaaattctgctaaaagactggagatattgtgtctatacatttggaagccaaatatgagatagcagagagtggtgaaatcacccttgaaatgagaattataaaactggaaacaagacctagttgtatctttactggctaggggatcttgggctgcttcagttagtgaaaagaacaccagtttggcatcacaatgcctgacttaacctgctggccccaatatatattcgttgtgtgacactagacaccatttaagtttgcttatcttcaatttcctcagtataaaagaagaaaaaatgattattatgttcataccgttaagttaaagttatataatatgtgtcacactgcaaataaagtatattaattatgtgcataaacccacttattactcactaaacaataaaaaaactaccaaaaaactaacgtttttattgcataaatataaatataaccttaagatttactgtgatcttgtacaagtgtatataaaatcaaacactagacatctcttttagagagttttatttttcagtgtctgtgcttatcttaaatgagtactatttagattataatttaagcagtatggatgtcagtggttgaagttcatttcattttatacattacataatgtgtcattaataggaagcacttattcttaactatgatttttcttgtctcttacgagaactcagaatttgaaaacctgtgaaagtaatctaaatattcttcccattgcaggaggcttttgtgcattactgctgggtgatggtctttcattgattctatgaacttgccaagcataggaattctgtttactgtttttctgcccaatatggtagtaaatcactccaagagttggtaaaatgactgcatattgggaagttctgtaccatcagttttttcagcaatcatctgagggatcaaaacagatctgattcaccagagactaccttaaaaaaccagaatggcagttgatttaaaattgaagatatatgtggcctaagatgcagaactatttgtcttcacagggcataaaccttctagtgggaaaatccattccatttatcaaattataggccagaagtttattttgcgagcaaagggatttgagggttttaaggggtatttctatgttctctagcaaagagagctcctttactctgaggatatttcttcctaaagaagtaggactcagtttctaagatctgtgcagtctttcccactatataatctgatacaaaaacgttactaatgtttgaatgtttcttaattgttgctacaagtttgctttttacatgaccatatttattagcctgttcacaggctgctaataaagacatatccgagactgggtaatttataaaggaaagaggttcaatggactcacagttccacatggctgggggaggcctcacaatcatggcagaagaggaaggaagaacaaaaggacatcttacaagagagtgtgtgcaggagatctgccctttataaaaccatcagatctcatgagacttattcactatcacaagaacagcatgggaaagacctgccccccatgattcaattacctcccaccgggtactcccactacacttgggaattatgggatctaccattcaagatgagatttgggtggggacacagccaaccatatcactacatgaatacactgaaacccacccaatccacccaatttatttccactacactacatcaaaagagatagtgtacaaaaggatgctggtttttgtggcctgccaaatttgaggcaaaatcatgacagtggttcatctgaccaccgtcttcttttcttggtaatgtactgaaacttcttaattctcaaaactaagagtaatttctgtaaatgagaaactgaaaatattacttgaaagagtttcaaggaagttggattctattcccagtttcatcgctgaggagcatatcactttagctttttgagtcctagttttcacttctgtaaaatgagaagacagagtgggttgaattctaaaatcagttgtagggctaagatgatgacttaccatgctacagtttggggtagtttcttattgatatgaataatattttgtgcattatttacattaaaaatttttattgttttcagaaccaaatgacctttttctctaaaaaaatacatatttttagatatttcttgctttatgggtcacaaaatgtagccacaataatcagaaaaggaccaatattgttgacaaagtgaacaactaagaaatgtaatacttgagccccagagctggcttttaacttaaatagtaaatttctaaattttgattactataaataatattatcactataattatcttccacaacagggaagaccacagtggctctgaagaactaaataaaacctagatatcacacatatttgagagaacaaaaattcacaataggaagctgtacaatatttgggaattcttttcacagtttaaactttctctgtcttcaaatatccctattacagcaaaatcccacctactcacaattgtacgtattcaaaatgggacctcagaacacaagcaggtggaaatcacaggtcatggccacagttgaaatgatatgtctttgctaatttaaaaacacactcttgtgatgagcagttttgcatatttaatataaatattacatcaaaaatagattgtgcttgctctgcaatgttgcccttataagccctggagggatgtgatcattttctgctgactctgctatatatgacggtttgtaaattaatactaaccttctcaatggtaaatgttggcccagccctacagtaattatgtaacgcagaaaacttgagcaatcagacatgtttcaatggtaaatattttgtctctccccacccccggtattatgtattaacgaatacattattacctgctcaagcattttctcttttctgtctcaatcagtattatggtccgtgatataattaaatgtttcattttgaacaaaaacatttattttattgctcaccaaggctgttcaattttagcctttggccatatgactttaatcagaagtatttgtgatttagagcactatagcatgtttatttttgcaatttattttaacagcccatgggaaaatgacagtaaatagcttgtaatttttgtaagtaataaaaaaatagctgtgacctatgattgaaggaaaaaaaaattcagggactttcctgtagaaatagactgtcatcgtttgaaaactcaacattttctaaattactatttatttttaatgatcaaaggcttcttacacattgtctcttccagtgattctcaaagtgttatacttagactactgcatgataataaattggaaaatgtctttaaaaaatagatttctttgccagacgcagtggctcacacctgtaattcaagcactttgagaggacgaggcaggagaatcacttgcgctcaggaattcgagaccagcctgggcaacaatatgagaccctgtctctgcaaaaaatacaaaaattagccaagcgtgctggcacatgcctatagtcctagctacttgagaggctgagacaggaggattgcttgagcccaggagacagaggttgcagagagctatgattgcaccactgcaccccagcctgagcaaaagagcaagaccctgtctccaataatagtagtagtaataataataatgatggatttgttggcactacccagaattattgaataagaaaattttgtgagcagaatctcaggctctgcattttgtataagcttaccagctaattcttttgaatatttaagtttgcattatcctattttaaaattctattttttcatataaactgcaatcatgagaaaatataggactttttccccaatctcacaagttaactgcagaatttgaatgagaattcagatctctttattcctaagacaatttctagagacaatacatactggatttcaatttatttttcatcctacacagttggtataaaattaattttataaataagaaccttttatattactaggataaaagtagcattctaacaatttttcatctttaggttggtgtctcacctacttatgtaaactttttctagcttaatcagtctaatatatcattctttttttttctgagacaaagttctaaactcatgacatccgatcacgtgttcccgtctcaaaattacttgttttgctctcatttgtgtatttcccatttgtattaatcaagatatactaggttatgctgcattaacaaatgaacatgccaaagtcacagtggcatagtgcagtcagtgaaagtttatttttcagccatactacatatccagcatggctcagcagggatctctgctccattctgatgctattagtgctattaagcaaatattactggtccggccccctctgacacatggtaaaattacacatgcatgctttttttgcaattacattgggcaattaattagttcttccagatatcctgtaagcagaagttgcaggcattgcactgcaacatttaattgctggtgtgagaacctccagacatcatctctctggcattacaattggtaacattgaaaatggtaactattccttcagtgtgcatctttgaggtaccataaggagcagagatttgcctcagattcacaagagatatattgtacaagagaaaaataaagttgtgttgttttgtcttctgagattgttagaattgtttgttaccttcgcataacattgactatctggactcagatatcctcagaaatatatatacagagagatccagcatggaagaggctgtgcttccttgtatctgcaatattttaaacatgtggcgtttttgtccccatgacatagaaaatgtctgaaaaagtttacacagctttttcattcctcaagctaacaataataggatatttttcctcacagcccgttatccagaactaatcacatgactccaacatactaaaagaagggtaataaatgcaatttttaattttgggagaggaaaagaagaacttgatattaataaaaactagtaatggggtagacttcattgaataaactttatatttttgttcatagaaaattttccctcatatataatttggaagtcaagaacaaatttgttgacttgggataatatcaagaagtcataatggaatatgcagatatatgtgcctgtaataaaataaagtcctaaaaagaaaaaataataaatagatttttaaagcatggtaaatatatttgcatattatgacagaggtcaacacccttactctattaaaaatatttacaaatcaatgtttaaataatggaaacgtaatcatataaaaccaggaaaaaaagtgaatagtcactcaaatcgtaatatgaatacccaaatctagtaaacctctgaaaaaaatgttcactgttattcttctcaaaaaatgaaaatttaaaaatcaagtatatattctgcctaccaattgtcaaaaacattttgaaatatattaatagcaagaggcagacttgaagggagcaaacttccctagaacatctataagtagttaggggatcaattttaaaacgtttatgaaaattaaaaatagaaaatatatcccagggaaacattcaaaaagtatacaaagatatatatttgagaatattcactgtagcagcattttcaaaactaaaaatttagaaatgtttgtaaataggagatagttcagtaaatcatggtacagaaagacagtggaattctgttacagatagaaagcaaaataaacacaggactttcagttaggagcatgttgggtatatgtgagaaaaaaatgtcagtgaggtcatgacatacttggctagagagagaaaaatgagaggttcggtgatgaaggttaaatcatagatggtttgtaggccaacataagaacttagagcttcactcaaatttgagcctttttgatgaatttgaccaaaagagtaaaattacttggatgaccacttgtaaggatctctctacctattttgtggtgaattgattaaaatgaaaataatataagcagggagaccaggtagatgactatttcctgaagcaaaataagagatgttggtaacttgggataggataatagtaatgaaaaatatggaataattttaaggttaaaaaattaagatttgctgatggactagatacagtgagtgagagaaggaaaggtattaaaaagtaatccaagtctaccttgatcaagtgaaaggctgcattgaaaagacagaaagaagtaggtttatgagaaaatcaaaaatttacttcggagcatattaaagttgagttgcctattttgcatcaaatggagatgtaaatgaagcagttgggtatacaaacgtgagtgaagagatacattttagaagcatcagtgcataaattttattaaaggctttttaaagtaatgaccttgaaagatcatctatagtgagtaagtagacagagacagaaggcatctatggatcaagtcctggagtaatccaataggtagagcttgcaagatgaggcagagctagctagtaatagagaaaagaagtaatttttgagattcaaaaaaaaaaaaaaaaatgaaagagtggcatccagaagccaagtgaaggtatttaaagggggattttaatcaactctatcaaatacaatttatagtcaaataagatggctgaaaattgacaacatgagttggcagtatgactattattggtagcatttgtatgaacgtctcatgatggaaaatgaaagtctaattgaaatgactttgagacaatggaagaaaaggacacaaaaagagtgagacgattttctgtatgcaagcagaggctgaatagtagacagcagggtatatgagatgaaggtaggtttttatatgatagatattatagcttgcttatatgctgatgacaaaaatccagtaaagtaggaaaattaaggttacataaaatagaaaaaatagtaaccaggagagggtgagacaagggctcttgtttgtttatttcaactgaggagtcaaatttctttcatttttaagaataagtacagcattgtacttcaagagcaaaaaataaagagcaaggtaccatggtgaagaaaggtggggcaggagggggaaagaaggtgaaagataatttataccattttttgctaataatttttatattatctaatttagtctttatttttactttttgaacagaattttttaaaaacagttttagagtgacagaaaaattgggcagaaagtacagagaatttttgtatgcttcccgctcccacacacatagcatcttcctctatcaatattttgcaccagagtgacacattttttacaattaaaaacctacattaacacgtcaatgttactcaaagtctatagcttacattagggtacactcttggtgtcatacattctatgggttttgacaaatgtataatggcatgtatctataaataaatttttattatcaaagtatcataaataataactatgataaaaatattttatcataaagtatcataaataataattttattaccctaaaaatcctctgtgctctagtcatccctccatccccacccaatgcctgaaaaccattgattgtcttattgtcctgcaattttttctataattttattgtggtataataaacaacataaaattcgctttcttaacaattttaagtttacagttcggtggtattaaatatactcataatgttgtgcaacattcaccaccgttcatctctataattcttttcctcttttaaaacttaaattctgttatacacactaaacaataattttctatgcactcatcctgaagcccctcaccaacactattctaatttctgtctctatgattttgactgctatcagtatacttcttataagcaaaacctatagtatcattctttatatgactggattatttcacatagcaaaatgcccttaagatgtatccaagttttagcatgtatcagaattttctccttttttaaatgctaaataacattccattatacccatacatcacattttctttgggtttaggtatatctctcatagacagaccatgtgtttttaactattctgtcaatctctgtttttacattccatttacatttaaagtaattactgaaacgaggaggggcttctgtgtttttgctctttgttttctatatacgttatagctgttttgttcctcatttccagaattattgtcttacattgtgtttagctgatttcttacagcgaaatatttaaaatcctttcttatttccttttatgtatattatatccctattttccttgtggttaccatgggaattacatttaacggcctaaagttataacactctcattttgtttatgccgacttaagtaacataggaaaccctttaccacttaatggccctgttgccactccttttggttgttgatgtgacaaaattacatctttatacatccggtgccccaaaacataaactgataattcttttaaatacattggtctcttaaaatatgtggaaaacaaaatgttgtgttacaaaccaaagttacaattattctagcttttagattaataactgtttatttttaaatgtagtagtctcttaaatcatgtagaaaacaaaaagtaaagttacaacttactgttgtaagtaaagttacaaattattgttgttacaataatactagcttttgtaattgcccatgtatttacctttatagaggtatttatctcttcacatgactttgaattactgtctactctcctttcatttcaccctatggaacccacttaagcatatcttgcaaagtaggtctagtggaaacaaattccctcagattttatctgggaatctcagtttcaccctcacttttgaaggatggttttgtcagatttagaattcttcgctaacaatttgaaaatattttttcagcacattaagtatcttggtccactaacttctgccctacaaagtttctgatgagaaataagtggataatgttactgaggattccttgtgtataagtcacttctctgttgctacttgaaagattttctccttgtttttggcttttaaaagtttgattttaatgtgtctatgtgtgggtctctttatttttattctctttgaagtttgagattcttggatacttacattcatatgagaagttttcagcaattatttcttcaaataatttctctttctgtctctcttgctcgctcactcactctctctgtcttctgggacttctacaatgcatatgttaatttatttgttggtttcccagatatcatttaggttctgttcatatttattcaatatttttgttcctgtttttcagaatcaatatttattgttgtatcttcaagtttgctgattttttcttttgcttacacaaatttgcctttgaatccctctgtaaattttccatttcaaatactgtacttttcagctccagaactttaggttcagaatttctttttttctatctctttattgataattacattttgctgttaggtagttttcttgactttatctatatcttcctttagttctatatcttccttaacatctttaagatggacattttgaagttttgtctatggatctgccatcaagtctttttgggtatagtgtcggttgatttttttttcctttgaaaggccatgctttcttgtttctttgtgtgttttgtgttgttgtaaaaaatggatacttgaatctaataatgtggtaaccctggtaatctgacccttcccccttcctcagagtttgtcagtttttgatattctttttatttatcgttttgctttttgtattgttgtaggctatctctcattctgggatcagcctgaggtaaaataataaattcttgtcaagtcttttctgaatctatgccttttccttaacatgcacagtcactttttaatgttccccaatatatacaattgcttttaaatatatcagtgtttaatgcctggctctcaaaagagaaaaaagaaaaaaaaattaaaaaattagttggagaagcactggaaagtcacttcagccagaggtaaaggggctttcaacaatggcgagacgtgaaaaatcaatggcagctcgtggcttgtctgcacctctctgataagaagcagctgtcagaagaacaaccccaaatatctggaggacagagtcctttgtgctcaccctggctccttacagttctgtccagtctgcttcaggaacatatgcatagctgtctaccacagcgatgtatgcggagaatgggtagcaggtgctgtactgagtgctaaacttgatggaagttaactgcaattttccatcccagcattcccctggaagttgcaaactttcaatagactccagggttccaaagagttacatcagacagattctgccagtgctattgttatctaggtggggagacagattcctggtgcttcctacgccaccactttttcagaatcctctggaatgaactcctttgcagaagcaaagaagttggtctttgttgagactacagacaaataatccataatagtagtactggttatagagtgtatgggttacagttactgacaaattttgagaagttgttattgatgctaatggagtactcttctacctgattctatttcctcagtaaaatgagaagcagttttttagctgaggatgagaagagggtttgaaacagaaagaaaaacagagattgaaaaaggagttgaggatttatgcaaatgagaaattatattgttgaaccttggaacagcaaaagtcactaggatcaatagataataggtcctgtgaggttgaaagatcactgaagctggatagataagaaacgaagactgaaaaatggaatacttgaaattaagattatgaagcagatgcagttattgacagtaaaacatctaggttatggtcatgagagtgggtgactaagacagcatgggaggcaaaattatgaaaggacagaaggaccaggaaatgagacaacaggattctaaaatggctgcacatatttttaaaatcaccaagaattataacagaagttggggttgagagagtaacagtaggcccatgtgctataaccctcaacaatgtggaagagaaaacccaagggggtgccactgagtaaaacaaggaagggaggcagttgtagaatgtgatgacatgagctacaaaagggcatttgtagggagctgcaagaaatcatggcctgaaaggagcattgaaaagcaaagagactatattccacgttcaggaccagggaatgggagaaaaaaattcacaacttagagagggtcacaggcaaagccacgtcttcggggaagagctattattcaatcacagctaagtcgttagagggatgttcagaaaaacaaacaaacaaaaaacagaaaatatgagctaacttattggaactatgaattctacagggcagagcaagaacagaacagctttaggagtcaaggagagtgggaggtggggtcagactgaggttgtcagtgccatatggggaaaagggccctgcaacaactaacataaacagagatgtgggacatgattacatgagctctgatagtctgtgagacagagtgtggtagactggcaaatgtgtgttggaggggagggatggtggtgttactaggagcacacaatgatctggactgtcctcttttcactcttctctaggtttgtgaggaagctttggaaagggacagaatcagaactgtgggcatatccataccagaatattagcagtaaatatcccggcatggtggcattatgcatgacactgattttctcattttttatttagtatttttaagtacaattgtcctgctgtgtcagtagtgggttcttcatccatggattcaaccaaccgtgaatagaaaacattcggaaaaataatgccactgtactgaacacgtaccacacttttaaaattcctgtaattttctaaccaatacagtgtaacaactatttacataaaatctacattgtatcaggcgttataagtaatctagagaagacttaaagtatatggaagattgtttgtagtttatatgcaaatactacgctcttttatgtaagggacttgaacatccatggactctggtatctgtgggggtcctggaatcaatccctcacagatatctgtatttattttaagtgaatgtgtattatggaatataaatataaatatatgtatatgcacacacacacatatatatacacaatatatacacacatatatatacacaatataagtgtatatatatgtgtgtgtgttgtcatttttcaacttaagtttaaaaaattgcctagaagggataaaacaaaaatagagctccagatatctaatgttcttttcagaaagaaatctttatatctctgttttacttcagctgtattttttaaactacttggctaaagtaaacccacgttcatagagaaaatcactattattttgcataaagttgtgaagtctaaggctgaatagagtctaacaatcatatttattgatgtgtctgttgttaaacactgagcagatgtctccattagagcctctataatgatgtctagatcattttagggagatttttactaatttcaagctacatagtgattccttccacatcaaatttttacttcttagatatttcttgtatttcttatcccctaatatggagactattaggctctcattatttctttcccactcctcagggttatcaggaggattataagcatgagctctggaattagacttctagtgtttgaatcccattgatgtctaaaagatatggcctttgccctcataatttgcaatgtaatcattgaagagaggcaggtacatcagtttctacaacacaatgtagacagaagtaagtatcataaaaataatattggctgaattggtagaaaatatcatggagggaatggcttttgagtggggattgaataaacagagtgttttaggaataaaaatggtgttaggaagaaaagttcaagcaaagaataattttagtgaaggtataaaaatgatgaactgctctcatcttcaggggagggtctagaaggatgggagtaaatattgagtaggggaaaattgagagatgtggttaaaaataccttgtttggacatgaatactagcctaataattctgatttgctttactatccatttgactttatggatcattaaaaaattttagtataaatgctgatcgctggtatatatctctctaagcttgtttctgcacatgagagcaatcaggaaaacattttcaatcaatcacttattttactagctggtgccaggcaaatggctttcctgattttttttcaatctttaaaattgacttaacgactatttttttaagttaattgggtggttcagggtaagtttaaatgcaaacaaaacacttagcataggagagcgagtgcgtaaattcacagtgggagcaaacatcagggcaacaaaaaaattagagccatttttgagtcattgaccacccacatttgagagttttttcctggatgaacattccttctgcctttggaaataaattaatgttttagagcaggggttagcacactttttccatagagaaccagatagtaaatattttgggccttgctggataaatagtctctgtcacaggacttgtctctacttttatagggtgaaaacacctgtagacaatgtgtaaatgagtgggcatggttgtcttccatctaaacattatttacatagtgggtagtagatcatatctgagccacagtcatagctggctgaccctgtcttagaaaattattgggaacaggtgtgtaaaaagttgaagtaaacaaatgcaatattaagatactatcacataatgatgaatgttcaccaaatgttttctttgaatatcaatgcaaacctggcctgactttgatagtgatacttccaactaagggcggaatccatagtcagcaaaaattattattttttgtatgtcttttgctgttacagagcagaggaaacaattaattcaacttagattaaagaaaggcatagtttaataataaatagacctcacagaaacacaagcccagaaactaacatagagctgggtatcatgagatataaaaatgggagtaaaaatttaggacagtaccaggtacttatttcagcccatgggcaatcttatttttcttttagaaaaaaatcttttaaggctgggtagttggcttatgtctataatcccaaggcgggaggattgcttgaacccagtggttatcagcctgggcaacatggtgagaccttgtctccacaaaaatataaaaaattagctgcgtgtggtggtgcatgcctgcagttccagctactgggaagactgaggtgggaggattgcttgagcttgggagtcaaggctgcaatgagccatgatcgcaccactgcactccagcctaggcaacagagtgagaccctgtctcaaaacaaaacaaaacaaaaagaaaaaccctgtaagattaatgttgatattatccccatcttacaaataagaaaactgagtcacagaccactgctaaagaagtttctcttggccacagcttagaaaatattagagccagattttttatccagccagttcacctcaggagccagtaatcttagacgttgaccaactggtttaagtcaatttgctctttgaagtttgagctaaactgtgaaaacaactaggatttatctaatcatagtagctaacatctgtgaatcaatatatgccagggctttatacaaatcagctcctttaatcttcacaaccctacttaatggacgaaaaaaagagacactgtcaccgaaagtgatataaatgcaattggtagagccaggactctatcctggtgagtctgcccttagagagtataaacttaatctttagggcaagcaaaataatgttaaaaaacataatatatgatgtgcagagaccaggctgctgaaatcagcaagagactgatttgctaggcaaggtggttcccagattatggaaccagtgaaggaggataattttttaatataggaagcaactgagaaccactgtagagttgtcagtcaggaaggtttgcttgatagcagtaaacactggagactgtaagggagtttgaaaaatgagggatccaaaagcaatcatgagttttgtgttatcctgcagaagagtgagagtagtaagaaactgagaagagagaattacttggagacatatttcaaaggaaaatattatttgacactgacaggtcacagaagataaagcaaaaaatagtcaagattaattcacatgcttagcctgggataccctgacaaatgatgttatcacagacaaactgaataagtttagttaaagaagccagtttgaattaaaagtaagtttggttaaattcactcgtaaatttaaagagatatgccattttggcaattacaaatctagagatggagtacagttcatagagcataaagagtgagaaaagccattcagtttagaggtgagaacaccatcagttacgtatgtctacaagagtaaattcaacagagtggtgtgaattgaaggtcatttggtggggatgaaataggttaacaatttgaaaccataacataatgagtttgcatggagtaataatgctcatgttagatttcaaggaattaataaaaacggcaaatggaaatacagttagcaggaacctagatcatgtagcacacatttcagaacctgtccataacagaaggaaactgcagtggtgactctaggacaaataggtagttttcctttcttttttaaagttggtgaagacctagtttttccttattgtatatttagttttcctcctatagctccaaggtaaaatatataagtgctatttgtttcctagcaatatttttcccagaagcagaatgataagttgtagaagagatatattttaattatttattgaaaatgtaaactgcttcaagcaatataacaccataaataaaaatggctaattttgaaagcatgagagtgtacacaagtctgataatttcaattctccatcaactcaaagaggcatcatgggagcattttatataatcttcactctccttgtcacaaattcaccctgagggaaactaatcttgatggagaagtctgactgtcttgggtagggaaaaatgcatatgtgagtattctcatgatgaaatttaaactatgattttggtgaaatatttgaaatgtaactaaaaatatagctttctccaaattgctacaatatagtttttaattatgttatctttctccttttttaaatctgtggatctattttcaagctattccaatagctaacattttcatttttaccccctactcataaggtaccactgtttgccgattatcatgtaagatttaattttattgatcattgcttataatgtgtgcctagagacagagaacaagcttccctatccaatttctattttcccttcaggttaataggtttccctttcccaatcattgagtattgcacataagaacaaggagaaaaatgtttgttgaggtatatttagaaaagaaaaagaaggaaaatcctcatttagtagtgatcttgtgtttttctctagttcattagaaaatcagccaatgtatgaagactaagctttaattaatgaagttgtcctatattataagagggttccaggatgtatcttacatgcaaatgttttcatctttttaaggtaattctattaatatacctgctgtgccctaagggtcctagtctgagtacatttatccctttagcaagatttgggggtggaggccatttgtattctcttctattcatgttggactttagttggtgattagacacagtagacaatgtcatgtagggttagatattcatgtatggcttagatgcaggtagattttacctccacaatcatatgaacattgagtgtgtctcattggatttctgtaagaatgacatgaagtgaagaatttaaacttcttgacaaattacatgacacagaaaccactccataagtgttagataatcttttgtacgtgaatgggaaataataatatatattcatattttcatgttttggcctaaaggaaatctagatattaaatactagatcctggtgggaagattatttttttttcagggtggaaactgagcagatggaggacaaggatggggaagatttttctatacttttgttatgtttttggactttaatccgtatgactgtattatatatttgaaaaggcaaatataaaagtcatctgagctttttgtcatcataatggtatcctttctgacaatcgttgcttttaatcctaaaatgtctcatcaagtgcctttgtctcacaatttatctgtagaacatatatgcttgtgtgtggaatgagggctactcagactgtgaactcagaacaggcaaaatgtaaatgctcatttaattgctgttttgtagatctaaccaatttctatgactgtgtgaaagtggttaatgaggtttttctttctctttatcagatgatagtccaccttctaagataaaccttctctgtgttgaagtcaggcttagataaggaataagttattaataatcatgaaatctaataattaatagctttattagaagactagggagaactgatttactactaatagtaattattcttaattacagctaacctttgttggagtgtacagtgcaaagcactttaaatgtattatttgatttccctagcaaccctatgtggtacatggtagacggtagatgctagattaataaaatgacaaataaccacttggaaaatttgtctaaaatcatgtggctggtaaatggtctcagagccaagcctttttaatgccaaaactttttaatccctatgctctagaccatcacactgctgtatgtaagcagctttcaattatgtagtttaagaaatttttatttagcaactatttctggagtaattagtgattgttccattttgtagggaactggggttgccaagtcgacagatattgggctcataattcatatcatgcattgacagcatgtatgcaattaaccatctcaagtggtagcactgtcacgacaaactgcctgttcagtctcatgcatttctgtagtattgtaatccaaagatagtggggtctcatagaataaaatcaaatatattatccatgatctgaactatcagatattatccatatctgaacaatccatgaaaacatttattgttttcctcaatatcactcaaaatagattttagccctcttataaagagtttaaacagcaatgataacagtaacaaaaatggctttttattttctggctaaattatactttacctatattcatggttgtttacaattaaaaatgatcattctcaatagaatgcatacacatggtcaaaagctgtatccacatattaccaaaagaaactggtgattttattttttaaaaaagtaacattcaaagtcgttttgttacaggaagaaaaaaatgtctatgaaagctggatattttacttttcatttatttttgttgtatcatgtgaagagagctggagattctctgtttcataattttaatatatggattaaattggattattcagaaaaattctacttatgacacttctctgtactgttttattacttgcagctacgtaactctaatcctaatagaacccctgttattcatgacgctatgtaagctttgttgcattattcatgtttactttatttaaatttgtgtctgtgaactgtttgatttgtgaggctctcaggaaactgtcatcaacagaaatgacaagaccaagcttgtaaattacattttttatatgtgctaaagtctagacttctatgttttgctaaagaaatcaccctattaaaaataataacatgtatccttaaagcagagtgtctatgatttataggagcaataggcttgctcggaagtggggtgcctgcagtatctttaccctgtttacttgttccaggtgcctattgacttctcacattgttgccactataacgcggatacaagctgaaactcacaattgttatgttttgaaacttgctaaggtaatgtttttctcttgccctaaatatttgaagatatatttgaatagatcagtgtcttttcacccatttttaaagcacacattgtcttgtgcttctctttttaataggatggagatgagtgagacttgttttcccatttttgacatgcttgagcaagaaaacaaagctttccaccatcccccaaatggaaaaactgcactatgctagatgggttttgaaaaataaaaacacaaatcaaaaccttctaacagcacatctgttcttctttacaggaattagacgatataagctgcagctcagaatcagaggtaagcattacatttaatctgtcatgcctgcaggtttttatgaagttcaaacattttaaaaggttcagcttgataaaactccctcattatgtttcttgaggttagtcctgtcatctttgtccagtgtctcactaacaacatttccagttcagtaagagcagacattgctcattgcattttatttgatctcaggctatttaatactataagatgttgtgtgcacaccattcctttgggattttaaaccattaggttaaaggtacatccaattatgtgatatctttaagcaacttgaaggtgcagttttatatatagaaatttaccactgaacgatactgaaatgaagttaaggttgtgaaacacactgacaaaagatagggaatccaaagttaggaatgacattttgtccttcccttgtgctatactgaaaatgaaggaagttgagttgagtacaagataaactcaaggacactgaggattttactttttaaaatgtccttatagatgcatcatacacaaggtaacaataatagctgtacttatggaatagccgggagtttaaaacaccctttcactgatacgattgtactggaaccttaaaacagtcctattcacataagaaatcggtgattttagtctgttttccccaatgagaacacagagaatctacaagtaattataattttttttttacaattgcaaaagcagtaagaaatgtagcagcatgtcagagcctgttcttcagacatcaaggttggtactgtctgtactacacagtctcactgctgcctataagtatatatgcgtgcacctatcaacacacttatgtacaaacacacataccagtggatagtgagaggaagaacaaaagaaccagagaccaagtaatatgtatttgctggataaattaagctgttctctctttcatgcaattcaattcaaactgctttaaacattaaaagaaatgtattggctgatgaaaacataaaagtccagagtcactgttcttgtgagtttcctagatttgtcctcaagtgtgccagatttactgtgggcatgccttgtgcttgcaaaaggtcaatggcagtttcgggaaatctgtgacccagagttcacagcataaatcctgagtttccaataggttgaaatagccatgaaaccatcctgtagccaagcgtaaagcacatagacttggattagcttcagtggtcatcatggtaagggggaatggaatatcctgtttgcattgaacagatatacttccccattatagagaaattgtctatctcatatgactacaaggatgttctgcaatggggaatagtatattaattctatgcacacaacctcaatatgtactataactctgttttagtatgtaactactctgtgctaggtatgtagaattctcattatttgactttaggtataaagggatacataagtgtactcctaaatatgtgtaagatcatacttatgttctgataaataaatccatcaattcatttttatttcattcagtttaatttttatttgtacacattttcatgtatggggtacctgtgaatttttatttgtacacattgtcgtgtggggttcatgtgaattttcttacatgtgtatagtgtgtagtaaacaagtcagaatatttagggcgtccatcgtctgaatacattttgttaactataatctaccctgctatcaaacattgaatcaatcccatctaactgcatgtttataccctttaactcatttctctttatactcccccttcccccaactcactcctcccaatctctattatctttctttccactctctacctccatgtgatcaaatattttcactccagcatataagtgagaacatacaatatttgcctttttgtgcctggcttagttcactaaagataatgacctccagttccatcaatgttatgtcaaatggcatgttttctttctttttatggacaaatagtattccattgtgtatataccacattttctttaaacattcattcactgatggacacttatctttgttatctacctttgttattataaatagtgccataataaacatgcaaatacaggtattcctgtggtatactgatttcctttgggtagatatcagtaataggattgctggatcaaatgatagttccatttttagtgttttgaggtatttccatcctgttttgtatagtggtttactagtttacatacctaccaactgtgtatgggtgctcccttttctctgcatccttgccaacattcattattttttgtctttataataatggccactttgattggggtaagatgatacctccttgtggttttgatttgaatttatctgattagtgacactgagaatttttcatataactcttggccatgggcatgtcttcttttgagaaatatgtattcatgtcctttgcacactttttttcttttttcttttttgagacagaatttctttcttgttgcccaggctggagtgcaatggcgcgatcttggctcactgcatcctctgcctcccaggttcaagcgtttctcctgtctcagtctcctgagtagctgagattacaggcacatgccgccacacccagctaatttttgtatttttagtagagatgggtttcatctttttttttctgtcgagttgcttgatttccctgtatattctggatattggtctgctgtcatgtgtttagtttgcaaagattttctcccattcaataggtttcttcacactgttcattatttcttttgttgtgcagaagctctttagtttaagtctcatttgtccatttttgtttttgttgtctctgctttggaaatcttagtcataaattctttgcctagaccaatgcccaagagagatttccctaggttttcttccagtatttttatagttttgggtcttacatttaagtttttaatccatttttgttgatttttgtatatggttagagatagggatctagtttctttcttctgcatgtggctatccagttctcccagcaccatttattcaagaaggtgtccttcccccaatataaattcttgtcagctttgttcaagatcagttggctgtaaatatgtgactgtgtttctgggttctctattttgttccagtgggatatatgtctatttttaaaccaataccatgtgttttggttagtatagctttgtaatatattttaaagtcaggtaatgtgatgccttcagcattgttccttttgttcaggattacttggttatgcaggcttttatttcactctatatgaattttagaactttgtacaaaaattctgtgaagaatgatggtattttgatagggattgcataatctgtggtttttttgggaaatatggtcattttcgtgatattcttctgatctttgaggatgggattttttcatttttgttctcttctatttatttaatcaatgttttgtaattttccttgtagagatcttaaatttagtcctaggggctttaatttttatagctattataaaagtcattggcttcctgatttctttttcagatagatgactattggtatatagaaatgctactttttttttttttttttttttttttttgagaagaactctcgctctgtcacctaggctggagtgcagtggcgcgatctcggctcactgcaagctccacctcctgggttcccgccattctcctgcctcagcctcccgagtagctgggactacaggtgcccgccaccacgcccggctaattttttgtatttttagtagagacagggtttcaccatgtttgcaaggatggtctagatctcctgacctcaggatccacccgcctcggcctcccaaagtgctgggattacaggtgtgagccaccacgtccggccgaaatgctactgatttctgtatattgattttgtattctgcaaacttactgaatccatttatcaaatctaagagctttttggtagagttgttaggttgttctcaataaaagatcatattattagcaaagaggaacaatttgaattcttcttttccaatttggattccttttacttatttttcttgcctgattggctaggacttctaatactacgttgaataggcatggtgaaagtgggcacccttatcttgttccatttgttagaggaaaggctttcaacgtttcccattcagtttgatgttagctgtgggtttgtcatatatggcctttattattgtgaggtgtttttttctatgtttagtttttgagagtttttatcctgaaggattgttgaattttatcaaatgcttgctctttgtctattgagattatcatatttttttcttcattctgttgatgtgatgtattacatttattgatttgcatatgttgaaccatccttgcatccctgggataaatctcactcaattgtgttatcttatctttttaatatgttgttggattttgtttgcttatattttgttgaggaatttttgtgcatgttcatcagtaatattagtctatagttttcttttgttgttgctgtgtctttgtctggttttaatatcagggtgatgctgctctcatagaatgagttagagggattccctcctcttcaagggggaattttttggaatagtttcaggaagattggtattaattctttgtaaatttggtggaatttggcagtgaaaccatctggtgctgggattttctttgttagaagattgtttattcctaattcaaccctgctacttgttattggtctgttcaggttttctgtttcttctcgattctatcttggtaggttgtgtatttccaatactttatctatttcctctcggttttccagtttgccaaagtatagttgttcataatagtctctgatgatctctttatttctgtagcatcagctgtaatgtctcctttatcatttctgattttgtttatttgagccctctctcagctttattagtttagctagcagtttatctattttgtctatcttttcaaagaatccacttatcattttgttgattcttttaaaaatatttatttcttataaataagttttattttctattcagtgggtacatgtacaggtttgttacataggtatattgcatgatgctgaagtttggggtacgattgatcccataactcaggtagtgagcatactactcaacaatgtgtttttcagccttctctctcccccttcatccctccctctagtagtctccagtatctatttttgtcatctttgtgccctgagtatccagtgtttagctcccacttatagtgagagcatgcagcatttggttttctgtttccatgttaactcacttaggataatggcctccagctgcatctgtgatactgcaaatgacatgattttattctttgtgatggctgtgtagtgtttcatggtgtatatgcataccatttcatttatccagttcaccattgatgggcacctaagttgagtccatgtctttgctattgtgattagtgttgcaataaacatgtgaatgcatgtgtcttattagtaaaatgattcattttcttttggaaatatacccagtaatagaatgggtggccaaatggtaattctgttttaagttctttgataaatctccaaactgctttccataatagctgacctaattgacattcccaccaaaaatgtctaagcattcccttttttctgcagccttgccagcacctgttgttttctgacctttaaataatagccattctgactggtgtgagatgttatcttattgtggttttaatttgcatttttcttatgattagtgttactgaacatattttcatatgtttgtttgcttcttatatgtcttcttttgaggagtgtgttttcatgtctttagtgctatgtgcctacttcaaaatgttagatctcaaaataacatatctgaatgtctaaatttcttgccaaacttgggctattttcatctattattttgttaaattgattttataattcttttattttctcttcattctgagaggtaccaataattcaaatatttggtcactttatgtcataccaaatcacaaaggatttcctcattcttttttattctttctgccttatttttttgtctagctggattatttcagaagaactgtcttcaagttctgaaattctttctgctcttaatctagtctactgttgaagtttttgattttttatatatattttttattttttttattttttatttattaatttttttttttgagatggagtctcactctgacacccaggctggagttcagtggcccaatctcagctcactgcaacctccatctcccgggttctagcaattctcctgcctcagcctcctgagtagctgggattacaagcacgcgccaccacacccagctaattttcgtatttttagtagggatggggtttcgccatattgcccaggctggtctcgaactcctgacctcaagtgatccatctgcctcggcctcccaaagtgctgggattacaggtgtgagcccctgcacccaacctatattttgtatttctttcaatgaattcttcaattccatatttttatttggttcttttcaaaaatatctatctctttagtgaatttctcattaatattatgaacggattttctgatttcttcacataatttttcagatttttttttctcactgagcttatttaaaatcagcattgtgattttttaatttggagtttgaaaaatttatttttgattaaagtgtattgctaaagaattattgtttatttagaattgtcatatttccttgctttttcatgtttcctatttgcttatgttgatatctgcacatcagatgtatcagtcacctttttctatttttgaatttactttgtagaggagtactttttttctgtattcatggtacggtgagtaggacaccttggctttgattctggctatgtgcaatactgtagtctctgtatgatttctttggcagtaaacagtgttacttctacctgtgatttcctcttaagttgtgattattagtggaggctgtggtgaagttgtgctagggactgggatgttaggtaggtcagtcttcaggcctcagtggtaacaaaggtgggttgagcatgccccaatgccattagcattgtaccccaaggcagtttacactagcccccatgttggcgattactggagagccaaatttcgagcctatgtgtggcttgcttgaatgctggtagtggcaggcagtggtggatcaggtaggtgggtgggttctcaggccactgggcagccagtgtgccatgggcagtggctcattcacagctcacaatctattctaagtagtgacactgtgagtttccctaacacctcactccaagcactgctaagccccaggacactgtgcagtcatccaagtgctaggtaagaaaatggtgccttgctctagccacttagatgtcagaaagggtgtaggacccagcatgagcgccctccctgggttagcttcattctacgatcccctgacagcttcttgtgttagtttcagggcttagagggctagagggactttcccatggctaagattggatgattccactgtgggaatataagctgctagaagcctctcacttacccattctagcatggagaactcactcctggctcccacccaattcctgcccctagacaaccccagccaagcaggctgcctttcttctttctctttccttgcttttcatattttctctcacttttttaagagaaaagagagagttttctctcttgaataatgtgttttaattgtgcttatccgtatactatttcagttcttctaagtagaagtgagcctaaaatgcttctagtcagccatcttgaagcctttcctcaaggcagtttttaaaaattcagtttatttctacttttcagtttccattatccttactctaacaaagccaaattttaatgcattggatagatatcttttattgatgtgtgtttcatagatttgttttattgttttgtgtgcaaaatagtggttgcctaagtcgtattgtgttatctaaagaaacaaatatgttttcttggtattcctatattggcacggaaacatctagtttatttcttcctattgttgtgtggttctacagggtgagaatatactgcaatttacttaatcactttcttattaatggataacaatttggcttccagcttcccacccaccacaaatatcattgcaatatatttctgccaacatcttcttaaaaagttgtatgagtatatatttggcttatacacctgaaaccagaatgagaatgagtttgaatgtgttatttacatacttgtttagatactgatgaatggctctccaaaatgtctctacactcccctctagaaatacatgaggcttgtttatcttcatcatctaccaaactcagcattattcagtggcttccaaaaactctaaatgctgaaaatacttaccaatttgtatgttttataaaggggtttaatacaagtaagtacttggtttaaaaaaatcagtggatgggatgcaaaagcaagtctagactgggcctctaagaattatgtcagaaaaaaataatcaaatatcttctaaagagagtttcaaccttgagaccaccatggaacttttgagcttaacaacatatgatgcagctgctaagttaaggaaactacaactagaaaggagctctcactatcactacagatacaaatacgtcttggtatctcctaagtgacactcagaatgctggagaatcaatcatcactgcaggagtagctcagatctctggactgatttctgctagcagaaaatagcaaaaaaggcaagaagaaggtctttgtcattttctatttaccaattttatgagcattcacctaacatacaatttgtttctagaatcttagctgcaaaggagtatggggaaaataggggttttctggcctctataatgcaaaaaagcacattaaaaccatgtatgaaaaggattttgaaagagccaattcatagcatccaccatgccaactttctaatggttggcagtctaatgtgtgaaaatgactttgtgccttctgtctattctttttagaactgggatttccatttctataaaatacatattttttaaactttctggttgtaatcttgattatttttgttggtttgattacagattctagataatagacaccttgccattttgtacaatagaaatattcctcataacattttatgcctgttgacataattttttaatttacagaaatacttatttagtgtgataaaatgtgttattgttccacagatatcctgtaatttgagttttgtttaacaaggcctttcttattcctaggccgtaaggatgaattgtcttttaataaatttataaatgtaataatgttttaaaaaattaatgcccttaatttatctaaaaaccattgtgtgtattttgataggtagagatatccttatccttgttttccccttttaagtaagctggtttttcagcaccatttacctaacaattattcattctccgttaaattgttttacacctttattgaatctcacgttcctgaatgtgtgcatgtgtgtgtatacatgagtgcacatgtgtttggggtgtttattttgatcctttaatgtatcttttgcattacatcaatgtcatccttttttttattattatactttaagttttagggtacatgtgcacaatgtgcaggttagttacatgtgtatacatgtgccatgatggtgtgctgcacccattaactcgtcatttagcattaggtatatctcctaaagctatccctcccccctccccccaccccacaacagtccccagagtgtggtgttccccttcctgtgtccttgtgttctcattgttcagttcccacctatgagtgagaatatgcggtgtttggttttttgttcttaaaatagtttactgagaatgatgatttccaatttcatccatgtccctacaaaggacatgaactcttcattttttatggctgcatagtattccatggtgtatatgtgccacattttcttaatccagtctatcgttgttggacatttgggttggttccaagtctttgctattgtgaataacgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgacggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttctgttgccattgcttttggtgttttagacatgaagtccttgcccatgcctatgtcctgaattaccatgcctagtttttcttctagggtttttatggttttaggtctaacgtttaagtctttaatccaacttgaattaatttttgtataaggtgtaaggaagggatccagtttcagctttctacatgtggctagccagttttcccagcaccatttattaaatagggaatcctttccccattgcttgtttttctcaggtttgtcaaagatcagatagttgtagatatgcggcattatttctgagtgctctgttctgtttcattggcctatatctctgttttggtaccagtaccatgctgttttggttactgtagccttgtagtatagtttgaagtcaggtagcatgatgcctccagctttgttcttttggcttaggattgacttggctatgtgggctctttttggttccatatgaactttaaagtagttttttccaattctgtgaagaaagtcattggtagcttgatggggatggcattgaatctataaattaccttgggcaatatggccattgtcacgatattgattcttcctacccatgagcatggaatgttcttccatttgtttgtatcctcttttatttcattgagcagtggtttgtagttctccttgaagaggtccttcacatcccttgtaagttggattcctaggtactttattctctttgaagcaattgtgaatgggagttcactcatgattaatgataaaggggatatcaccaccaatcccacagaaatacgaactaccatcagagaatactacaaacacctctatgcaaatgaactagaacatctagaagaaatggataaattccttgacacatacaccatcccaagactaaatcaggaagaagttgaatctctgaatagaccgataacaggctctgaaattgtggcaataatcaatagcttaccaaccaaaaagagtccaggaccagatggattcacagccaaattctaccaaaggtacaaagaggagctggtaccattccttctgaaacattccaatcaatagaaaaagagggaatactccctaactcattttatgaggccagcatcatcctgataccaaagccgggcagagacacaaccaaaaaagagaattttagaccaatatccttatgaacattgatgcaaaaatcctcaatgaaatactggcaaagcgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacgcttcatgctaaaaactctcagtaaattaggtattgatgggacctatctcaaaataataagagctatctatgacaaacccacagccaatatcatactgaatgggcaaaaactggaagcattccgtttgaaaactggcacaagacagggatgccctctctcaccactcctattcaacatagtgttggaagttctggccagggcaattaggcaggagatggaaataaagggtattcaattaggaaaagaggaagccaaattgtccctgtttgcagatgacatgattgtatatctagaaaaccccattgtctcagcccaaaatctccttaagctgataagcaagttcaggaaagtctcaggatacaaaatcagtgtacaaaaatcacaagcattcttgtacaccaataacagacaaacagagagtcatccttttttttattcctttgggttcacagaatactctaggctatatctcctccttttgtatttctttttcaaatttgagaacaatcattgatctgtattttccatataatttttcagttatttttattgatatcttcataacactaatcagagattttggctgagattgcattacatttataggggattatgtaaataattggcatatttacatgtcatttcattaaatatctctatattaaacaacaaagtctctgtcctccattagttaaaaatattatccgtgatattcttaactattagattggttgattcctaaatagtaggttgaaccatatgaatatatcatttttattatttataaaagggttggttattgttaaattcacatggttaaacttagtactttgtagttttattgttataatcaattatatatttcacttttatatttatttttggtgctgagaacaactattaatttgtataaattaatgatggtttatgcagccatgtctaatactttgttggttgtattgctatctttttctgaaataggtattatatcatctgccaataataacagtattatcactttccttccaatacttaacacctcattcctctttcttttcctacagaattgatcaggttatagggtatttagcatgcatgccaataaagaatattgttatagccagcattcttttttctcattagtaaaggaaatgatcacaattgttttctacttaccatacatttctgttatataagcttcactacattcagaaatttttttttagattttataggttgctgacagattattatgtttttgtcccaaatgtttaaagaaagatttatttgaatattgaatattgaaattattttttacaggaatctattactataatgaattatactaatggattctctaatgtttatcatctgtggatacaagtcatccaggtacagcttatatttcaagcaagccttccttgcagctaattagagttatatgactaaatatgggaaatagaatgatagtaaagttattgtgagtgacttacaggttatctccaactcaacacacaacagtggccctggacattgaccatttctcccttcttgactagacatgacaataactggagtgactttagaagccataaattaagtgttgacatgtcataccatcctgaaccaatcagaatctcccatgagataaaaataaacttctatctatgtaagtccctgaaattttgttgttgttgttacctcagttaaacctttatcctatctaatgatgtctttgaagtttggtgataaaccctaattcatcagaatgcattataacttttctaaatgtactattagattagtttgaataatgctttgttgtagattttagcatttctattaataagcaaaatgtggctaaaattttactttcttatataattagtatagtcaatattttacataatcttatatagaacataattttaaaataaaaattatattagacttttaaattaatcttgacagctttttctctttatttaatttccaaaaaagaaatgtgtaaaatgcatgttctctaggctgaattatatctgccaaaaaaatgtttaattcttaaccaccgggttctataaatgtgacctattttgaaaataaggtctttgcagatgtaatcaagttaatataacgtccctagggtatgtccacatccaatgtgactagtgtccttttaagaggatgagaatggactcaaaaacacaccgatgaaaatgctgcatgaagacagatatacaaaggaagacagccatgtgataaccaagaagagattaaatttatgcagctacaagccaaggaatatcgaaggttgcaacaaccatcagaagccaagaaagatcattgccttgctgacatcttgattttggacttctagcctccagaactatgagagaatacatttctgttgttttaagccattcagtatgtggtagttaattatgtgagccctgggaaactaatacagattttggcactgggaggtaggatactgctgtaacaaatatctaaaaatgtgcaagtggctttggaattgtgtagtaaatagagtctggaagtgtttttgaagcatattctagaaaagtttagattgtcttgaagaggctgttggtagaaatctggacattaaaggtgttctggtggggtctcagatggaaatgaagatcatgttttggacaccggagaaaaggcaaccctatttataaaataattgagagtttgatgatttggaaaattctcagctattcatatttcaaagaatgggaaagcatgttctggagagaaaacaccataggtgtgtctgaataaatttttgctacagagattaagcgtgtgactcatggatccaatcaactatctcagtagaaacggtcaccttggatgaaagatgatagaaatgaacaaagggcaggaaggctgttggactttttggttccacaaacagaaaatgggcagctagagctgcttggctagcaacctctgttagccttcaagaaaaaaataagaaaatttttaagggtggctcagatgccagtgggattttcaatgtctgggagggtgggatggttaccactgtggatcaagagggcagggccactgctattgaataccagaaggggatagggagccatctcagtgggttcaatggaaagagtcacggagaattattctcagaacttagactttaatggaattttctctgataggttacagacttgcttgggatatgtgaccctttcttttttttcttttttgaatttctcccttttggaatgggaatatctattctatgcctattccaccagtgcattttgtaaaaaaggtaatttgttttctctatttcagaggtccacagataaagaggaattttgccccaaaatgaacattacccagcatctcatccatatctgattctgaagttttagaagatgagatttgggagttgttgagttacttttatttagaagacattttggtgttagaggtcacattaggatgggttaagattttgggggatgttgggatggggtgaatgtattttgtatgtgaaaagatgtgggttggggatctagcaggcatattaatatgggttgaattgtgtgcccccccacagggatacgttgatatcctaacctcaagtacctatgaatatgaccttatttggaaataaagacattacagatatagttaatatgaggtcatcagggtggacctaatctaccctgattgatgttattttaagaggcgaacagacaaatgcatatcgaggagaatgctgtgtgaggacatgaacgcacgaaaggaagatgaccatgtcacaacaggaagagtttggaattcagaagatgcaatacaagaaatatccagcaaccaccagaaggagaggcagcgtggtcttgccaagatctttcttttagacttctagctctagatctttgaaagactaaatttctcttgttttgagccacccagtaggtggtcatttattatggtatccctagtaaaaaaaaaatattctggatagtttggtaattctcatttataaaactatttatcggtgaaaccccatctctactaaaaacacaaaaaattagctgggcgtgatggcgggcgcctgtagtcccagctacttgggaggctggggcaggagaatggcatgaacccaggaggcggagcttgcagtgagctgagatagccccactgcactccagcctgggcgacagagtgagactccgcctcaaaaaaaaaaaaaaaaaaactattaatacaatgataattattactattaatttctattggtgggaggctgcttctgagatggaaaacatgtctttagctacaatttaaatttacttaattctaattagtctgttaaaatattctatttattacatatttgtaatgaatttgtcatgtcatctattttctttatatatttattagcatagtattagcatgataatggccttttttttgttcaacagtccttcctttagtttatccctctttctcctctcacaattccttagaggcagcaaggaaaaactgaggggacccttttaatactttggctacaaaattttttagctggattacccaggcctttaagcacatttttctattaatacctgtcttttatcacagcatcctacatttgagtgccacaatctgaatttggtcatctattgctgcataaataattaatcccaagcttaggctcaaacagcaaacacttattatgtcacgaaattgctagggccagacaccttactttcttgccatatggccttctccataggctgcctgagtaccctcacatagtggcagctagcttcactcaggaagagcaatccaagaagagtgagagcccagcctaatcttcaaagagttatgccatcaactcttctgtattctatggtgacgcagacctattctggtacaatgtgagagactttacaagggtctgaacacaaggaggtgggggtaatcgggagcaacttggaggttagcttccacagttattaaggcataatctccaccatacaacatgaggagtgggctttgccaagagtatcaacatacattctgctggatcttcatctaatggtcagttgaaatggacatattggaatttattataaaataataattttaaatgatttttaaatgatttgctacacagatcagttacctgtaatgaaaaactaacagacaagtgatttttaaaaattggatcagtatgaggttcacctataatatgttcacactatcctggcccctgagagtaatattataataaaactcatttttataagtgacatcatcctagtcttggtatcaaatgaggcataaatggattgaagtgctcatttggcctaataatgtagcgaggttatttcaattagaatcacccagctactagtaatctgactatgttattggagcaattcctttaaactactgaccaagtcttgcctggctcagcaggccacatctaatgtgattacctcctaacgtgttatgacatttaggaattctatacaacaatcttaacaggacatagaaataccacttctataaaatgaactgacatgaagttaattctttaacgcatttcattaagagaaaagtgtttactttcatctctgcaaacaattccctcattaatctgggaaatatcacctgagaatgctattgaagtcgataaaatcaaataaaataatgacaggtaccgacaggaatgcaacaaattctactccaaaatatactcccctattagagctgttgtaaaccatgcttggattcggctaccttggcagaagatttaaaaagaaaagacacattcacagctgtgtaattagaggagaataagaccagcaattagttgtagagtaggtgttacttctatgttagcatctattttcagttttttatgttttgctttatttcctgtttcttgctgtctataagaatttccagacaaactttgagagtctgggccatgtttaacaaaatcacagaatactgagattaggaggaagtttaacctaatgttgccaattcctgtttagacttgtttcccttcgaagcaactaatttttacctctggaatttgattttgaccctaaacttaatggaactttagtgatagaactcattgccttctgaaggagtaccttctacaaaaagttcatttgttcaattgcaaagttctttgtcatatcaagcttgtttatccacttgaagttttcatatgttgacataaactctacctttggcaatatctagcacaagtctcatttctcttcagcaaaaaagacccttaaaaatatttatgataaacccttttgtatttttgttgctaaaagtggaatcacctcataaagctgaatgatagcattactgagtctcctgagatgggcttgtcatcacatttttctttctgtgtgcctttacgacatcaagaaggtgcatgattgctgtgtatttccagctcatgagagatttggtcttgctactcattgacatggaaggttagcctcagtcaaaagagttcaatagtcttccccaggagtatacttcttgactcacagtgacacaacaggataggtgaatgaaataatcttgagagtctgtatgctagtataaaactagtgagggcagacattaaagactcataaaattaaaaatcaagagaaaggtcaaatcagatgtgaaaagtattgtttcttaaggaacttacacatccaggatgatgtcaaagcgagagacagagaataaagaggggggacctttaagtcaggaatatagcatggtatgtgatttgaagcatttactgaatgccaacgctatgagtgttcgagtagtactctggaatgttgagggaggggatcatttttaatactggaatgagaacctgggaagtagggtaccaaaacatgttgaattgattcaagattcaattaacagggatttattgatgttctatattgaggcaggcaatgtttcgggtacagaatccacagttttaggcagtgagacactcacaaacttacaatgctattaaagttgtgtggcaatacactgaacataaataagacatgatatgctgattttgaagttgtgaaagagtttgtatctggattattgattttatagtatattttgccaatagaagttataaaagtattatggtatgatttttattgtgtacattttttgtggcttaataccaatgagaagttgtatttgccagatgttatatggtttaaatacgactaaaaatcttaagttatagtttacttgctctggttggttctctttcagtttgtttgctctccctgaaattttagatatcagtgtaaggaaaaatgagtgagactgccatagaaattcagagctttttacatagtccaactcagtatagtcagggtaatggtgtcaatgagctttgtaaacaaaaattgctgtgggaaaatttctcagggactgtaatagtgagatgaagcccctaggttcatactgtggaaccaaaggcaagacactgagattaaagcattttgtaagcattaagtactaatcataagtagaaaatgatcataagtttttaaaagaaaaaaatagcatatacatagaaaaggattttttaatcaactgggcttttagatgttactagtaattgctaaataatattccagaatcgtctttataaaatcatatagtactagagttttagtttcagaaaggtgggatagacatattttccctatttcctcctgctaagtacagctaaaagccctgaatattatatataaaataaacataagaagattgaaatgtgaaaggaggaaggcaactggctaaaggccttaggacccaaacactaacataataggatgctctctgggttttctttttttactcagatcacaaacttaaagaagccagaaacccagaaataccaataggtgtagacaaacaaaacacaacaaaaaactctaaacaaaactctaatctctctagccaaaagatgaagaaaaaatatagtgagacagatagctgttagataatagctgctttactccagccaaacaccactaaaaagatcatagtcccatacccatcagcagaagccaagtggggagctagattttcctgcttacaagggtataataagatactccaataccctatcatgatggtgtcagagaaggcagagtaggaacataggtctctcactcctttcagacaataagctcccttcttccactgcaggatcaatagagacaacatatggagcctggacttccactccaatcatgcattaatgatattctcctccctgtttcaactgggtgctatcagagcagactcagtagaaagtcaggacttttaccaccaaacacacattttagaacaagaatctaagacatattttagaacttgaaaatattacaactgagacaaacaaaacctaaaactcaactctctgtgggcgagcttaagagcagaatgaagaggactaggggaaaaaaaaattagagaccttgaaggtctctgataggatcttcagagacaaaagaaattacacttctaaacaacagaaagactgcaaaaataaagcaaaaaataagaataacaaaacccaaatcctcaagaacatccgggagtataacaagggatctaacatttatgtcactggagtctcagaaaaagaggagaatgaagctataagaatattcaaagtaatgttggctaaaaagttggaaatttgaataaaaggctaaacccttcagatttaagaaactgggcaaacttcaaataggataaatccatagaaatctgcaccaagatgccttggagttaaacttctgaaaactatatcatgaaaaacaattttaaaggagataactaacactttccctacacagggaagataattttaatgacagaggttttctcatcagatccatagagactaaaaggaaatgacacaatagtttttaagtactgaaagaaaagaactgtcaacccagaattctacaaccagaaaaaaatctctcaagaaagatgaatcaagatagtctctgatcaaggaaagctaacagaatttctccccagtagatttatccaaaaagtcttaagaaagttctcaaaaagaaaaagaaatgttaaaaaaaatcttgggacattaggacagaagaacaacaaagaacaaaaacaatctgggtaaatacagaaaaattccccactcctcttgaattttgtaaatcatgtttgatgtttgaagataaaattttaacagtgtgtgctatagttctgcaaaataaaaacaaacaaaaaaagccactaccaaccaaaaccaaaacaaactaaccacaacgctgcagctgggtgtcagtaaaagtaacgttctgttgcaaccagatattaaatgtttgatctccatggtcgctttccatggatttggacaagaaaatgaaacattcttcaaaaaacattcatgttgtatacttaaaatgtaaatttttctacttaaaggtaccaacatctttggtatgggagaggacagaaaagcagaaatggagtattttattctctgaaggaggtaaattaaataagaacaaaccataaataagttgagaagtataaattaaatactaaatgatgtaattcatactcaagtgttagagaagaatagattaagacacaaacacgaaggatttgggctggactttgaaggatggaaaagacttagataaaattaaagacaatgcacagtgggagaaaggacacagaaataagcatgggcatggaagcaaccaggctgagatccttgatgtcggagtgttgtattagttttctacagctgccctaggaataaccacaaactgtataacttgaaaggacagaaatttattttctcatagttgtagagacaagatgtctgattctgaaattcgggtgttgactgacagaaccatgctcctcctgaagttctaggagatggtccttccttgtctctcccaagcttcttggcattccctggtttatggcagcataaactccagtctctgcttccatcttcacatgtctttttccctctgtgggtctctgtgtccaaatgtcctcttcttttttttttttttttttaacagatttattttatttttttttattttattattattatactttaagttttagggtacatgtgcacaacgtgcaggttttttacatatgtatacatgtgccatgttggtgtgctgcacccattaactcatcattaacattaggtatatctcctaatgctatccttccccccactcccccacaacagtccctggagtgtgatgttccccttcctgtgtccatgtgttctcattgttcagttcccacctatgagtgagaacatgcggtgtttggttttttgtccttgcgatagtttgctgagaatgatggtttccagtttcatccatgtccctaaaaaggacataaactcttcatttttatggctgcatagtattccatggtgtatatgtgccacattttcttaatccagtctatcgttgttggacatttgggttggttccaggtctttgatattgtgaatagtgccgcagtaaacatacgtgtgcatgtgtcttcacagcagcatgatttgtaatcctttgggtatatacccagtaaggggatggctgggtcaaatggtatttctagttctagatccctgaggaatcgccacactgacttccacaatggttgaactagtttacagtcccaccaacagtgtaaaagtgttcctatttctccacatcctctccagcacctattgtttcctgactttttaatgattgccattctaacaggtgtgagatgctatctcattgtggtttcgatttgcatttctctgatggccagtggtgatgagcattttttcatgtgttttttggctgcataaatgtcttcttttgagaagtgtctgttcatatccttcgtccactttttgatggagttgtttgtttttttcttgtcaattattttgagttcattgtagattctggatattagccctttgtcagatgagtaggttgcgaaaattttctcccattttgtaggttgcctgttcactctgatggtagtttcttttgctgtgcagaagctctttagtttaattagatcccatataaagagaacattagtcattggattaggggccgctctaatccagtgtgacatcatcttaatggctgtatttacagagatgctgtttccaaattagtcacagtcacaggtaccgagtgttagattttcaacatatttttcaagcactagtcatatttctcaacttgaagatgtgaaaagtagtactttaggtgggtttgaattttgtggagccttagaaactatataatatttgcatttgataaagagccatgaaactgattcaaaaccaacccaatactgtataaactctttctcactttaaatatagacacatacaaatagaggagcatttctggtagatttatagatagtaaatttgtaatagtaaatttgtaatcaaacattgataatgaaatatcacatcaaactaggaaccaggagtcttcatttctaattctgtcaccatctctactatgccccatgaccttaagatacaccttagcatgaatatgggattatttttaccatctatgatatagataaatttctcagcttcataataataaacatttttattgcatgctatatgtcaagcactaatacatatgctgaactatttacctgaattgtctcatttaatagttaaaatattcctatgagttaaatcatattatccttactttttaggtgataactaaagcccaaacagagttttgaaaactgcctcagtcaaagggtggtattaagattccaacctatatttatcttagtcaacagctaggttcatagccagtattcaatcaagggttcacaaattgtgagcccattgatgatatatggcccaaagatatatgttcttagatatacattctgttttaaaagaatgagccaacatctaaaacatcaaatgattttacattaaaataatttttataatattttgaaaaacttagtaggtcttgaacttctctgcccaaacttagctggaccttaagaacatttgcccatgcatttgcccatttagatattcatgcattctccacttaaatgtaatccccagctctccctatcacctccaaacacacagtgtgtcaattatgatttgtcattgagcttgcactattgttttcttcttacatctatagtggaacttctttttacccatatttcaaataaaagaagtggaatacttctttttacccatatttcaaataaaagtgagaaaattaacaataggctgaaatatgttatttttctcatgcctctcctagattcttcttttatgtgaacttgctggctcctataggcatgtaagtttgtaactcctgccatattgcctctggatcagtgatctcaaccttggctgtacacatgaatcacatagagagatttaaaaattcccaatgttcagtctgcactctagacctattaaatcagaatttctgtgcatggagcccaggtatcaatatttacagcatcccactgtgcagtcaatgttgagaaccactgctctagatattctttaagatatcttctgttttctaaattctaaatttacaattcaaaagccagttctaaagattggaatggttcgatatgttgtgtgtaagctgtatattggggatgtgggattgatgtagggacactgactgtggatctttgcttgccgagctaagcaaattagaccaaccctttagatgtgcagcccattctagcacacaacattgacatccagaggaaaagtgtcataagttagtcttagttatggggccaacagtttacgtgacctaagaaagtcatttactcagtctcggttttattttcttttttcaactatgactcaacagcgctcatatacaatgctgtatgcaggtcctatatttgcagtaaagacagtatcagaaaatcaaaataaagtacattcaagatatatacttactataagaacataaaataaattttttcaaacctactgatttccaacagaaattcagaaacatagggggacaactgtactgcagaaagacatgtattcagaaaggtaatcagaatgtgaaatgtttactgcaatgcttaggtaaggaacttttgcccctggctaccctccaaggtctagatgacacatgtctctggtgaatcatgaggttgctaattgtaagctttatggattcaacaaccagcactgagaagacctgcaatgatcagcagccaaagccaatggcacagcttggagcccggcgctttctgttctttgtgttcatactagttcattctctagagaaggtcagagtattccatacaaaactatgctcagttttcaagtgtgaagcttccatgacaggaaacacatcaaggcttttgacagctgataactttgtacctcctctctgaggggctcctgttcagaacaaaaatgtaatatagctccgggtgttatcagagctgttataaaatgcacttgggcattctgaggattcatgcttaatgcctttctataatttgtgcagaatgtgtgcagagtccttacagcatgctaataacattttgttatgacacagtgcagcaccacagagccaacttacataaggatagaacaatgatgtagaaggcaaagataaagattagaatttcaagttaaaaagcaaggttttatagaggccattgataggttggaggtaaagcaactgacaacaacttaaaatagttaaagacatttaggcatatcttagaatgagactcgactgacattttgaaggcaagcttataggaaaattaatcacatgaggagtgttcattgactttctatagaaaaagtattgagataaatttgcaggtattcaataaagtagagtgcctatcaaaataggcagcctgcgttaggacgtcaccattttccatacatgtgtgtgtttttcttcctaaaaatattgtctatatatgccagaaacaattgtggctgaaataaatttcttgtatcaacaggatctcagcttataactttacatctgagaatgaagccaaacagaagtacttgcttttgtttgtggcattgctcccgatttatttgaatttagtcctgtcactggagttcaataaagtcaggcagtgaatccatatggatttgggtaatagattgatgttctgataatgagaatcaatccagaattaaaattaattttaggtgaagagtaaatacactgcttttagatactcatgaaactctgcttccttcttgtaagtaatgatgagaatgacatggatatgtgaagaatagaatgcagaataaaaacagaataaatcttcatgtgtttcataaacaaaatccagggctggtggtaagtatatcaaagcatttgtgttttatctttgaaggaaatatgaaatgttacaagtttttcattaatttatgtagacactaagtaggacctgagagagaaataataattatacaaaatagtgttttattggataaatgcttttttgttaaactattgtacttgagtgagaaattatggtgtgtattttctttatattcactattgtgcattttgagatgccattatgccaacagattataggcaaacctgatgattatgctctgaactgcatccattatatttattaaaccaccttttctactaccttttatgaatgtttaactatagaaacttcaacgttttaaaaatgatttatataatcaaatcattcatgtataattaattctactaattttcatgagtgtttcaggtcattttggcataattagccattgttgagggttttctcccccatcaattaaactaattgctttccacataggtatagattgaatattgatccccatttttttcagctcacttgcataagcaaattatgcctaattgccagcttactacatcattacacacttatcatcaattatacaaaaatatactctgctagacaaatgatttctttgtggcattttgaagggctttttaattgtgatgcttagaacagtattgtcattttaaaaaatattaaacaccatgtttaaaccaataacgcaataaagcgtgttattggttaacaaacataccagctcctggctagaccatcatttaccttggaatataaagagtgtcttaaaacaatttgaaggaaactcattgttattaaatatagtaaatccaccaatgcaaatattagaataagttctttctaaattttttagcttaatctttatctttcccattccacatatttatttcttctctacctgacgaaaagtctttgagaagatctgaagaggtggtgaatttcaaagaatcactatacagaacacaccaacatttttaaaagtcaggagataaaagcaaccccattcatcatgcattctgtgcagagcattaatgtcttttagtgattttactgggcatttgtcttcactagtttctcagttagattctttaaaaagtacagaaagatatgaaaataatataatcccaagattctccttacagatttctacaccctatgacataattttcacacattagctctccatagagaatggagataaaccaaaagccaatattaaaatgtattttaaaataagtgggaggactgtcctgatatgacagtcttattttaatccttggctattccactaataaaatcatataatatgagccacttttacattggtgctcacctcatggaagccagacttttctcaacaggatgccacatttagcaaagtaggcctccacaggctgtatctaacacccacaaacaaaagctgaggatgcgaaaaggttctaaatgattctatcgcttgaaactgcctgataatgagtcttgaattacctgtggggatcttgatgatcaattctttatttacactttaggactaaccttactcttttcttattcaagaaagttggggaagacggaaagaagaagagtatagtaaatattcccttactcattgatatctttttaaaaccaaaatgggacaattttagaagaccatttcgttttaatcaatttaatgtaatttaaccattttctaaaattggatgatgattttgtgccacaaatcctaggctcagcttatggaatcacaggacatcagagttagaaaaccaatgggagatttacatagctttaatcactgacatccagtatctatttgaattcctctagtggcaggtgacttgtttttacctagaaagcagcacataatatttcaagggagcttcagtcatcacaaggttcttagacccattcatcccatctctgcactctttcaaatcttggaaagaacttatatttttctcctcacaggttatagtttgtgttgataactctcataaatgcctactcttttccattgttgaccaaacatccttagatctacattctccttgtatagtttcagacctttcaaaatctttgtctacggatatatttcatgcatatctcttttttgatggcatttaaggtctgtgaacaggaaggtagcatttatagaaatcatgaaaacaatacaaaattataaaacaaatgccaggcgcagtagctcacgcctgtaatcccagcactttgggaggccgagatggatggatcacctgaggtctggagtccacaaccagcctgaccaacatggagaaaccccgtctctactaataatacaaaattagccgggcatggtggtgcatgcctgtaatcccagctacttgggaggctgaggcaggagaattgcttgaacccgggaggcagaggttgtggtgagccgaaatcgcgccattgcactccagcctgggcaacaagagcaaaactccatctcaaaagaaaaacaaaaacagaaacaaaaaacagacaaaaatctattattttcccctttacatagcttttaaaagatacaaatacaaaaattcaccttacataaaatatacatgtattaagaatgctagtagagaataatacataaagttgtaaaatgtgtgctattttcatttcttaaaactggaattatactgagttgttattatatttgacaaaaataagatagaatatttaaaaatcttttacaaaagatggcatcaccaaactgttgattcatgataacttttaatatctgaaataaattttgttcagtctaaacactgctaacaagaaaatatcatgtaagtttaaataccatttgatattctttgggtctttcagtttattttatttttacaaagttttatgaatggatttatttaagtaatattataatgtaaataacaagtcaaaatcaggggtttgaaagaatcgtttctcttaaaatgggtctgaaccttattcgagtttgggaaacactgggctataaaataaaattaaactttggattggtatgccaggccttccatgatctggccctcatggtaccattgcttcatgtcctgtcagtctcttagtcaaacctgaggtcccaccaacactgtaatttccatgtccttattctagctgttccctctacccaggacaaccttataaacctactcagaaaaaataacacatcacagaccatagataggtcttgggattttaatcctcccagaatgacaattagaaattacctactcaactgaacaaaatggtacaatctgtctaccatctcatcatgagatatgtatgaagcagtcttccacattattgtgagggatagactgagcacctgtcaggccaccacaaggaagtcaatacgttccctctaagccagagaagccaggaccaatagcccagacaaaacggaaacttcaaaaaacaggcccccatcaggcttaaaatggtcactcccagtcattccccacaactgtcttaagcattttgcttgataaatacagacttttgaccagaagagataaacaactttgatgttaaggttgttatcatttgtgataacatttcgattgattttaaactttcaatggtacttcaatgatgtcaataatacaaacctgatttaaagctgggaatctaaaatgaagtcaagtatttgctgaaacatttctttattatgttcaaaatggtaactttcatatgaaaaaaagattgacaacctgtgtcacacctttactaagacttcacaaactcttttgtggccagtgttacttctgctttcataatggccgcttaaagacatcttgtattgtttatactgacaacacatctgtatttcttattgttgactcaaaatcctctctcattaacttgaattaaaatagaaaatagcactggtcaggcctaaaactactcagcaaacatgcactttaacagtaaatttacaactctttacaacagaaaccgcgcactcttctttaattgctacagagaggtcagtctttcaaaccaaataagagtaagagatgctgcttttatcatagccttatgcaattgtaaaatagagagcaaactaaggtctgccgttctttctccacctgcttacttttggttatatctcatgacagattttgaagccgatttcaaagggcaacatctgttgtttgaactatgcatggaaagtttacataaagctaaatttatagatagctaaggctatgaaaagtattagaagaggatgctgaagatacaaaagtaaaataaatggtgaatttggatgaatcgtagtgaattaattctctaattgcattacttattctgttaataggaagacatttgagcaacttatatatggaggggttcagggcatgatgccccagaatgtggctccttggcctttgataaaacagcagaatgaggaaggtcagtctctgaccttctcccatccttctcccctgaagtaggtcacaagaccctcattagagaggtattctggcagaaagaaacatccttatctctgaaaagacagagaagaatctgaacaaatggccttaacaagtttattaccattacatcctagaccctttgttcatcacactttcccacaactgtccactttgggtcaaacctaagcataaagacgaacaggtttcctgtttctttaggtcttcatttctgaaggctctcatgtcatgtaaagcttatatcaaatatatttttatgttttcctcttgttaatctgtcttttgttacaggtgcctcagccatgaacctagtattggatgtggaaaataaatcttcacccatttataatattcatgactccaaaacatgtcctcttttaatatcccaagctgggttttattccaggcctccctaggggtgtcatgggagaataaatggcaaatttagaattctttatacattatattagccacagatatatatatacatatatatatatatatatatatatatacacatatatatatatatatatatacacatacatatatatatatatatatatatacacatacatatatatatatatacacatacatatataccttttatttttttgagatggagtttcgctcttgttgcccaggctagagtgcgatggcgtgatctcggctcactgcaacctccgcctcctcggttcgagtgattctcctgcttcagcctccagtgtagctgggattacaggcatgtgccaccacgcctggctaattttttatttttagtagagacgggatttctccatgttggtcaggctggtctcgatctcccaacctcaggtgatctgcccgcctctgcctaccaacgtgctggggttacaggcgtgagccagcgtgccaggcctatatatatcttttgttaagaaattagaatttactctttaagatagagttaggcctagtggggtattttgaaaatgtttctgaaaattcgcctataaataaccctgataattttacactgtctttaaatttactggagttctaccaaatgcctaaagcaaataagtgtggatgttaaacattaaaggcaatacttctattccaacattgcaaataactgactgctctgaaccttacttatgaatggcgatacttatatgacatattaaagtttagagtgcaagatgtgttttcctgcctgggacattatatttgataattataaactgatattttaaaatgcatgcatgtctttattatttttaaaaaggtgggtttcaatatgaaaacacctttgtcatgttttccttcttgtgtgtttcatggattagaaagcaatttaagatttaaaaaaatgtttactgaccaacaagtgttttgtttagaaactgtgaaaaatagaattgctgagctaaagcaggcgataaaacagattgagtttgtaatacattacttacaatgtgtgcttaagacatccacaagtaaaatgtgtcttattataaaataaatatacatatatatacacacacacatagtgttttcaaagcacagtgaattaataccaacctcaaatttcattctcgctgcacaaaactaactttaaattacacagtagttttctcagaaaccaatgtcagatattaaagggtctcatccatctataaaatgtaatagttgaaagcatccatctgatagtctgggcaagaaagtgctaggtgaggaggaatgggataaggagaagtgacaggacagtcagaccttggtaaaaatcacttcattggtttaattgaacaatttctctaccatagagtaataaagaaaatatcacacccagtaacaatagatagtttccaagttaaaagaaaaatctgttgcacctcgttggcgtgttctcataacaagtagaacataaagttattagcatgcaccatattccattttaatttctgatctatttatctttctctttcattaaattattagctcctttaagacatatcagtatatctctaaaatctaacaaagaacacagtgcccaacacgtcgtagagaatcaaagagaattttttgttttctgttaacctttatgtttaatcattatgtctacgattcttatttgcataattatacctttaaaatacctaattggtgtgaaatgttttggatgtaccaatcattgttttttgtttgtttgttttttcttgagacagagtcttgctctgtcacccaggctggagtgtagtggcgggatctcagctcactgcaacctctgctttcaaggttcaagcgattctcctgcctcagcctcccaagtagctggaactataggcacccaacaccacacctggctaatttttgtatttttttagtagagatgaggtttcaccatgttggcctggctagtctcaaactcctgacctcaagtgatccacctgcctcggcctcccaaagtgctggaattacaggtgtgagccaccatgtccagccccaatcactcttttaaagcttttctgcattaactcattcatgttacaacaactctgtgatgtaggcactttgatgtacctgatttatccacagttgacagatgaataagcagggtatagatcagaaagtttaattttccaatgtctaactgtgaataagtggcacagccaggatttgaatctaggccatctaagtcatgagccatagcacatacccattacataaaatatctacattattaaaactaaacaatgctttggagtcaaagaatatttctatagttggggcaacaattttttaaattagtcatcatgattataatataaatattattatttaactgtaaatttaactagaggtggcaaaagtggatggctgagagtcgaggcaggtaaaaacttaacctgggtaatagtgaaggtgagcagtctgtcttcagactataaatcattaagtcataggcaacctgagctatcaggagaaagctcagaatatgacaggaagagaagggagctgaaatggaagatgtgaaaggtgttgtagagttcaaacttgcctgagctgatcatataacctgtttcaatgaacatctttatttctgccctcattttgttatttacctagatggttgttcagtttccatgtagttgtgtggttttgagtgagtttcttaatcctgagttctaatgtgattgcactgtggtctgagagactgtttgttattatttccattcttttgcatttgctgaggagtgttttacttccaattatgtggtcaattttagagtaagtgtgatgtggtgctgaaaacaatgtatgttgtgttgatttggggtggagagttctgtagatgtctattaggtccacttggtccagagctcagttcaagtcctggatatccttgttaattttctgtctcattgatctgtctaatattgacagtggggtattaaagtctcccactattttgtgtgggaatctaagtctctttgtaggtctttaagaccttgctttatgaatctgtgtgctcctgtattgggtgcaatcatatttagaatagttagctcttcttgttgcattgatctctttaccattatgtaatgcacttctttttctcttttgatctttgttggtttaaagcctgttttatcagagactaggattgcaagccctgcttttgtttttgctttccatttgcatggtaaatattcctcagtccctttattttgagcctatgtgtgtctttgcatgtgagatgggtctcctgaatgcagcacactgatgggtcttgactctttatccagtttgccagtctgtatcttttaattggagtatttagcccatttacatttaaggttaatattgtcatgtgtgaatttgctcctgtcattatgatatagcttgttagtttgcccattagttgatgcaggttcttcatagcatctatggtctttacaatttggtatgtttttgcagtggctggtaccggttgttcctttccatgtttggtgcttctttcacaagctcttgtaaggcaggcctggtggtgacaaaatctctcagcatatgcttctttgtaaatgattttatttctcctttgcttatgaagtttattttgactggatatgaaattctgggttgaaaattctctctccatatatatatagagagagagagagagtgtgtgtgtgcacatatttgttctctttctctggagaactctaacacatggctgttacaaatcataatatgtacatatttctattgattatctattaaggagtaaaatttctgggtcataaagtgtgcataggtctgacattagcagacaatggtaaacaatttctgaactaggtcaatttacactgtctccaatataagactaccatttgctctagagtctcaccaaaacttgatggcatcagtagtttttaatgtaaaccttgccattgttttgaagttattttaattaacttatcttggtctcaaatatatatttgttgttacctagaatgtaatctgctgatcatcagctaattatgagaatgagacaaggtttctgcttccatagctcagtggataaactgtcttcatggtaaaactgatcagcaaaaatatttctcaccatgctgaaatatgctgtgcttgttcatcacaatctgcctttctggtcttgtggtcaaaaagtatcatgctaatcctaaatgcaatctgttccttgctccatcaagttgatattagataaaaactgaccccaacttgatacctttgctagctccaaattggtgtgctaatgggtgatttggagatttacagtcttttaaaacatgatttttgtatatccccccaaatataaaagctcctcaagctgcttgctacaaacacctcctctcttcactgttgcctgcatgagagtcttctcttttccttctgcagctactgattcactgcaaaatcaactcagactaagtgcagattttaaatagcatggcgaattgaatgatcccagttttaaatatgtcaggaaggtaatgtggagttttctagtacagccattagttttcctcctcctgtgttgcagctgcaaacacattggcattctccaagactgcctcaatatactgtgtgtgctccacccacgattacaaaataattggagtgttaagagaaacatggcgtgaggtgttgggagttggaaggctggccttcaggagcaactctatcttctcccttccaggcacttgatttggtttttccttagttcagattcgattctgaatctgaaaatgttgcctaagccctaattcagaaatcctttgcaagagagctgaaaaatttgctccaaaaaagaaaaaggggagagttctagacagaagtaatcagctacctgtaatcataactttagcatgcttttaccaaaagatgattagaaggatatatctgcttcatcagtgatttttaagaaaaatttcattttcttattgatagaaagacacgtggataagtatactgataaatggctgagactatccagcacactaacaaggtagcttcacacatttctaggtgtgaaaaaagtgctgggaatgttaagtggatgtgactacaacatcccctaaatgagaccagctttctttcagctcttttactttcaactaaaagtgaaaaatgtttatcagctgaggtcaggcactggaaatgagtagtgaatgtaaaatacaagctgtacagaattgttccacatctaaacctgtgggtggatatttgtgcaataaccccaagggtctactttattttaacttttcagcataactgaatggcatagcaagtcacttatctgttcaaaattcatgagagagacagaaaattgataaactcttgcaaaaatttcccagccttctttctaagaagaaccacaatggaaatttgctggcaaaactaaaaaattattgtaacaatattagcaaggggcatgctttagccttcagtgtttaaaaaaaaattcccttcctcatgtacacaacttggtatactcttagcaaagtttgttatactcttagccttttggaaaaggagaaagcttttggtatgcccaatatgaaacaaatttttataatctttttgtaataatttaaagtaagtctatgtcatttcagaatgagcacagtggaaatgaacaatttttacaagtagtgaaatagtcaatacacaaagtattatttattgttgttaatatgtttcaaataatgttaacagttcctagcacatagtaggaacatagaaaatatttgtttctttcaatatcagtcattttttattggcgaccagctaaaatacgctctagctgatttaagtggaaaagggattcattaaatagatattagatgcttctcagggtgatggggaagcctgaataatgtggctcaagaaataggcagtaaacaagtgtctcatattttcagctccctagtcatttatgtatcagtcatttattgcttgtttctttcctaaataaatgatatattctcttttcctgtgtttgaggatcactttgaagatcctcaagatcctcaaacataggaaaagagaatatatcgtttatttaggaaagaaacaagcaaacaaatgatgatgaaaatggtgtccaatgaaaatactaaaacgtatgattacatggtttatataatttgggtatcaattagtttggttaatataaatagacaatgtggaacttttaaacagaaggttaaagccttctctttatcttcacctgtggaaccctcagaacttcagattagtgttaaatccattctgttgtaatgagcacctttctaagaactggaagcaaatctaaaaggaagtcattgaaatcagagggaaaataaaatattctataactgataaaggggaagtgttattaaccagtttaatggatatatttttaatacatagtagaaatgtctttgtttgtagaaatgctctaacaaggactcacttcatttcaactgcatcacagcttacctgtaatgttttgggaacttaaaacctacaattcttcatttaacatacggagtcaacctttatttttaatgccaattcttgatacttaaaataaagtttcaaataaagtgacaataaatgtatcaaaaggtcttcctaggatagatagcttgatatttttcattgccaaaatctcataaacaccaagttgcatacatgaattatattcacacagcatacggaagtttttttttctaaattctctcatttgagtatttttttctcaactactgggccatgactcatgagcatgtggagcagatgtacttggttttatttatctatttatttatttgcatctggtttgcataggacagaataaacacaaaataaggacctaaaattgcttacttgggtgattgaatgcatttatcaggttggtctattactatcttaagagctacacgatacaggccaggcgcagtggctcatgcctgtaatcccagcactttgggaggctgaggtggggtggatcaagaggtcaggagatcagaccatcctggctaacacggtgaaaccccgtctctactaaaaatacaaaaaattagccgggcgtggtggtgggcgcctgtagtcccagctagtggggaggctgaggcaggagaatggcatgaacctgggagatggagcttgcattgagacgagattgcaccactgcactccagcctgggcgacagagcaagactctgtctcaaaaaaaaaaaaaaaaatggagagagagagagctacacaatacaaaatgccaagttatatttcataaaaatttcaatgaaatagtaattatttttctatcattaatttttatcacgatattacaagtgataagaaagaaatcagaaacattttctgccaaagtaaaatgaggtgtatcattcatataataacatgaatattaagcagttttcatatgctagcctatttaatcctcacaataattcagtgtgggaaatagagttcaaggtacccttgaacaacaagggggttgggttgctgacccctcatgcagtcaaaaattcacatgtaacatttgacttcccaaaaacttaacttctaatagcctagtgttgactagagccttatgggtgacataaacatattttgtatgttatatgtattatacaatgtattcttacaataaagtaatctagagaaaagaaaatgttgttaagaatatcataaggaagagaaaatgtatttactgttcattaagtggaagtcaatcatcatagaggcctttatccttgttctcttcaggttgagtaggaggaggaggaggagagttggtcttattgtctctgggacggccaacgtggaagaggcaaataaggtgaaaggagaggcaggagaggcaagcacacttcctgtaacttttactgaaaataatgtatgtataagtggaccctcccggttcaagagtccaccgtattatacttaatttgtttttagagatgaagaaacagagcaattagaaatttgcccaaggtcacatacttgtaagaggtgtatatatatatatatgtatatgtatacacgtatatatatatgtatatatatacacgtatatatatatacgtgtatatatatacacacactatatacatataatatacatatgaaaatatatggcatatattatatagaaaatatatattaatatagatcgctacagaaaaagatttaaggagtttgaagcaatataatcagtgaattttaatagaaaagactcacgaaatgcaacactctaccctactttgttaaggtcaacagatgctcagattgcctttataatgcaataatatgtttaatatttttttcttatttttttagacagagtcttgctgtgtcacccaggctggagtgcagtggcatgatcttgactcactgcaacctctgcctcccaggttcaagccttctgagtagctggaattacaggcatgcaccaccacatccagctaatttttgtatttttagtagagatggggtttcgccatatgggccaggctggtcttgaactcctggcctcaagtgatccacctgcctaggtctcccaaagtgctgaaattacaggcatgagccatcgtgcttggccttgataatgtttaactcatcccactttcatacctcaaacaaccagtaaattagtatactgttccatttgtctgtatagcacctggtattcaagccattttcctaccagagaaaatattctccagagagaatattttttctttgctgaaataaaagttgatgggcagggtcttgcttttctttttttagatctgtatgaattaattttgctttgggctgaatgtttatgtccccttaaaattcatatgttgaacacctaatcaccaaggtgattgggccttgggaagtaattcaattatgagaaggaagccctagtaaatgagattggtgaacttagaaagggcaccccatagagtgcctttcttcttctaccatgagaggatacagtggagaaggcaacgtctatgaaccagaaagtaggccctcaccagacactgaacctgctagtgctttgatcttggatttcccaaccttcagaactgtgagaagtaaatttctattatttgtaagctaaccaggctatggtgtttatattacagtagcctgaacaggctaagacagatgtactctcagtccctggggaagtacaagttgtcctctttccccatttctttcctgtgtatgcactagccttagctctgctcttctttacataataatattacaaaataatttcatttacagaataatatcatttttgttgtcaatatcaattattttttatacaaggaattaaaaaccttgggtaacatttttctagagtcttactttctcttggttatgactttttcacccatttacacgtgtgacacatatatcacatgtgtaaatacgatgcatttgcacactgttgcaaatagccaaaatattccataataagataatttgcctgggcttagtggctcatgcctgtaatcctagatttttgggaggctgaagaaggtgggaggactgcttgaacacaggagttcaagaccagcctcggcaatacggtgagaccctgtctctacaaaaaataaaaaataaaatagcctggtgtggtaatacatacctatcatcctagctactcaggagactgaggcagaaggatggcttgagcctgggaggttgaggctgcagtgagtcacgttcatgccactgcgctccagcctgggtgacagagtgagactctgtctggggcggaggagggtggaggaaagaaagaaagtgagaagaaaagctttatatagcagagttgtctccatgttttctgaacactgtgcatcccagtctaaatcagtaatcatattgtaaagttcctcaggacctgactctgtttcttaagcagaaaataaatgtattgacatataaagggtagctcagaaaattaaagaaatatttgaagaacagttgtggggctggacaaatataagagcacttcaggcatctagggaatagaacattattattaaattatgtaacacactctctatgggataaatcagctaaaatgatcttcagtatttaattactccactccaggttagatcctataggaagtgcaactggacaaacatgaatcacttgcccacctactttctaggaaagcacagaatctcatgatggataattttgctaaatggtccatctatcaaagtgaaattgggagcttttaccagaatacaggaaaagtagattggcaaaagcaacagatttctattacaactgttaacaattttaaaatagtttcgttacaaagctgttgaatccacaacacagctgcaatcttagatcaatattttcagtgtcactcccccacctttaaaaaatctgaatatgacatcaattcatactttagacagttaattagattaagaccactactttattgtggcagaaaaataaagtttaatctgagattttagacgtcttcaaaattagaacagggaggtttggttgatctttgaagaattcattcctaaggtaagtgaaaaataacatctcaatacaaataaatgtatccatgaatgaaaggttagcatgtactcagtatctcaaccctttgttggaatgtgaggaaggctacatccttacagatctgacgttctgagactctcagggcacaggaactgataatactaaggcatatcaggccttcttgctcagtgcatctggggaggctattgtagttctaaggttataaacatgcaaacatatactgtcttcttcaaagctgcctcccccttgtctctcttattggcagcagaaagtagagcagagctacaaatcatgcacagcaatctggagatacggcagggcagcctcgtgtcggagtcgtaaatctgacaccctggccaatcagtgccggcctcattttattcacggcatgttcatcgtgcaggcaataggagcgggaggctgctttctgtccttggcttctaaccacatggttgcatcctggtgtgtttttctatttgtgtatatttgagagaacaataagttatgtttatgctttcctttcaagaaggagagtctatatttttcatccttggacttaatcagagcctaatttttgtaaaaaattcatttacttgaagtacaaagctattgtgtgttgcacttggggtttctttttgtgttgttttgataaagaaggattccaaggccaaagtttcccagtgtcattttaagtaagacctgcaaaatattcagggtcttaggtgaaaaaaaaaataccgagtagaaaaagtactcttccttaccatatgaccactttcagccttgctaggtggaaggaagtggctctgtcaagtccatattccagcagggctcaaaatttacatccctttgcatatttccattaaaaataatataagcttccaattcaaatgtataattttgcataatcattgcttcccatcttctctttgggtcggctaaaataaaagggaggagaaagcatagtttacagaaagtaagctttaaatggttgagccatttaaaatcaccatttttgttagtaaaatatagttcaacactgagtattttgtatgtttcaaagtaatataaaattattctatactaacaatgaaaattagagaataattatgactgaatgggaactaaaaactagatgggaataggtaaatggataaacaagtgtgaagaaagctacacatctcaaggttggtcttggtggtcatgactgtaatcccagcactttgggaggctgaggcgggtggatcacttgaggccaggagttggagaccagcctggccaacatagttaaaccccatgtctactaaaaatacaaaaaaattagctgggttcgggagtgcacaactgtattcccagctattcaggaggctgaggcataagaattgcttgaacctaggaggcagaggttgcagtgagctgagatcacaccactgcactccagcctggatatcagagtgagaacctgtctccaaaaaaagaaagaaagttacatatcccagaatatgggagcttggaaggattttggaatgagtttgtttaatgggtctctgaaggctatggagtcaaagacagtaagccaattagagggcactgggcaaacaggccccaaatagtaatcatatagaactaagccaagtagcaatcctatacccactcttagactataggcatttgttatcctcaagggaaactccaaattgggttcttctgcaaagcaataaacagtttgaggaaagttaagttccgagtgtgggtgttggttctaacagtaagatcatggtctgctacaatttggatgtttttatcccctccaaatctcatggtgaaatttaatcttcaatacagcagtgttgggaggtgagacctaatgggtaatgtctaggtcatagggctccgtgttaatgaatggattattatttttatttttataatggcaataccactaaaaaataactttcaggagtggattctttctcttccactttctgccacatgaggatacaatgttaatctctgtttgttcttgcaccttcttccacgtgaggatgcagcaaaaagccctcattggacaccagatgcaggtgccttgatcttggacttgccagcctccagagctgtgagaaacaaatttatgttctttataaattacccactctgttatttttgttacagcagtacaaaatgcactaggatatagtcattctgccatttggtggaaagtgtaatagctggttagctaacaggtccaggtcagacctcataaaacaccatgtacacagcctggtcaaatgtccaacttagtaaagaaaatcaaatagaaactgtactactgattaaagcaacaaagaaagtacctaacattcttatttcttacagttaagctgtgcttatgaaaagatctagcagtatcaagaaactcagatataagtctactctaaaagaaaacaaataactctgcacacaagtgagaacttagtaaaatccagtctataattaaaaatttgagaaagtattgcattcctaaaatagaaaaagtttggtatgtaaaaaaaaaatcagatagcaacaaaactgtcccagtttaaaatactaagggataaatttttaaagaatggggaaaagataaaaatacaaataaaaatataagatgtaaaggactgacaaaggaggtccctgagtaataagaatcatatatcaaaaaaaagccaactgtcaaataaattatgaaagaaaatttcctagagctgaaaacaggtattaaaatttagattcaaagggctttaaaggcccagaaacatacattttttaaaaagtcaatcatccttaatcatatctttatgaagttttagaactgcaactttttgaaggaaaattattctcaacttagaattctataatagtcagactacaaatcaaatgtaaatcttaaaaaatgtgcaatacgtagaataacattgggcctttgttttaacaaaaccattctttaaaagttacttcagagcttggcttggtagcacactcctgtaatcccagctactcaggaggctgaggcaggaagattgcttgagcccaggagttccaggtggcagtgagctatgatcacatctgtgaatggtcacagcactccagcctgggagataaagcaagactacatctctaaaaataaataaagaaagaaagaaattacatcaggatacgctctggaaaaatcaaagagtatttcaagaaaaggggaacacacaaggtcaggaaacagtggatccaaccatcagagttatgatgagaagcactgaaatggcagctgaacttgtgacctaaatcacaaccatgtggattaaaacaagaggaagcgattcttcatgaaagaggtttacagaaaacgtgaaactacagaatggctagtaagatcaaacatttaggaaaacacaaatacataaggcaaatcatgactaaaaaaaagaggaaagaaagaaaaaaacagttataaattcttggaaaaatgtaacatttcacaaaaagtcatggtccaattttgaagcaatgtaacctgcatgatggtttcaggcaattatgaaagatgatttattttaatgtgatgctaagaaaattctcctgtgtgtgacacaagagtgcagaaattggatcagagacaattaaatgcaatctacctataatactttcttggacaacaaaaaatacttatataattttaaaaagtaaaacagactttagcattaacccaaggacagtgtgtgttaagtctgcttgcagttggaatataaagtaacagttaatatgcaatacctcaacaatataaaagttgaagtgtgactgacataagatagtgtatttacatggaagagagaggagaaggaaagatcatgccaagagaaaatactgtgttaatagtcataatgtaaataattaaaattgcagttgaagtattttaatgttaaaattttaaccaaattataattcattacaatatatttatatgtattattatatataatataatgtataatgtctatttttatatatatagtagtattggagaagaaaatttttaaaagtagtatgagcaaatcaaatccttattgtgcacactgggaagaaagtagaaattttgtacaattgacagatcaagaaatagttgtataattatattacttaagatttttagggtttttcattctaaacagtggaacacaagttgaagaagagggaggcaataaactgtagctttttaatagtgagtttttctgtacagttttgattagttatcagggccatctattactccagtaaatattgaaatagaaaaaaaaggatggaattatatgaaaaaataataatggcctttattgctttatggtgagattacagattttttaatctactttttgcattgaaaacacttgcaataatgtatatatatatttttttgatgataagaaattcagaagtatccacaaataatttttttaaataatatttcattgtctacaatgtgttgtgtaatttgacagaaatttttatgctttttatctattctgtgaaatgatttatccatttgcgttcccacatgaataaactgaggctcactgaaactttttaactaacacaggttcacataaaaatatgccattgcttcaagcctaacttttggcttctcaaaatagctcaccacactctatctccaaaagcttatgacatgtgtagggatgtgactagtaatcttacaaaatagggacctgaaagatttactgcaatttacctgaatgaaaactgatttaacactcactacccacattaagatgattttttaaaaatagctgttaccataattaacccagatttataaatcatctctaaaaaaatctggccccattgatccaattggtttctgcacactcaattactaaagctgaacattctaaatagacttgcctgcccctttgtggttctgttgtgttgaccctacccttgttaaaagtatgtattctttattagactgctcatctttaaatgcctctcttcagcatttgttagttgtgtgacactgatattcccattttgagaccttcattcttcaactataaaataaaaatttaaaaagtactgcagttgaaaatgtcagttgtcttccaaacatctattcatccctttttcattgccaacagaaccccaatttgaggtctggaaatatgatcagctaaatgtatactacatctttctggctgccttaaagctaagggttgccatgtaacagttccaaccaacaaggtgtaagtggaagttggctgtgggtttttgagaaagcttactctttcttgatatgaacaacaaaaaaagaagatatggtttagactgtcctacctatctctgttttacttgcttcaaataaggacgcagtgcaaaaagccaggtctgcaatattgtgagcatgtggaggtaggtgtagtggaaaggacaagagaattgcaaaagttctaactttgatataaacaagatgtcagctgcttaacctttaaattttgtgtgacataagaaaaaataatgggtctaagccagtagaagtggccttctgccatttgtggcctaattaattgctttctctctctctcttttttttttttttgacaggattttgctctattgcctaagctggagtgcaatgacatatgattgcttactgcagcctccaactcctgagcttaagcaatcctaccacctaaccctcctaagtagctgggactacaggtacttttcaccatgtctggccaatttttaattttttttattttgtttttgtacagacaatgtctggctctgttgcccaggctgatcttgaactcctggcctcaagccatcatcctcctttggcctcccaggtgctgggtttacagggtgactcactccacccagatgtggccaaatgaatttctaatggattctaatgtctttttcacaggattaaatcaaacaatacatataaataattaagattagggccaagtacatagtgcataataattattggctacaatggggttaaaggaggaaattttaacatggcatagaaatttgcaccttgaaattcagcctttttatctcattgctcaggaaacaaatgttcagagcatgaaatcacttgatcaagataattcatgtgatctttatttctcttcataagttactattatgaaatgtgctatttattaatcatctgctatgtaacaggtgttccacaaaagtccgggtatagagtaatgccctcacaaaacttccttatagtgtcacacattctgggtctaaaacttgaattaaacccatttaagatttaattacatcaaatattaaaaagtgttgatactcaggtttagcttgaatcttagcagacaggatatggtctaattaaaccactaactacatctgctatttatatccattaactttaattttatagtgtagttcatagaaccaaagaaatggctgagatgccaggcttggttagggtagaaacaacggctaatccaatcatccaggtcgtaggagtcagcctaacctcagcattgacactagactatatcaactccaactcttgttttttctgttcttgaattcttccacttgactcagaaactagaaggggctggggaacgggatggattgttctaatttgaatgacatattcactccttggctaagagaggtacatcaccttgactgacagtccaccatattgctcacaatgggagtgaagttactccccaggaggagattagtgtgccacctccaaaagaaagtggaatgcagaacaattacctatgcaattactgaaaccagagctctagcaaaaagtataaaataaaaatgagagactatggaacttagataacaccctggttctgaatgggaggggggtggtagagctcaaaaagaaaatattagaaccctagccaagtcccagaattaccttagtcagtccctgtgtatcagcctgtggtattttgtgacaggaaaggaaaaacagtaaccctgccttcttactctttttggtataccttaccaattctcttttatattccaagaagttcttgcctgaaatatgtaacagttaagtgttgtttttctccttgcttatattgactttgtgaaaagagcttatgaaatgtagtgttgctcagtcttagaaaactaggccaggtatccaattagcatatctctcttgctcacaggactatcaggatgattaaggagtgttccttctagcagagaaaaaggtcttctgagctgggagtcagtttgacagactagtctttcattgacccccttcagctctcctttattttacccttgatttttaaggagggtgcttttactgttctttatatcactcttgctgtcattgttactgcagttgagaatgctttgattccccctctgtgtttaaattctttatcttcttctatttcacacattcaatgttgtagccaattgccaattctgtttgggcaattcaatgatgcataacacttttaagcagagtataactgaaagggcaaacttttgtaaaagattattattaaagataaacactttggatggatggatggatggttggatggatggatagatggatgccacaggttctgtatactgtgcagaaccccttatgctcatttctcatttctgagtgtcttttctcctgtttcagtgtgtcattgatctcaatcagctgtacctcaaagtcatatttggcacactctcctagggcaactgggacacttcccatagtcatgggcaaccagaagtgcttgggagtttacatcagtctctcaccttgaggacttcaatcagtggctgtatgttgtggaagtataaagtcccaggatctgatgagatcagaatgaagctacatttaatagggcttggcctgaaatcatacccttgcttggcttcttccccttcagtgtcatgtgcaaaatcccaagaaaagaactagttaatttgtctaagaacctcagaaaacactggcacagatagtgaagaagaggaaaagtagtataagatgaagttggaaagagacttaagagtcagatcatgccaagacttataaggagtctgagtattattcaaagcatcgcagttcacatctactagccttttctccttcataggaaaaactgcaatcaagaatggtagccacaatgggtagttgccatggtagtgaggacaagtagccaatatttacggtattgtcattgctggtaaaggaagcatagggtatacaactaattttctaatgcaattgttgcaattgttagccaggttgtaccaaaggaatcttcctattcttcatcacaaaataattatccttaaaaagagcttggaatcaagaatccagagatatagtgctaatattcaagagttttcacattatgctaaatttagccaaatgttgcaaaatcatggttaagttgacataggcccctgtctaagctgcaactcttggttgaacacatcaataatggtgtttaagcatcccaaattcgactgatggcagagaagccaaattgatcattttgatgtaaaatgaccttcatttgcttctgttatggttctgttctctagggaagaacaaataatttctaacctatgcttagctaggatgtgacactttattatcaatttattgataaggattatggtgtactatagattattatttatttatcttatgttagtttatcaccacttataatctgctaacttttctaaaaagtatcaatagaattagttttattttttcattgcattaagaagcacatttttaaataatctgaaattgtttttacataaacataatttatctaagatttagattttaataacactacattttgttagtgcagacttggcctccatgcttactaaaacataggtagtttaattagctgatcacaatatggaatatgactattagacgagaatatgttttaaaatttgttttaatatcctgtaagagaaggcaaatcaacaagcatgtggagagaaactcttttcttgatctacttacttttaaatatattttggcacataggaccattattcacaggatccaatttatttcaacttacaacttattagtaataataatatatgtagctttatatctttatgtgaaaatcccaactatgacttaagtgtgagtgtcatatcctgcaatttcacagatacttagaagtgatagatgaaaatcatatatattcttcttgtttactgaagatatttaacaccagaaaaagattaaggaaaaagaaacactctccatatgtattcatacatttttaatgagaaaaaaagaaataagctctgtcaaagtgctatttgtagctatttccaaatttaattttatgttttaaaaagtttttgaagtcccacctaagataacatctgtgaggccagaaataaataaaatccaagtgtatttaaaagaaactaaggattaaaaggtgagcagaacctgaagtggataaaaatttgtcttttcaatttacttggtgttcattttgggaaattagcctcgtgacccccagcctaaatgacatcatccagtgaggttgctaaatcagtgtgataagacccctggaattgaggaagtttcaagaaaggatgctgaaaatctaccatacattgagttactgtagattaatggttcatggcattatcttatttactcctaagaacaactgtatacattagatattattatcttcattttatagaagagacaccaagtgttggagaggctaatgacttaacatagctattaatcagcagaggtacatttaaaatctgaatccaaatccagaaatcacaaagctagcatatcccctctagtaccagcctggtaattgtgatttatgtgcttaataagaaatcagatctgttttcatgaacactatgtttaataaatcatcttattgaatcagaggtcctaactgtctagcctgaactaaccaactgggttctagtaatcaagcaattaaagacaacagtttggaattgtaggtgacataaggcaggtaaataagaaggaatcattcctggttttgcatagccacatacagagcacagtgcctagagcagagcattgcagatccattgaatctgcttttaagatccatctagtgtgcctagaaaagaaacaggaaagaaatcacaaactgttaacagatagaataatttactaaaaatgtcatactgcctgtcactggtttattataagtagcataattcaaatgaaacctacatgggctccaaaatgttacacctagaatacagcaagatttgaccatgactaccctaaatgatatatgatcagtccattttcctttgctataaaggaatgcatgagactaggtaatttataaagaaaagaggtttatttggctgacagttctacaggcagtgcaagcatagcaccagcctctgctcagcttctggtgaagcctcaggaagcttttattcatgacagaaggtaaacagggagcagacatgtcacatggggagaaagagaggaagagagaaggcaggccaggctctttaaacaaccagctctcacgtgaacccgagctcactcattactgtaggaagggcacaagcaattcatgagaatctgacctcatgacccaaacacctctcattaggccctacctccaacactggggatcatatttcaacataagatctgtaggggacaagcatcaaaactaaatcaatatagttcaccaaacatatgcacagtgattcttagtcaacatcaggttggcagatctaccctgtgagatttatctagctatttaataactgccaacatactactttttaatctgactttaaatcaaatcatcacgtatatcataccagaaagcaaattagaattacatgttattaatttaccaaggaaagccatgtgccaaaaacatcttttggaatacaggaaaattgatcagaaatttaacttctaatttaatattggttccccatttattggtagtaaactataaatgctaatatccgatggtaggattaggatgagactctttgacctagaacaagaggatgaggcgtttgcgctcagctttgtagaaagctttgtagcttgggaacaaacaaatgctcatcattagcggttcagtttcttcaacttctctttctctttttcttcgcctatcaatcttataaggtttgtttctctcctgttccgttcaaagatctttgctctaataaaaagcacaatttaagaagttttctcattctggatatactttttactgcccaaagtacagcacagagaattaagttttcaaaaaccaagtgatatagaagaaagaaaaagagattaaagaacatgaaagtgctacagagactcaataaaatatatgtagtttttttaactctgaattttcctcttttgaagacaaccaaaatcttttaaaacacattatcttaaactattttttatttgtatcagttctccattaagttatgaatatatatttttaaaacagctttggaaaaatacattttctgttttattttgttctacaaaatatagatagaatacttctccgaaagatactattttcctagtacacaggatatgaaatctcagaaaagtataaaaaaagaatacaaagcttataggcttgtgatgggacttaggagaaaagtttggacaaagggacaagcatacaatgcatcttccttctcttcagacagaaacagtattaataccaaaagaatatgtaaaagtgagcaattccctctgtattcacacaatccaagcgagtgtgaatgataatgggatcttgaatctctcgtaccagacatcagtaaaaaaacaactatgtcctgtcagccttataacaaaggagcttattaagataaatgatacttttaagataacatctaccataatatgctacacttggtattcaaatgtaaaacaagccaaagtcaatatatccattgttctccctcttaattctttgccttaatctccttcacaacaaataaaattgtaaagcaaatcaactgctcaaaactaacagtgccacttgtcctatgtcaaaatttgtctaggacagtctaaattcaaatattcaattcttctatggacaatgcaaatttatttatatcatgcttccttttaacaaccttgataggaatttcaaaacactggagattaactgagtaaattatgattcaactctataatatatagtatgcaactaaaaagaatatctaatgataaaagaaaatatttaattattttgctaaatgcaaaaagcaagtttcataattttatattcaatatgtctacattttatagaactatacagatataatgaaagaccacaaggtcatatgccaaaatattaatagtaattttttaaaatgatagacttccaggtatcttatatgattgacttgcatttcttttgatctcaatcagagtagttgaattattttcttgtgaaaatgtactatccttgtttttgtttctgtatgttttctctatgtaaatcctagcttttcaaataaccattcaaattcttatgctttgtattttattttcctgaacataccagctaatgtaaaataatctttctttccaattcttgaaaccaaatgtaagctccttaagggaagaatctataacaatttgtacttcccacagcaactatattagcagagaaaaatgatttggtaaataaatacctgtgagattaaaaagaaaatcttaaggatgtaatgagatttgcatacacacagacacactctcacactttctttaagaggaggctcttcagtcctatttatttcacccaactctcatcaagttgcagactctgaaccaaaaggaatcttaggaaccctccatactgtgctgatttctcctccgtaatagtctctttgcatccagctgggcttgaatatcttcagccacagaaaaatcacttaacatatggagctcattctattgctacatatgtcctaaatactaaaacattattttaatgcttagccacaacacacacatgcttaaatttaaaaaaaaaaaaagtcagtaccatcccctaggtaatcatgtttgtaacactttaatgagtttaaggcctgagctctaaattataatcaaatgttaagttaaaaaaaatgaagcatatagaattttctgctttcttcatgttgattgcttccttatacttccttattttcaatatgtatcttacttatttaaggtatattttaaaatttaatgtgatggcagaaaacaaaatatgaaaacaatgcatactattatatatttatcaagatttgtgtaatttagaccatcatttgaatcttacttcttatatttcgatattttaagaattaagcttatataggtaaagaccaaggttacagttttactataataagttatataaaaaacaaatatattgaagcagagcacagcaaacttttcctgtaaaggacctgatagtaaatattttcagctttgggaactatacaatccctgctacaactattaatctctgtcattatagggcaaaagcagccacaaataacatgtaagtgaatggcgtgtctgtttagctgtgttccaataaaactttatttattaaaaacaagcaagatttgaatttggcctgatgtaaacatagtttgataatccctatactattgggattactcatgccattgtcctaatgaactacatagtttaaatctattccatcaataaggctatgtgcatcaggatttattcaattgaacgtgtatttgttaagctcatcatataagctcagcattgtaatcaatcaggctttatacagtcttatttaagattgcctagaaaaacagactaaagattatgcaacaaatttgagacatccaagtggcaaaaccaagtaattcaacatgaaatatttatttgaggatatgaaaaaacaaatgtacatgcgtgtgtatgcacacaggcacctgtaacaatagccttgttttcctctcttaggaagatataaataaaagcttaaatggctttcatgagagtagaagagatatcatgttatttcgttctctttttaaagcattctagaataaataaacagtagttgccagaggacctactataagcaattctggacttgacccccaaaaatgttacctctcaaaatatttctgaaggatgagctgaaggggagtaaacagtgacttaaaatctgatagtagacacttttcatgatccttgaacaaggatctatcattatgccttagtgtacctctggttcataactttgacacacacaatgattattcctcagtggtaatgaaatatttattaaatacagataatatttgatagggtttagatatctgtcccttttaaatcagctcatgttgaaatatagtccccagtgttggacgtggagcctgatgggagatgttcggatcaggaggtggatcactcatgaatagccttgtgccatctttttggtaatgagtgaattctccttctattagtttacctgagagttgctgtttaacccattctccccaagaatattcgctggtggtgcttgtggctgcagagtttaccctgagataactcgtgggttacagttctaaccttacccccaaagtttgccagggaatatctcaattttattattattttcacattgctctaatatatcaacttgggaaacaaaatacatcattctatttatagcattctgtttttagtagtggtatttctatttacaaaatatagtaattctcaattgctgaaaatgtcaaattctatacaacatagaattcgacattttctgtgttgttccatgcttcaaaatttgaaatttactaacagataaacattattaaatactgatcgtcatatacatttctattacattaagattagagacaagttctgtttacaaataactccaagaacagtttttagattttattttcacattgaaaatcaattagatttgctcctacctcaaagagcatgtttgtgtaaaattaaatgagtactggcagtgagctgcactttttttttctaaatgagaaatgggttaaaagagtgttgcacctcttcctctcactcattccctttcttgtcatgtgacatgcctgctccctctttgcctcctgccatgagtaaaagctgcttgaggtctcaccagaagctgagcagatgctggtgccccacttgtatagcctgcagaactgtgagccaaataaccccctctttttaaaaaataaattacccagcctcaagtattccttcatagcaatgcaaaataaactaatacagaaaattggtactaagagtgggctcttgtataaagatacctgaaaatgtggaagcatctttgttactgggtaacagtcagaggttggaagagtttgaaggtctcgaaagaagacaagagagaatttggaactttttagagacttgttaagtagttgtaaccaaaatgctggtagaaatataaacagtaaaggccaggctgatgaggtatcagatgaaaatgagaattttttgaaaactggagcaaaattcacccttgttacatcctagcaaagagcttggctgcattgtgtccatgctgtagggatttatgggatgtttaacttaagagtgttgacttaggatatctgacagaagaaatttctaagcagaaagcattcaaggggctgtgtggctgtttctaacaaactacaacaagatgttggaacagatgtattacttaaggttaaaaattataataaaaagcaaagcagagtgtacaaatttggaaaattcataatctggccatgaggtagacaaagaaagacagttttcaggagaaaagcagaagcagctgagaaataaccaattgctagagagacttgcatgactaaaatggaaccaagtgctgatagccaagacaatggaaaaaagaccttgaagacatttcagaaatcttcaggagagtccctgccatcacaggcctagaggcctaggaagaaagaatgcttctggggacaatgcctgggagaccactgctctgcaccacctcaggagagtgtgccctatatcctggctgcttcagccccaaccaaagctgaaagggcctgggtatacctaagctcccattatggagagttcaagccactgtaagcattggcagcttctacatggtgttaatcctgtaagtgcacagagcacgagagtgaaggcttagtaacttccacttatatttcagaggatgtattggaaaggctgggtacctaggcagaagcctgctacaggggtggagcccttgcagagagcctatactaggatagtgccaaggggaaatgtggggttgcagcccccacacagagtcaccacccgggcaatgcctagtggatttgtgaaaatggggccaccacctttcagatcccagaatataccttgagcctggaaaagtcacaggcattcaactccaacccgttacagcagccacatgggcttcaccaaataaagccatggaggcagagctgcagagctgcccaaggccttgggaagaccacctgtcatttttctccaatgtagtagtttctccaataacccatggtacctcccaccaagacctgagtcctcaaaatatctattgaatggttgtactcttaggggtgtagttataataataatgatatacttcagtattaaattttaaattttatggagtaatgataagcaataaaaataaaacaatacttcttccttgtttgctaaattacaagtagcaagccattcaggggaggagccaagatggccgaataggaacagctccggtctacagctcccagcgtgagcgacacagaagacgggtgatttctgcatttccatctgaggtaccgggttcatctcactagggagtgccagacagtgggcgcaggtcagtgggtgcgcacaccgtgcgtgagccgaagcagggcaaggcattgcctcacctgggaagcgcaaggggtcagggagttccctttcggagtcaaagaaaggggtgacggacagcgcctggaaaatcgggtcactcccacccgaatactgtgcttttccaacgggcttaaaaaacgacgcaccacgagattatatcccgcacctggctcggagggtcctacgcccacggagtctcgctgattgctagcacagcagtctgagatcaaactgcaaggcggcagcgaggccgggggaggggcgcctgccattgcccaggcttgattaggtaaacaaagcagcctgtaagctcgaactgggtggagcccaccacagctcaaggaggcctgcctgcctgcctctgtaggctccacctctggggacagggcacagacaaacaaaaagacagcagtaacctctgcagacttaaatgtccctgtgtgacagctttgaagagaacagtggctctcccagcatgcagctggagatctgagaacaggcagacggccttctcaagtgggtccctgacccctgacccccgagcagcctaactgggaggcaccccccagcagggacacactgacacctcacacggcagggtactccaacagacctgcagctgagggtcctctctgttagaaggaaaactaacaaacagaaaggacatccacaccaaaaacccatctgtacatcaccatcatcaaagaccaaaagtagataaaaccacaaagatggggaaaaaacagaacaaaaactggaaactctaagatgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccaatgcgatcaactggaagaaagggtatcagcgatggaagatgaaatgaatgaaatgaagcgagaagggaagtctagagaaaaaagaataaaaagaaatgagcaaagcctccaagaaatatgggactatgtgaaaagaccaaatctacatctgattgatgtacctgaaagtgatggggagaaaggaaccaagttggaaaacactctgcaggatattatccaggagaacttccccagtctagcaaggcagcccaatgttcagattcaggaaatacagacaacaccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctcttggcagaaaccctacaagccagaagagagtggggaccaatattcaacattcttaaagaaaagaattttcaacccagaatttcatatccagccaaactaagcttcataagtgaaggagaaataaaatactttacagacaagcaaatgctgagagattttgtcaccaccaggcctgccttacaagagctcctgaaggaagcactaaacatggaaaggaataatcagtaccagccgctgcaaaatcatgccaaaatgtaaagaccatcgagactaggaagaaactgcatcaactaatgagcaaaatcaccagctaacatcataatgacaggatcaaattcacacataacaatattaactttaaatgtaaatggactaaatgctccaattaaaagacacagactggcaaattggataaagagtcaagacgcatcagtgtgctgtattcaggaaacccatctcacatgcagagacacatataggctcaaaataaaaggatggaggaagatctaccaagccagtggaaaacaaaaaaaggcaggggttgcaatccacgtctctgataaaacagactttaaaccaacaaagatcaaaagagacaaggccattacataatggtaaagggatcaattcaacaagaagagctaactatcctaaatatatatgcacccaatacaggagcactaagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctgcagaactctccaccccaaatcaacagaatatacatttttttcagcaccacaccacacctattccaaaattgaccacatactgggaagtaaagctctcctcagcaaatgtaaaagaacagaaattataacaaactatctctcagaccacagtgcaatcaaactagaactcaggattaagaatctcactcaaaactgctcaactacatggaaactgaacaacctgctcctgaatgactactgggtacataacgaaatgaaggcagaaataaagatgttctttcaaaccaacgagaacaaagacacaacataccagaatctctgggacgcattcaaagcaatgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagaaaaaagagagaagaatcaaatagatgcaataaaaaatgataaaggggatatcaccacggatcccacagaaatacaaactaccatcagggaatactacaaacacctctacgcaaataaactagaaaatctagaagaaatggataaattcctggacacacacactctcccaagactaaaccaggaagaagttgaatctctgaatagaccaataacaggagctgaaattgtggcaataatcaatagcttaccaaccaaaaagactccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgaacaagtgggcttcatccctgggatgcaaggctggttcaatatacgcaaatcaataaatgtaatgcagcatataaacagagccaaagacaaaaaccacgtgagtatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcgaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccacttctcgaggaaataaaagaggatacaaacaaatggaagaacattccatgctcatgggtaggaagaatcaatatcatgaaaatggccatactgcccaaggtaatttacagattcaatgccatccccatcaagctaccgatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaagaactccctatttaataaatggtgctgggaaaactggctagccatatgtagaaagctgaaactggatcccttccttacatcttatacaaaaatcaattcaacatggattaaagacttaaatgttagacctaaaaccataaaaaccctagaaaaaaacgtaggcattaccattcaggacataggcatgggcaaggacttcatgtccagaacaccaaaagcaatggcaacaaaagacaaaattgacaaatgggatctaattaaactgaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaaacaaacaaccccatcaaaaagtgggcgaaggacatgaacagacacttctcaaaagaagacatttatgcagccaaaaaacacatgaaaaaatgctcatcatcactggccatcagagaaatgcacatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgtgtgtatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagtcatcaaaaatgatgagttcatgtcctttgtagggaaatggatgaaattggaaatcatcattctcagtaaactatcttaagaacaaaaaaccaaacaccgcatattctcactcataggtgggaattgaacaatgacaacacatggacacaggaaggggaatatcacactctggggactgttgtggggtggggggagtggggagggatagcatcgggagatatacctaatgctagatgacgagttagtgggtgcagcgcaccagcatggcacatgtatacatatgtaactaacctgcacaatgtgcacatgtaccctaaaacttaaagtataataaaaataaataaataaataaattacaagtagcataaactaagatggatgtgtagatagatacataggccccttgttatgttttcttatctttcagaacaaaaaagtagacaagtttcctagtcaagatattccttagctacagcagtcacaggaaaattatagcacatgttacctctaatcatatatctgtctatagaatgattcatcctgcatgtttctaacagagcgatcattgctcagcacaaccctgctcatttaattactcctcagaatcctcaagtggctctcaatacttccaaaatacaagtcaaatcaggtttgcctgtcttccaaactcctcaacaattcaactctcagccatctttcattttgaaacacaggttgttttggtagaatttacataaaataaaatttactctttttgatgtataattctatgagttttactaacgtatatagtcatgtgactacaaataaaatcaatatatagaacattttcatcacctgaaaatgtaaccttctgcctctttgtaggcattcatctccctcagtcctagccagtggcaaccactgacttatttcttgtccttcaacttgactcctagaaactcatgtaaacggaatcataaaggatatagccttttaagtacgtattgtttcactaacttaatgtatttgagatttatccatattgttgcttatttagtaggttgagcctttcactttttattgctatcattccattatatggataggccaaagtttgtttaaccatttgtccattgagagatatttatgtggggatttgctgacaagatggccaaataggaaaagttccagtctgcagctcccagcgagatcgacgcagaaggtgggtgattcctgcatttccaactgaggtaagcagttcatctcattgggactggttggagagtgggtacagcccgtggagggcaagccaaagcaggatggggcatcacctcacccaggaagcacaagggttgggggaattatctccccgacccaaggaaagcagtgaggcactgcaccatgaggaatggtgtgctctggcccaggtactgcacttttcccatggtctacacaacccacagatcaggagattccttctggtgcctaagccaccagagccctggatttcaagcacaaaactgggtggttgtttgggcagataccaaactagcttcaggagttttttttcaataccccagtggcgcctggaacaccagtgagacagaatcgttcactcccctggaaagggggctgaagccagggagccaagtggtctggctcgggggatcccacccccatggaggccagcaagcttggatgcactggctggaagttctcgctgccagcacagcagtttgaggttgacctgggatgctcaagcttggtgtggggaggggcctctgccaatgctgagacttgagtaagtggttttacccttacagagtgaacaaagctgcagggaagttcaagctgggcagagcccaccgcagctcagcaaggccatggtggccagactgcctctccagatccctcctctctgggcagggcatgtctgaaataaaggcagcagccccagctgcttatagataaaacctccatatcccagggacaatgcacctaggggaaggggcagctgtgggcgcagcttcagcagacttaaacattcctgcctgacagctctgaagagagcagcagatctcccagcacagagtttcagctctgctaagggtaagacttccccatcaagtgagtccctgacccctatgtatcctgactgggagacacctcgcagtaggggctgacatacacctcatacaggagagctctggctagcatctggcaggtgcccctctgggacgaagcttccagaggaaggaacaggcagcaatctttgctgttctgcagcctccactggtgattctcaggaaacagggtctggagtggacctccagcaaactccagcagatctgtagcagaggggcctgttagaaggaaaactgacaaacagggatagcatcaatatcaacaaaaaggacgtccactcagagaccccatctgaaagtcaccaacatcaaagaccaaaggtagataaatccactaagatagtgagaaaccagtgcaaaaaggctgaaaattccaaaagccagaacacctcatctcctccaaaggatcacaacttctggccagcaagggaacaaaactggatggagaatgagtttgacaaattgacagaagtaggtttcagaaggtgggtgataacaaactcctccgagctaaaggagcatgtttaacccaatgcaaggaagctaagaacctggaaaaaaggttagacaaattgctaactagaataaccagtttagagaagaacataaatgacctgatcgagctgaaacacagcattaaaacatcctgatgcataaacaagtatcaatagctgaatcaatcaagcagaagaaagcatctcagacattgaagatcaacttaatgaaataaagtgagaagacaatattaaagaaaaaagaataaaaaggaatgaacaaagcctccaagaaatatgggactatgtggaaaaaaactaaatccacatttaattgttgtacctgaaagtgacggggagaatggaatcaaattggaaaacactcttaaggatattatccaggagaacttcaccaacctagcaaggcaggccaacattcaaattcagaaaatacagagaacaccacaaagatactcctcaagaagagcaaccccaagacacataattgtcagattcaccaagattgaaatgaaggaaaaattattaagggcagccagagagaaaggtcgggttacccacaaaggaaagcccctcagactaacaggagatctctcagcagaaaacttacaagccagaagagagtgggtgccaatattcaacattgttaaagaaaagattttcaacccagaatttcatatccagccaaactaagcttcataagtgagggagaaataaaatcctttacaaacaagcaaatgctgaaagattttgtcaccaccaggcctgccttaccagagctcctggaggaagcactaaacatgcaaaggaacaactggtaccagtcactgcgaaaacataccaaattataaagaccgtcgacattatgaaaaaactgcatcaattaacatgtaaaataaccagctagtgtcataatgacaggttcaaattcccaaataacaatattaaccttaaatgtaaatggcttaaatgtcccaattaaaagacatagaccggcaaactggataaagagtcaagacccatcagtgtgctgtattaaggagatccagctcatatgcaaagacacacataggctcaaaatacagggatagaaaaagatttaccaaacgaatggaaagcaaaaaaaaagctacggttgtattcttagtctctggtaaaacagactttaaaccaacaaagatcaaaagagaaaaagaagggcattacatattggtaaagggaccaatgcagcaagaagagctaaccatactaaatatgtatgcaccaaatactggagcacacagattcataaagcaacttcttagagacctacaaagaggcttagaatcccacacaataataatgggagactttaacaccccattggcaatattagacagatcaatgagacagaaaattaacaaggatatccaggacttgaactcagctctggaccaagcagaactaatagacatctacagaactctccaccccaaatcaacagaatatacattcttctcagcacctcatcacacttattctaaaattgagcacataattggaagtaaaacatgcctcagcaaatgcaaaagaatggaaatcacaacagtctctcagaccacagtacaatcaaagtagaactcaggattaagaaactcactcagaacagcaaacaacatggaaactgaacaatgtgctcctgaatgactactgggtaaataacaaaataaagacagaaataaagatgttccttgaaaccaataagaacaaagacacaatgtacaagaatctctaggacacatttaaaagagtgtttagagggaaatttatagcactacatgcccacaagagaaagcagaaaatatctaaaattgacacactaacatcacaattaaaagaactagagaaggaagaacaaacaaattcaaaagcagcagatgacaagaaataactaagatcagagcagaactgaagaagatagagccatgaaaaatacttcaaaaaatcaatgaatccaagagttggttttttgaaaagatcaacaaaatagactgctagccagactaatagagaagaaaagagagaagaatcaaataggcacaataaaaaatgataaaggggatataaccactgatcccacagaaatacaaactaccaccagaggatactataaacacgtctatgcaaataaactagaaaatctagaagaaatggataaattcctggacacctacaccctcccaagtctaaaccaggaagaagtcgaatccctgaatagaccaataaaaagttctgagatggaggcagtaattaacagcctaccaccaaaaaaaaatcctggaccagacagattcacagctgatttttatgagggatacaaagaggagctggtaccattccttctgaaactattccaaacaatagagaaagagagaatcctttctaactcattttatgaggccagcatcatcctgataccaaaagctggcagagacacacacaaaaaagaaaatttcaggtcaatatccctgatgaacatcgatgcaaaaatcctcaataaaatactggcaaaccaaatccagcagcacatcaaaaagcttacgcaccatgatcaagttggcttcatccctgggatgcaaggctggttcagcatactcaaatcaataaacgtaattgatcacagaaacagaaccaatgacaaaaaccacatgattatctaaatagatgcagaaaaggccttcgacaaaattcaacaacgcttcatggtgaaagctctcaataaactaggtattgatggaacagatctcaaaataataagacctatttatgacaaacccacagccaatatcatactgaatgtgcaaaaactggaagcattccttttgaaaactggcacaagacaaggatgtcctctctcaccactcctattcaacacagtattggaagttttggctagggcaatcaggcaagagaaagaaataaaatgtattcaaataggaagagaggaagtcaaattgtctctgtttgcagatgacatgattgtatatttagaaaaccccaacatctcagcccaaaatctccttaatctgataagcaacttcagcaaagtctcaggatacaaaatcaatgtaccaaaattacaagcattcctatacaccaataacagacaaatagccaaatcatgagtgtactcccattcagaattgctacaaaggcaataaaatacctaggaatgcaactcacaagggatgtgaaggacctcttcaaggagaactacaaaccactgctcaaggaaataaaagaggacgcaaataaatggaaaaacgttctatgcttatggataggaagaatcaataacatgaaaatggccatagtgcccaaagtaatttatagattcaatgctttccccaacaagctaccattgactttcttcacagaattagaaaaaaaactttgaatttcatatggaaccaaaaacaaaagtccacatagccaagaaaatcctaactaaaaagaacaaagctgggggcatcatgctacctgacttcaaactatactacacggtgacagtaagcaaaacagcatggtactggtcccgtaacagatatacagaccaatagaacagaacagaggcctcagaaataacaccacacatatacaaccatctgatctttgacaaacctgacaaaaacaagcaatggggaaagaatttcctatttaataaatggtgttgaaaaaactggctagccatatgtaagaaactgaatctggactttccttacaccctatacaaaaattaactcaagatggattaaaggcttaaatgtaaaccctaaaaccataaaaaccctagaggaaaacctaggcaataccattcaggacataggtgtagacagagacttcatgactaaaacaccaaaagcaaaggcaacaaaagccaaaattgacaaatggaatctaattaaactaaagagtttctgcacagcaaaataaactattttcagagttaacaggcaacctacggaaagggagaaaaaatttgcaatctatccatctgacaaagggctaatatccagaatctacaaagaacttaaacaaatttacaagaaaaaaactcagtggccaaaggctatgaacacacacttttcaaaagaagacatttatgcggccaagaaacataaaaagcccgtcatcactagtaattagagaaatacaaatcaaagtcacaatgagataccatctcctgccagttagtatggcgcacattaaaaagtcaggaaacaacccatgctgtaaaggatgtgaagaaatagaaacgctatacactgtttttgggagtgtaaattagttcaaccattgtggaagacagtgtggcaattcctcaaggatctaaaactagaaatcccatttgacctagtaatctcattactgggtatatagccaaaggattataaatcattctaccataaagacacgtgcacatttatgtatattgtggcactgttcacaatagcaaagacttggaacaaatccaaatgcccatcaatgatatactggataaagaaaatgtggcacatgtacaccatggaatactatgtagccataaaaaggataagtttatgtcttttgcaggtacatggatgaagctggaaaccatcattctcagcaaactaacacaagaacagaaaatcaaacaccgcatgttctcactcataagtgggagttgaacaatgagaacacatggaaacaggaaggggaacatgacacactggggactgtcgggagctgaggggctaggggagggacagcattaggataaatacctgattagatgatgagttgatgggtgcagaaaaccaccatggcacctatatgtcttttgtaacaaaactgaacgttctgcacatgtaccccagaacttaaaatatattaataaaaaatatatttatgtttctacatattgacaaatatgaataaattgttattaaaaattgtgcacaagattcttcctaaatatgttttcactgttcttgagaaaatgcctaggtataggatttctaagattttatgaagtcaaataaaaactctaggaaatcaccaaactgttttccaaattgtttttaccactttacatttccaccagcagtgttccgcatcttccagttgttccacatcttcactagaacttagtattgtaggggtttttttgttccctttaactttctaaagctgtgtaatggtaccacattaatctcattgtgattgtagcttgcatttttcaaatgacattgagtatcatttaatgtgcttattatatattgtcaaatgtcagttcaatattttgccaggttttaattggattatttttctcattattgagttttaaaagttatttacatattcctaataggcatcttgtattaagtatgcatttttcaaatattttctgggtcatttctttctcaacaatatcttttaaagaatgaatgttttaaattttgataaagatccatttatcaatattttttatgaattttaattttggtgtcatatttaagaattatttgcctaacataagatcacacaaatatttctgagtattttgtttctcgaagttatttaatgacatggtttggctctgcgtccccacccaaatctcatcttgtggctcgcataattcccacatgttgtgggagggacctggtgggagatgattgaatcctgggggctcgtctttccagtactgttctcctgaccatgaatgagctcaaaagatctgatggttttaaaaacaggagtttctctgcacaagctctctcttttcttgatgccatccatgtaagatgtgatttgatcctccttgccttctgccatgattgcgatgcctccccaaccatttggaattgtaagtccaataaacttctttcttatgcaaattgcccagtctctgacatgtctatcagcagtgtgaaaatgggctaatacatataattttctgttttatatttagatgtacaatttattctgatttaaatttttgtgtgttatagatcaagtccttttctttttgtctttcattcattactatttttatttttgcatatagatgaacatttctttcaccacaacttattggtgactgttctttagccactgatttgcctttgtgtctttttcaaattgatcgtacatgggtgagtgtattcctgatacattcatatttgtgtctgtccttttgctaaaacaatgctgtcttaattattaatattattcatattatgcctctttaataaatcacttaatgtgaatcttccaacttagttcttttaaaaaattgtttattccactttacttaaatgtgtatgtatccatcaacagagctttaaagtacgtcgtgtaaaatctgatacaattgaaagaagaaaccaacaaatgcacaattattcttaggaacctcagcactctcttttcagtaatttatagaacaaacaaatgaaatcagcaaagatatagaagacttaaaaaatactgtcaagtaacttgacctaattgacatttagagaacattccatcaaacaaaagcaatatctatctatctatctatctatcatctatctatctatctatcgtctatctatctatctatacacttttcaattgcatatggaacgttcaccaaatagaccacagtctgggacaagggtgttcaactataaaaaaaaatcattcaatgtgatccacataaaagcagactaagcaaggaaaacaacacataatcatatcaatatacaaagaaatgcatttgacaaactcaaaattcatgtatgattaaaaaaaattctccacaaacctagaaggtgatttccttaatatgaagaagaatatctatttaaaaatttacagctaacattatacctaatggagaactgctgaatgactacctctattggaaagactaagcaatgaaaatacacttttagtactcctattcaatattacagtgcttccagtcctagcaagtgcaagtaagtgcaataaggaaagaaaaaagattttaaaatgcatgcaaattgaaaaggaagaagtaaaaaaaaaatccccagtgatagactagatgatcatctatgaagaaaatctcaaaaaaatctacaaaaaagctctcagagttagtaagtgagtttagtacgtttgtggcataaaagtttgacataggaaatcaatcattattttatatattaataattaacaattgaaaaccaaaatactaatactaattatcatatttctttaaaaatgatatatgtaagtatgaatataacaaaacatatttaagatatatatatggtgatatggtttggctctgtgtccccacccaaatcttatgtggaattgtaatcccaaagtgtggagggagggaccaggtgagaggtgatttgatcatgggggcaattacttcagctgttctcatgataataagtgagatcttactagagctgatggttttaagtgtggcacttccttgctcttttcctctctctcctgctgccttgtaaagaaggtgtttgcttctccttcacattctgccatggttgtaagtttccagaggtttttccagtcatgcagaactgagagtcaattaaacttcttttatttataaattacccagtctcagatagtctcttcatagcagtgtgaaaatgaactaatacatatggtaaacattacaaaatgttaacaaaaaattaaggaagacctaaataaatggagagacataccacaggtatgaactggaaggctcattatagttaaaaagcaattttctataaattgatttctagatttaaggcagtttaaattaaaatattctcaggattctttttagatatcgacaattttattatgaaatgtgtacggaaagttaaaagcagtagaataggcaaaccaatttggataaagaacaaggttgaacgccttacactacttgacattacaaaatacaaaatttagcccaggaaaagttggacatgtagaccaatggaacaaagtacagttttacaaaatagcctgtacaaatatggccaacagatttttgaaaaaggtgtaaaggtaattaaataaaaatctttttgagaaatgattgtagaacaattgaatattcatgtgcaaaactgtaaatgttgatctacagctccttcttctccaaaaacatgttttaaatggatcatagatctaaatgcaaaacataaaactgaaaaaaaaatcttagaagaaaacatagaaggaactccttgatgagaggaggcagaataagatagcagaataagaggctccatcaatcatcctcccttcaaggacatcaagttaacaactatttacacagaaaaaaaaaaaacacctttatgagagccaaaagtcagatatgcacccatagtacctggttttaacttcatattgctgaaagaggcactgaagagatagaaaaaactgtcctgaatgccagcattactcacccaatgcccttcctctggaagtggtggcatggtgtgtagagcacccctggacaccagggaagggagaaaacaacaattgtgaggcattaaaaatgctattctgttagagctgaaagaaaaactggactaaactcagctgacacctgcacatggagggaccatttaaaccactcctagccagaggggaatcacaaattccagtggtccaaacttgagttcccacaaacctcaccacagagggctacagtgctctgtttctccatgtaaacctgaaaggcagtctaggccataggactgcaactattaggtgagtcctagtgctgaacggggcccagggacaatggactgaaggagcatgtgccatactgatacatcaagtggggtagtcaagagagttctggcatcacccttcccctaatcccaggctgcacagctcatggcttcaagacagaccctttccttttgcttgatgagaggaaagagtggggaggtctttgtcttgcatcttggatacagtctcagccacagcagaagggatgaagcacctgtttcaggccatagcatccaggtgacatttttagacacactcgggacaaaaagggaacccactgccatgaaaggaaggatgcagtcctggcagcattaattacctgctaacttaagagcccttgggccctgaataaccagcagtatacccaagtactatgttgagggacctgtgtgactcagcacattaccagctatggtggccgtggggcaaaactcctgcttaacaaaagcagagggaaaagtaaaggggactttgtcttgcaccttaggtaccagcatggccacgggggagacaagccccgagtaggcttttgaagtccctgatgacagaacttgacttctgcatggcatttctggacctgccctaagccagcgaggagaccactgctatcaagggtgagtcccataccaggcagaattcaccattcaccacaagctaacttaagaggaaatatcaatggtagtctgtcagtactccttgtggcttgcggtggaggtagctacagggtgaggcaactctgcctttggaatggagaggaaaaagtgggaaggattacttcttacggttttagtgccagctcagccatagtacaacagaacaccaggtagacttattaggtttttgactcgtccctgactcctggatgacacctctggacccacctcaggcctgggaaggcactgccctgaaggaaagaacacaggcctggctggctttgccagtagctgactgtagagccccaggcccttgagcaaatataggcagtagcaaaggagaggttacagcaggccttaggtgagacccagtgctgtgttggcttcaggtctgacccagaagagtcatagtggtggtggccacatgggtgcttgtgtcactccacccccagttttaggtgacttagaacagagagagaaaccctgtttgtttgtgagaaagtaaggaagagaacaagagtcttttcctgataatccagagaattctcccggttcttgtccaggaccatcaggtagtacctctacaagtctgcaagaaccacagtgttgctatgtttaaggtgtcccttaaagcagatacagcttacatcacaacacccaagtcctttcaaatatctgaaaagccttcccatgaaggatggctacaaataagcccagacaatgaagacaacaataaatacctaactattcaatgcccagacaccaaagagcatctactagcatcaacaccgtccaagaaaacatgacttaatcaaatgaacaaaataaggcaccagggaccaatcctagagaaacagagatatatgacctttcagacagataattcaaaatagttctgttgagtaaactcaaagaaattcaagatagcacagataaagtattcagaattctctcagaaaaatctaacaaagagattgaaataatttagaataaccacgcagaaattctgaaactgaaaattgcaaatggcatagtgataaatgcatcagagtctgttaatagcaaaattgatgaagcagaagaaagaattagtaagctgaaagacaggctatctgaaaatacacagtcaaaggagacaaaagaaaaagaataaaaaacaatgaagcacaccgacgggatctagataatggcctcaaaagggcaaatctaagagttattggcctcaaagcaggcatagagaaagaaataagggtagaaagcttattcaaaaggataatagcacagaacatctcaaccctagagaaagatatcaatatccaagtacaagaaggctctacaataccaagcagatttagcccaaagaagactaactcaaggcatttaataatcaaactcccaaaagtcaaggataaaaataagaattataaaagcaacaagacaaaggaaacaaataacctacaatagtgctccaataaatctggaagcagacatttcagtggcaaccttacaggccagcatagagtggtataacacatttaagtatgaaaggaaaaatgcttttactctagaacagcagattgagcgaaaatatccttcaaacatgaaggagaaataaaaactttcccagacacacaaaagctgaggaatttcattaacatcagacctgtcctacaaaaaatgctaaaaggagtactgagtacttcaatcagaaagacaaagacattaatgagccataagttatcacctgaaggcacaaaactcactggtaatcataagtacatagaaaaacacataatattataacccagtagcagtggggtgtaaaccactcttatcctaaagtataaaaactaaatggtgaaccaataaaaagaaaataactacaatgactttttaagacagcacaatatagtataaatagaaacaacaaatattaaaaaggagggagatgaagctaaggtgtagagattttggaggttatttttgcttgtttttttgcttgtttatgcaaacagtgttaagtttttatcaggtttaaatgatgtgttataagatagtatttgcaagccttatggtgacctcaaaacaaaaaagcatacaatgcatacacaaaaaataaaaagaaagaaactaaatcatatcaccagagaaaaatcatctttactaaaggaagacaagaaggaaagaaggaagtgatagcaataagaggtagaaaaatcctaggcagacagaggcaggtcctgggtgaaaccccaccttctagccaaagacagtttaaagcctgaaagccagggaccttcttcacaaggtggcaggaaggagaagggcagactgaagggggaagagccccttataaaactatcagatctcatgagaattcactctctatcatgagaagagcctggggaaaaccacccctatgatttaattacctccacctggcctctctcaacatgtgaggattatggagattataattcaagatgagatttggatgggaatgtacgaagcctaaccttatcattctgcccctgtcacacccaaacttcatgtctttttcacatttcaaaaccaactatgcctttctaacagtcccccaaagtcttaattcatcccagcattaaccaaaaagtccaagtccaagtctcttctgagacaaggcaagtcccttctacccatgagcctgtaaaataaaaaacaagttagttacttcctagatacaatgggggtacaggcattgggtaaatacacccattacaagtggaagaaattggccaaaatgcagggactataggctccatgcaagtcccaaatcaagcaggacagtcaaaccttaaagtttcaaaatgatctcatttgaatccatgtctcacattcaggtcacactgatgcaagatgtgtgctcccacagcctttgtcagtgccacacctgtggctttgcagggtacagcaccccttctggctgctttcaattgttggcatttattgtctgcggcttttccagccacacagtgcaagctgccagtggatctaccattctggcctctggaggacagtgacctcttctcataccttcactaggcagtgccctacaagggactgtgtagtggctcagaccccacatttcccttccacaatgcactagcagaagttcttcatgagggctccacccctgctgcaagcttctgcttggacatacaggcatttccatacatcctctgaaatctaggtggaggttcctaaccctcagttcctgacttctgtgtacccacaggctcaacactatgtgtaaaccaccaagacttagagcttgcaccctatgaagcaatggcctgagctctacactggccccttttagccacggctgggatgcaagccaccaaatccgaagactgcacaaagcagcaaggccctgggccaggaccatgaaaccattattttctcctaggcctccgggcctgtgataggaggggctgcagtgaagacctctgatatgccctaaagatatcttccccattgtcttggtgattcacatttggctcctctttgcttatgcaaatttctacagctgacttgaatttctcttcagaaaataggtttttcttttctgttgcatcatcaggctgcaaattttctaaacttttatgctctgcttcccttttaaacattagtttcaattccaaaccatctctttgttaatgcataaaactgaatgctttcaagagcacccaagctcttgaatgctttgctgcttagaaatttcttctgccagattccctaaattatctttcatgttcaaaactccacagatcactagggctgtggaaaaatgctaaagcataacaagagtcacctttattccagtccccaaaaagctcttcatctcctctgaaactaccttagcctggacttcattgtccatatcactatcagcattttggtcaaagccatgccccactaccttggtatcaatttactgtattagtttcttctcacattgctataaagaactgcctggaactgggtaatttataaagaaagaggtttaattgactcacagttcagcatggttggcaaggcctcaggaaacttagaattatggcaggaaggaaggagaagcaaaataccttcttcacaaggtggcaggaaggagaatgaatacaggaggaactaccaaacccttataaaaccatcagatcttgtgagaagtaactcaatatcatgagaacagcatggggaaaaccacccacatggtacaattacccccacctggtctctcccttgaaacacagggattatggggattacaattcaagatgagatttgggtgaggactcaaagcctaaccacatcaactcatatctcttggaatgcacagaagtctaatcaaagttaactaaagacttaaatctaagacctcaaactatgaaactattactagaaaacactgggacaaatctctaggacactggtttgggcaaagatttcttgagcaataccctacaagcacaggcaaccaaagcaaacatggacaaatggaatcatgccaagttaaaaaccttttgcacagcaaaggatacaatcaagaaagtgaaaggacaacccacagaatgcaagaaaatatttgcaaactacccatctgataagaggttaataatcagaatatacaaggagctcaaacaactctatagaaaaaaatatataatgaactgatcaaaacatgagcaaaagatttgaatagacctttatcaaaagaagacatacaaatggtaaactggcatattaaatggtgctcaatattgttgatcatcagagaaatgcaaatcaaaactacaatgagataccatatcacctcagttaaaatggcttatattcaaaacacaggcaataacaaatgctggccaggatgtggaggaaagggcactcttgtatattgttggtagaaatgtaaattattgtggagatgagtttgggggttcctaaataaaactaaaaatggagctactttatgacccagcaatccccactgctgagtatatacccaagagaaaggaaatcagtatatcaaatatatatctgcattcctatgtttgttgcagcactgttcacaacagctaagatttggaagcaacaacagatgaatacataaagaaaatgtggtgcttatacacaatggattactattcagtcattaaaaagaatgagaatctgtcatttggaacaacatggatggaactgcagattattatgttagattaaataagcaaggcatagaagaacaaacattacttgttctcactcatttgtgaaacctaaaaatcaaaacaagtgaactcatggacatagaaattaggagaattgttaccagaggctggaaacagtagtaggggactgggggagaggtggagattgttaatggatactaaaaaacagagttagaaagaatgaataagacctgctgtttgatagcataacagggtgactgtagtcaataataacttaattgtacatttttaaataacttaaagagtgtgactggattgtttataactcaaaggataaaagtttgaggggatggataccccattctccatgatgtacatatttcacactacatgcctgtatcaaacctttccatgtaccccataaatgtatatacctactaagtacccacaaactgtttttcaaaaattttaaaaagaaactccttggataatccatgaaagaaaaagatgataaactggatttgaaccaattaaaataatttgctctgttgtcaaaaagaggatgagaaaacagcccacatgccataagaaaacattttaaaatcatatatcttgtacccaaatgtaagaaatctcaaattttaacaataagtaaataaacacagtaaaaatatgttcaagagatttgaactgacatgatagcaaaggtgctatatgaatgacagtaaggcacatgaaaaggtgatcaacctcattattcattataaaaacgctaattacaacatctaataaaaacatactagaatggctaaaatccaaaaacaaaatgacagtagcaaaggctagtgggaatatgaaacaactggaactgtcatatgtcactggtagaaatataaatggtacagctactctgggacagtttggtgtttttgtacagttaaacatagacttactgtataacccagcaatcccacttatgttcacacaaaacctgctgcttacaatcaccccaaactggaaaccacccaaatgtttctctaagaattactggattaacaaattgcattatatccccatacaatgaaacattactgagcaagaaaaaggaacactctatttttacacaaaacaatttggatgagtcccaaatgctaagtgaaagaaggccatttctaaagtaacatactgtatgtttctacttacatgacattctgaaaaggtaaagctattaggaagagaaaacagattggttgttgccagtggttaggtttggtgggactgtctacctgcaaatggtagtatccaaggctccatagggtgttgggattgttctctatcttgttaggaaggctggttacaagaatatatgcttgcgttaaaactcgtaactctggatgctatcagaaaataaattttactttatgtaagttcaaatataataaatgatagcaatttgtgatattaaggtcatttaatttaaaaaataatatctaatcaacccaatattaagaaagtttaacattatgatcgcaaaattctaagtaatttaattgtactcaatgtgaattactttctcaaaggagcatgtgattgtaaaacctacctgtaagtttgcttgtaagatatcttatccatctctaatcagatgtcatggaagtggatgaatgtccctatcctttaaatgttctgctttaggaacagaaaaccaaataccacgtgctctcacttatcagtgggaactgaatgatgtgaacacatggacacgtggtgaggagaaacacacactgggacctctcagagggtggggctgcgggaggaagagcgtcaggaagaatagctaatgagtgctgggcttaacacctggatgatggggtgatctgtgcggcaaaccaccatggcacttgtttacctatgtgacaaacctgcacatcctgtacatgtacccctgaacttaaaataagaattggaaatttaaaaaaacaaaaagccaaaaatttctgctttaattaaatatcattatctttttataatgcaaagaaaaatgtgtcttaaattgtatttaagattacattgattttattcgacaccatcattcagtttacctgaaattcttatcctgaaaatatctgacataggtgactctacatataacaaaagaaaacaaatatcagtaactttacagattgtgccaaacttcttcctcaacgtaatggactgtgttatcagccattcaaagcatctacatctaaacgaagacatctagatgagtaacttctatgcatagcttcagttattcaattttgctcaaattacagtggactactagtgaattgtcactatagatattcataggcttcatataaaatattggccatgttcctatatgattctggttgctccagaggtcttggattcataattacctgagcgtttctaacatgtattaacatgaagcatcaattgtttctggtaaatgaggaataagtggtttttgttcagaattgctctctgtagattctctgctagtattataatcctctttgattgaggtaaaaataacctggatgactaaaggtaaatttttccacaaaggagaattaatgcactgtctgttttctgtagaattatgacagattttatgcctttgttaaatcctaagattagttggtataactactttcaatgctctggcctattttctttgttgctaaaatgaaaatagatcagaaacaccttttgaggcctctggatttataatttaagaattaactctgagaaagtagtaggtgaataaatagagttataatctaagacaacgttacattccttgtgtgagtctcacatctaagacccggcagtactttcttcctctgtgcattctcacgaatacccacacactgtaagcatagtttctaagattccataattatgaatcctaacaataagaatgactcagaatgcagaatattacaatgcagactctgtcctgtcaggtaaagtaaggaaaggtaaatactgcttaccgatacacattattaaatggtctgttctaatttctaattgtaacttcttggtttcaatattagacatacatagaaagttctgcctaagtaacttgaggctgattccctgtggcacaggtccttactaatagatggtggttttagaatttgcattaagtctttctatctagttcatttcaacaaatatttaccgaatatccactctagtcgaggcactgtgctaccatatgggaacataaagatgactaggacaatccctatcctgcaggagtgtacaattacaaagcagagatgtgttgattgttatgattaatataaagtatagcagggttccaaatgcatgaagctagactgaagcatggagaatatttaaaggagaaaaaccctgagtctacttggggagattaatcaagatttcaaggaagaggtaacattggaaagggtccactgagagggagtcagactttggtgggcacaaacccaaaatgaaggagatgggaacagtaagtgcttttgtttactgcatgcggattgatggtgagaagttaaccagtaaatcggagagcccagaccttaaatatctagtcaagtttgtgttccattaagacaataagtttgctgactaaagatttttgaaagaattagatgacattttcatgaaaaaatacactcatatggacatcagcatgcacatacatatgtatacatatttatacagagcatacatatatatttatatacatatagagtacatttcatttaaatgaaacgaaactacttggactgtggaggataaatttagagaaatctacacttggaatcacctgttacaatataaatataaaactttatggcatagatagtcatcagtgttatactcagaacattcaagtaaatatatgataattgtataatatcagggttatatgcttttatagtataatgcatataaatttatagtatgtagtatactagtaggctcaaaatatgactagtactggtgccattatttttgaaaattagctaaggcactaaaaaagataattcatgtgaactagactgataagctgaaaacattgctacttgttatttttatgtcaaatgtaatttgttttagaataaacattataattggctattcaatgcccacacacttagtataactttttaggtagaatcagtgattttatggtaacgtctaaccttgtggggaaaaatatttctctaaacttcagtttactgaaacttaaatttcacacagagtcattgactaaaaaagaaagtcaccaggaccttctcatccatctcataaattgctaatgcccacttctaatggtgcatttgcaattggtttggtctatgaatgacacacccataatcatataacttcctaataacattttgtggtttatactcctctaataattctctgtttaacaatggtcataatgattttcatacaatacagatacttaaataatattttgcatttttccagattatattttggcataagttaaacattatgttcattgtttatcttcaattaaaataacagacaaatctactaaagtgaaagacatggcaggaaggtaaagactctaaaagcacatgtttttaattgtgagaaataattttgtccatttctagaaaaaagataggaaaggtgattcttaagtatttaatgtacagataaatgattcattaataatttttacacaattatttaatttgaatggataaatattattaagaattgtcataagtatatatataagacatagtcttacatgctgtattagtccatttgtacactgcctaaagaactacctgagactgggtaatttatgaagaaaagagatttaattgactcatagttccacagccttaacaggaagcatgactggaaggccttaagaaacttacaatcatggtggaaggtgagagggaaggaaggaccttcttcacatggtgccaggagagagaggcagtgaaggggggaattatcacacacttttaaaccgtcatatctcatgagagctcactcactattatgagaacagcaagggggaaatttccccccatgatccaatctcctcccaccagtctcctcctccaattcaacatgagatttgggtgggggcacaaatccaaatagattattgtaagtataatgaaatataagtgccatttatttatttaaaaaccattttttgagaacatactatgtactagacatggtactgtaactcttgttctgaggattgtatgaaaattatcatgttaaaattcatatgacaaaagaatgggtctacctcaagaagggtatgggaagctataaaaagaatggatatttgatctggaatttaaagatcaggtagaagaagcttgtcttaatggaaatagagataagacatgagagagtgaaaaaagaaaataagcaaaaatagaagggagcttaaatgctatcccatttgttgtgggttgaattgtgttctcccccaaaatatgtcgaagtcttaaccccagtacctgtgaatgggaccttattgggcaataggatctttgaagatataattctgatgtaacttagtagatggagtcatgctggaggcccttaattcaatacacctcatgtgctaaaaaaaagagaagggacgagaagagacatatacagaaagaaaataacaccatggcagaatacagacacacacagagaaggaagacagccgtgtgactttggtggaagagatgtgagtgatggcaactgcaagccaaggaacacacaagattgttcaaaaccctcagaagctgggagagaggcatgaaacacattttccttcagaatccccaagttgcaaccaaacctgccgaaacctggatttcagacttttagcttctaaactgtgagagaataaatttctactgtttaaaccacccagtttgtgggaacttactacagcagtcccaagaaacttgcatactatgctgaataaatgaggtagagttgtcaaaaggtggaacaattagttataaaaacatatggagagaaatgagaaggaaagaaaaagtctaataaaactaggcattttgtgaataagctaaggagtcaaactcttagcatataataatatagagtttgtcttttaattcaaggcagttacattcttctatttttttttttattaaagagagcatgagtttcagagaagatgataattttgaaaggctaaaagctacagctatataggccagagaaaagacaatttcaattttctaatgagggataatgatagtttatgctatgtattgttacacatgtaatgccctctagagatgaacatgctacattggacccagcctaataaacgacctttgatgtcgttttcctatcaatggtgaagggtttcgccaatctatccagagtttcccttcttgtttctctgggggttaaggccctcattagaaagttagacagagagggtaataccttggtaatggcatgggcaatgtctttgatgaatacactcttaagagcaagataatttaagtgcacattacagaatattatggcaaacaataaagcttgcatagattgaaaaacagacctttccctcactgttattaactgggaaaactagctttgaattgtaattaattttggggttggatcagttataaaatgcatatcttataaactaaaggtttattttttcggacaagatacaacttccagtaacaggtgaatttgaataagtattaactaattttaaatagttatccaaaataacattatctagttagaatcagagggacacacacaggttgggaaatattttgcatttcttggtgcaattctatatttaatgatttttttctatgatctataataataagaacaattattgacattgtatttggtaaaaaatgcttgatttggattcgaagtttcattcttacaaaactgtatgttttggtgtcaaaatgataactcaatatacatcatattcttatatcactggaccactgtaaatgtataaaaagtctaggatatagttttctttaattttacagtttaaaaaataaatttctgagaaagtcatcacaattattgcaaataattgtatgattatgaaaaaaatggcagtagtcacaatgctacttgtaaacagaaagatacttggtcatgtgaaagatacttgtagtccactaggcacatataggccatacttcttcaatctaaaagacagaagaggcatctgagtaacagacatgtttcctttactcacctagcttcctttttctatcctttattgaattataataatagaataggtcttattatcaattaagtgatctttcttgttctcacaatgagagcagctgcatcaagtaagttttcgccttactaaaaactttcagatgtcttttggttttattattcaatttttgagatgtataattaaatccctgggaatgagtggatataatttagaaggcaattcagctctgtgaacttatacagatgtcactaaaatcatgtttgatggataatttcagaaacaatgaaagcatcattaactagagtaacttggaaaagcacaagtaaaagacactgttattttgacaatattgagttaaatagaggccacaggaaaaaaaaaaaaaaaaaacctgcacatcaaagttaaatgatcagcattcaatgtaagacattcttggagaactggaatgtttgctttggttttgttgaagtgattaacatgaatatgtcagctgcgtaattcagtgaacaaaattcatttcactgtaggaagtccatgtgggttaaaggaaaacaaaatctctttgtatgtccaaatggttttaaaaaggatctagggaacagttagtatggttcttactaattgttttctttctttaggtggaataaataattctaataaataaagggaataatcataagaatattctgaaaggaactaacagaaagctcagtgcaaaatgaaaaactataagcttacaataaactatgttttgtatatagatttataggtatataaaaggttagataaatagaacagcaatagagaacagagatagaaataaagattgattctaggtctataccatgtctttatttaatttaatataaaagaaaatcatcgatcaaagatgcaagaaattttttttaagaatccaaatgttgttagaattgactgtaataaaaatagtttgccatagggcttttcatggtacattaaaattaagaaaaatattttcccatttactagcaggtcaagttgcttcttttcagtgatcataatcaattatccaggaaaagggacagaagaaatcaggaaaaaggagaatagactctttatgcataggtaggttcagaattaacaaagttttgtggtggtggttctttgctttgacacagattcaatgtaataaaatttgtaccacctttaggcaaaattgagaccaatagaagaaaaatgtaacatagagtcttgaagttgtgtcaatagaagaatttaaaaacatatttgcttttaaaaattgttttatggccatataatttgcattcaataaagtgcacacatcctaaatgttcattttgatgagttatgataattttatacactcctgtaacaaacaccctaagtaagatatagaacatttgtatcaccctagaattacattatatgcctttctattcaatttccacctagaagtgggagctactttctgatttccaccaacacatatcagtttgttttgcatagtcctggattcttataaattgaatcatgtagtgtgtaatcttttgtgtgtctgacttttttcactcaacataatatcgttaagatccatgcatatggttgcatgtatcattaatttgttagtttattgctaaatagtacaccattataggaaaatatcaaaatgtattaatccattctcttgttgatagatattcgagttgtttctattttatctactgtaattaaggctgttataagcatttttatataacatgtttatggacgtatgttttatttttatttggataaagactctagaacacaattgagtgatcataacattagattgtatatatttaagtttaactgtataagaaattgccaaagtgttttccaatagtgttgtagtattttttgtcaccaccagcaatttttgagaatgcaagttgttctgtatgttaggcaacataatggcccccagagaagtcctaatcccaaaaacctatgaatttgttactttctatggcaaaaggagctttgaagatgggattagtttgaggatcttgagatgggaaagttattctggattatctgctgaatcgagtataatcacagggtatttgtaagatgaagacaagagagtcagcgtcaaagagatataataatggtggcagacacagaggggaaggagagaaagagaaagcagaagatgctctgctgctggctttgaaaatggtggaagaggccatgaactaaggagtgaatgtggcctccagaaggtagaaaaggcatgggaataggttatccctttagagccttcagaagaagcccagacctcccaacatcttgatttttaggacttttgaccacataacataatatttaaaagttgtgttgttttaagccactaagtttgtggaaatgtgtattagcagtaacagaaaactaatatgcatccttgccaacatttgctgtcgccaatctttttagttttagtcattctagtgggtgtgaaatggtttagcattatcattttaatttgcatttccttgatgacccatgatgttgagcaaattttcatactctatcaggccatttgtgtatcttttcctgtgaagaatttcttttcaaggctttgaccatcattctactgaattattgtttcttctgttgttgattatcaggagctttaatatatagttgacacttgaacaacatggatctgaactacacaagtccacttattggtggattttcttcagcctctgccacccttgagacaacaagaccaatacctcctctttttccttctcctcagcctactcaacttgaagatggtgagaatgaagacctttatgatcatccacttctacttgttgaatagtaaatatattttttccttatggttttcttaataacactttcttttctcttgattactttattgccagaatacagtacatagtacatataataagcaaagtatgtattagtttactgtttaagtgataggtaaggcttccactcaacagcaggcaacagccaggtgttgtgacacatgcctgtaatcctagcattttgggaggccgaggtggaggatcgcttgagcccaggagttcaagaccagcctaagtaacatagtgagacccccatctccacaaaaaattaaaatacctaatcatggtggtgcatgcctgcaatcccagctactcaggaacctacaataggagccaaaaaggtggaggttacaatgagccattattgcactactgcactgcactcctgcctgggagacagagtgagaccttgtctcaaaacactacaacaaacaacaacaacagcaacaaaaatcagtaggtattaatagttaggttttttgggagtcagaagttatacacagattttgactgtgcaggggatcagcgctcctaacgcctgcattcttcaagggttacctgtattcttgatacaagttctccttcagatttaagtattatagatatttttccagtctatagcttacctattcattttcttaataatgtcttttgattgatttttaatttttaactttggtgaattccagttgtatactttttttatgattagcatttttgtgtcctatgaaactgttgccttcctcaatgtcactaaattctcttaggttttcttctagcaagtttatgtttcaaattttcacccttaggtctataattcgtcccaaatttatttttgtctgtaaagcaatgtcacgattcattttttttctcaatataattacccagttgtttcaaaactggttattaaagtttttctcttaatcattgaattttcttggcaccaaattattaactcttgacaaaaataattgacccttaagtaagcagacagacaagcagtgcttctattttatagcaatgtaaataatacacaacttacacaaagactttttagaagctaactaacagtggtcctatctaagtacgtacaccagattttttataaccacttttaaaataaaagtatttagattttaacacatagattaggacagagaaagcatatggtggaataaactgtatctttttggccagatggtgctatttctaggtcatcttgataaagagaggaggcaaacatgaaaacttaatgaaaaactatttatgatgctggagagaacatcttggctttgagtcacttttaaatcatagaagaggattattccataaaattatttataatgcctaaaattattctttgcccaaatcataaattttcagcattaccaagaagccatttagtatgtatagggtgtttcagcaagtgcagagatgcccaggtggttgggattcaatacaacgagctgtcacgctgcacattcttggagtacaaccttaatgggcattttcccacctgtgcaattcctctgttttcaccccactccattcatatttcacaaactactctaattatagtatttattattgacctcaggaaaaagaagtttgaaagggtggaaaaaacatgcattttgtctccatggatagtaaatcactgagctattgttccttgggaatcccaattcatgagaaattacatagacttttgccctaacactaatcagctgcctgatctgtaaatatttcagatccttgcctgtatctatttctccttgcagaaaactgtaatttatctagatttttctaataattcactgacattttactgctatccaatgagtaaatcattgttgcttttggtatcttatgattttgttcttttgtgtcaaagtttagctagtttcatctatcaggttggaataaaaaatgcaaattatgactataccacttatatagttacatgatctactgaccaaagttaatcatcactttaatcttggtaactcattcagagccctaattgtaatagcctttgcctgagttacctagagagtggtctcaataatccccttttatttttcatgtagagaaaagggcacacaaaatgatattatctcgatcacccagcacatgtattaaactataacagactttttaaatcatgtgtgatcttttattttttgactgaaagggactaagtttgctgcccagagaagtctttagggagcaaggaaaggtaagcaaataaacttatctggagtcaaaggtctcaaggaaaatcttgctttctataaaaggcagacaacgtcaagactcatagattttcccagggctaaaaatcagagccaattgcctcccatcttgaaaagactcattcatcatgctggttgaagtatcacagatcttgtcaaaatattcatgactcacatacgacccatccaaaagacaaaagccaacaaaatattttaccaaattctaaaatagtgtttgttttattattctttgttattcttcaacaattattgttacctttactatatgaaatataatagcaattccttgtcttcatggtctttctgttacagacatgttttacactgattataccactttagtgaaattcatcatacatattcctgatccaaattccttttttattaaccatatatgagagaaagtggatattaaaataattttgatggtaaaataagcgaaaaaataaagcaagcatggttaaaatgattaaattatggaaaagtgacccatgtgtttcagataaactgacgcttgagggtttttgttgttattgtggtttaaattttattttattttaattttaagttccaggatacaagtgcaggatgtgcaggtttcttacataggtaaagatgtgccgaaatggtggtttgctgcacctctcaacctatcacctaggtattaagccctacatgcgttagctccctcccactgcccctgcagcagatcccagtgtttgttgttccctccctgtgtccatgtgttctcattgtccagctcccacttgtaaataagaacctacggtgtttggttttctgttcctgttttagtttgttgaggataatgacttccatgaagcttgagttttcattctacaatttactgaatgacatttgagcagctagctgactttttaatgccttgattttaataattcaatgagttattgggtgagataatttagaacagcatacatgatatcgttattattagtcaataaaatgctatttatcttatttattactcataacaaaaatatgtatatgacccttcgctatgtttgaatatgtgatatattgaattgaattcactgtgaggcttcagtaggtacctataatattcaaatatgttacctgaaagctgtgaaaaatatatttttaaaaattagatttacatgcagtcaagttttcttttgatgacacactctcttgatatatactaagttttatacttggaatctttcacttttatccttactcagaaacgtgaatattaagaatcagtagagccagctcttctacatgttccctgccaattgctatcttgcctacttttaaaacacctctaacttgagaaaatgaaaacccacaaactaacaattgttccagggaagtccatggcatcacttggaacttttcatcattagtcccagttacactcttttgtgttgtatacaacattggcatatactctagtcatctgtatgccaagttaaatgagacttcattcagcaaccagtaatatgtcatgcatcagaagtctctctcatcatattgcttatcaccatcaaatagtttccattttgtctttattccttaaaaattgtcatgcttaaaattggtgcaaataatgtagatacttgtgattctattatatctacatatatttttctattttgcaagagaagtgaattttaataaattagttctcttagattataatgctacagaaaaactgaatgacctgactcgttggtgatttgattgggactggatttgtgttcctgcccaaatctcgtgttgaaatgtaatccccaatgctggagatgggaactgatgtgaggtgattggatcatgggagtggtttctaatagtttaacaccatccccgaagtgctgtttcgtgatagagttctctgaagatctggttgtttaaaaatatgtgtacctcccatctgtctcttcctcctgctctggccaggtaagatttgcctgctttctcttcaccttcaccttccactgaagagagaggttaaagattaacccccccactctaatcacatgtactgtctataaatctcaatctatcaagaccctttcacgtggaccccttggagttgtaagcccttaaaagggtctggagctctttctttggagagcgtcattcttgagatgcaagtctgctgacgctcccagccaaataaagcctcttccttctttaacatggcatctgaggggttttgtctgtggctcatcctgctgcatttcttggttccctgaccaggaagtgaggtgattaacggacagttgaggcagccccttaggtgacttacacctgccctgcagagcatccctgcagtgaactccagccagcttgagcgatggggatcctgagaccgctcctgggtaggtgtttgtcctggtagaactcctcgtcagagtggtgcatggcaggcccccgcagatgatcaatgcaatgtctgaacactgggaaggaaccattgcttggagtccagacatctggaatacagaaggaccggtcctgggaacttgcccactgcatttgagtggaagcgtggcctgatcacccactgtgtgcccttatgggcactttggtctcagtattgattttgatttggcttgacctgtttgcaaaaaggaaagtgaaagtgagtgagtgcttgagttttagatgtgcgaggtgagcgagtgacctctttaccctttccttcttgtggtgtgagtgttgttttgtctcgggaggaaaatgggtgttatgcaaagtaagcccactctgctaggaactatgttgaaaaatttcaaggaaggatttaatggagactatggagttactatacaccaggaaaacttaggactttgtgtgaaatagactggccagcattggaagtgggttgggcatcagaaggaaacctagatgggtcccttgtttttaaatgtatggcacaaagtaactggtaagccaagacacccagaccagtttccgtaaatagacacttggttacagctggttttagagccaccacagtggttaagaggacaggcagcagtagtactagtggcaaagggacagacagccaaggaagaatcctgctccaccaacctaagggagtcagctcctaaagtcctgtctgatccaacaccagaggattcatggcaagaaacagcaccagtggccccctttccaccaagaagaaaggtctcccactccgataccccatcctataccaaaaagccacaagctctgatggatttgctccaaactgttatccagacccacaaaccccacctgggctgattgccactagttgctcatatgcctctttaacacagatgaaaggaggagagtgctccaagcagcaacgaagtggctttagaacatgttccagctgattaccaaaacccccaagagtatatgaggatccaattaccaggaacagatgccgagtgggacccaaatgaaagacagggtatgcaaaggctaaaccggtacaggaaagcccttctggaagggttaaagaagggagctcagaaggtcacaaatgttaacaaagtctctgaggccattcaaggaaaagatgagagcccggcacaattctacaagagactacgtgaggcctatcgtatgtataccccctttgatcccagtagccttgaaaatcagcacatgattaacatggctttagttagtcaaagtgcagaagacattaaagaaaatttcaaaaacaggctgggttcacggtcatgaatacttcacagttactggagatagccaagcaggtgtttgtgaatagagacacggtaagctacagagagaactgcagagagagtgaacgccaagcccggcgaaacgccgacctgctagccacagctataagaggggcccccccaaagagaccagagaaggggggccccaggaaaaatacccagtctgtccatccacgcttgcagcgtaatcagtgtgcttactgtaaggaaataggacgttggaaggacaagtgcccacagttgaaagggaaacaaggtgactctgagcagaaggcctcagacaaggatgaaggggccttgttcaatcgggcagaagggttactggactgagggggaccaggctcatgtgcccccaaagagcccattgtcaggatgacagtcgggtacgaggacatttagtttcttgtcaatattggtgctgaacattcagtagtaaccaccccagtcgcccccttatccaaaaagactattgacataatcggagccacaggggtttcggcaaagcaaacgttctgtttcccccagacctgcactgtgtggggcatgaagtgattcatcagttcctgtacatggctgactgccccttgcctttgctaggaacggacctacttagcaagctgagagccaccatcacttttacaaagcacggctctttaccgctaaagctacctggaacgggagtcataatggcccttatggttccctgggaggaggaatggagactcttcttaactgagccaggccaagagataggagcaactctggctaagtgttggccaaaggtgtgggtggaagacaacgctctagggttggcaatcaaccaggcccccgtactcatagaagttaagcctggggcccagccagtcagacaaaaacagtacctggtccccagagaagctcttgaaggtatctggatccatctcgagtgcctgagggcctttggaattgtagtcccttgtcagtctccatggaacaatcccctcctgcctgttcccaagccaggggccatggactgcaggctggcacaggatttgcgcttggtcaaccaagctacagtgactttgcacccagtggtacctaacctgtacacattgttggggttgctgccagctgaggacagctggttcacttgcctggacctaaaggacattttctttagcatcaggctagctcctgagagccagaaactgtttgcctttcagtgggaggatccggagtcaggtgtcaccactcagtaccttggacccagcttccccaagggttcaagaactcccccaccatctttgggggggtgctggcttgagacctccagaagtttcccaccagagacctaggctgcttgctgctcgagtacatcgatgacctcctgttgggacaccccacggcagtcgggtgtgccaagggaacggataccctactccagcacctggaggactgtgggtataaggtgcccaagaagaaagctcagatctgcagacagcaggtaagttacctgggatttactatctgatagggggagcacagcctgggatcagaaagaaagcaggtcatttgcaacctaccggagcccgagaccagaaggcaggtgagagaattcttaggagccatggggttctgcaggttatggatcccaaactttgcagtactggccaagcccctgtacagagtcacaaaggggagcgacaaggaacctttcaaatgggggtcccaaaagcaatgagcttttcatgagttaaaagagaaactcatgtcagcccccgccctggggctgcctgacctgacaaagccatttacactatatgtgtcagagagagagaagacggtggttggagttttgacccagatcatgtggctctggccaatgctggtggcctacatctctaaacaactagatggggtttctaaaggttggcccccatgtttgagggccttggctgcaactgccaatggacggatccagttatcagataaaaaaatagccatgccacaactgctaggagccacagtcgtactggctgttcttgaggccccacatgctgtggtgactttaatgaataccaaaggacatcattggctaacaaatgctagactaactaggtaccaaagcttactctatgaaaatccccacataaccattgacgtttgcaacaccttgaaccccaccaccttactcctggtatcagagagcccagttgaacctaactgtgtagagttgttggactcagtttattctagcaggcccgacctccaagaccattcttggaaatcagtagactgggagctgtatatgaacgggagcagcttcgtcaacccacagggagagagatgtgcaggatatgcagtggtaatgctgggcactgtcattgaagccaaatcattgcccagggtacttcagcccagaaggccaaactcattgctttaatttgggccatagagctaagtgaagataagactgtaaatatttatactgactcttggtatgccttcttaaccctgcaagtgcatggggcattgtataaagaaaaaggcctgttgaactctgggggaaaagacacaaagtatcagcaagagattctgcaattattagaggcagtgtgaaagccccaaaaggtggcagtcatgtactgcagaggacaccaacaatctttcaccttgattgccttggggaactcccgagctgactcagaggcttgaaaagcagcatccaccccctaccgggcatcagtcacagcaccccctgctccttcaggcacctgaccttgtacctacttattctaaagaagagaaggactttctccaggcagagggagggcaggtgatagaagagggatggatccagttatcagatagaagaatagccatgccacaactgctaggagctgcagtcgtactggctgttcatgagaccacccacctaggccaagagtcacttgaaaagttgttaggctggtagttctacaactcacatccggcagcccttgccaaaacagtggtgtatcagtgtgtcacctgctggcagcagaaaggtaggcaaaatgcaaatgtcccgcccagcatacaagcctgtggagcagacccctttgaagatctccaagtagacttcaccaagatgcccaaatgtggaggtaacaagtatttgctagttctagtgtgtacatactctgggggtggtggtggtggtggtgtggaggtctgtccaacacgaactgagaaaactcttgaagtaacctgtgtgattctccgagatctcatccctaggtttggactgcccttacaaatagactcggacaacaggctggcatttgtggctgacttggtacagaagacagcaaaggtattggggatcacatggaaactacataccacttaccgaccacagagttctggaaaagtggagcagatgaatcagactatcaaaagtaatttagggaaagtgtgtcaagaaacaggattaaagtgggtacaagctttccctatggtattgtttaagattagatgtaccccttctaaaagaacaggatattccccttatgaactattatatcataggctccctcccatactacggggattcccaggcactcctcaagagctaggtgaaattgagttacagtgacagctacaggctttaaggaaaattacacaaacaatttcagcctgggtaaatgagaggtgccccatcagcttattctccccagttcaccctttctccttaggtgatcgggtgtggatcaaggattggaacgtaacccccttgcagccattgtggaaaggaccccagaccgtcatcttgaccacagccacaaaggtagagggaatcccagcctggatccaccacagccatataaaacctacagcacctgagacctgggaggtaagaccaagccaggacaacccctgcaaagtgatgctgaagaagacaataagccctgctcctgttacacccagaagctggctggtccatgcctggctgaagcataaggaaactcattgtgggtctcattttccttaaattttagacttgtacagtaagtacttcaactgatcttcctcagactgaggactgttcccagtgacatcaagttactgaggtagggcgaaaagttaaaacagtctttctgttttataattattatgaaggtactggaactctaaaagggacttgtttgtataatgccacccagtacaaggtatgcatgccaggaagtgaccagcctgatgtgtgctataacccatctgagccccctatgactacagttttccaaataagattgaggactggcaactggggaaaagctgataagagtaaagtaatatctaaaacagaagagaaaggagttcccaaacaaattatcttaaaatttgatgcctgtgtggcaatcaacagtgacccgtatggaaatagaataagatgcggctgtctagattgggaaagtggctatatagtagaaaataagtatgtttgcaatgaattaggactgtatagtgatgaacatagttactggtcctgtgtcatttaggctacctggaaaaaagataagaaggaccctgtcctccttcaaaaaggaaagagtaactgttcctgcactagtggtcactgtaactcattagaactacctgatcaccattggaaaacaggagagtatgtaaccctaggaatcaatggaactggactggatccccaagtaaatatttaagtgcaaaggaaggtccacaggctctttcccaaaccagtgtttcagaccttttaataataatagtgttaggagcctgcatgttactcccctgtatgttacccatatttctaccaccttagttcatcaaaagacctcagcacaagtgtattacatgaatccctattgatctgtctcacaggaagacctgggtggtgactatgaaagtgagaactcccactagtgagtgaggttctcaaagtgggggaatgaggagagaggccatttatcttactgtctcctgtctctgaagagaaagaggaagtaaaagctgaaaaacaacaggaatgaaatcagtggcaagaccagccagtgcaccgatgaccaggcctgaggttaaaagattaacccccaactctaaccacatgtgctacctatagatctcaatctatcatgaccctttcacgtggaaccccttagagttgtaagcccttaaaagggccaggaaccctttcttcggggagctccattcttgaaatgcaagtcggccaatagtccagtccgaataaggcctcttccttctttaatctggtatctgaggggttttgtctgcagttcatcctgctacagtcccagtgctggtggccacaggagtgcttatgtcgcccctcccctaaatgcagacagcacagcatggagagagagagagactccatttgtttgggggagagtgaaggaaaagaacaagagcctctgcctcataatccagggaattctgccagatcttactgcagaccaccaaggtggtacatctgtgagtttgcaagagtcatagtgttactgggcttgagatgcctctaaagcagatatggctgcagtgaccaaatacttagatcacaaccctcaattccctttgaatactgggaaagccttctcaaggaggatgggaggctgggcatggtggctcatgcctgcaatcccagcactttaggaggccaaggtgggcagatcacctgaggtggggagttcaagaccagcctgaccaacatggagaaaccccgtctctactaaaaatacaaaattggccaggcgtggtggcacatgcctgtaatcccagctacttaggaggctgaggcaggagaatcacctgaacctgggaggtggaggttgcagtgagccgagattgtgtcattgcactccaacctgggcaacaagagtgaaattccatgaggaagaagaaggagaaggagaccagatgtggtggctcatggctataattccaacaatttgggaagctgaggagggaggatcacttgaatccatgagatcaaaaccagcctgggcaacatactgagatcctgtgtctacaaaaaatacaaaaatcagctgggcatggtggcatgtgcctgtagtcccagctacttgggaggctgaggtgagaggatcgcttgagcccaggaggctgaggcctgcagtgagccatgatcatgccattgcactccagcctgagtggcagagtgagattctgtattagaagaaagaaacaaacaaagaaagatgggtacacacaagcacagactgtggagattataataaataactaattctttaatggccagacattgaccaatagccacaagcatcaagagcatccaggaaaacatgacctcacaaaattaaataaggcatgagtgtccaatctcagagtgacagaaatatgtgatctttcagagaaaaaattcaaaatagctgctttgaggaagctcaatgaaactcaagacaacacagagaaggaattcagaatcctatcaaatatatttaacaaagagattgaaataattttttaaaatcaagcagaaattctcgacctgaaaaatgtaattgacatactgaagaatgcatcagatctcttaccagcagaactgatcaagcagaagaaagaattagtgaggttaaagacaggctatttgaaaatacacagtcagaaaagacaaaataaaaaagaattaaaaactataaatcaagaaataaagtaaaataaaaacaatgaagcacacttactagatctagaaaatagcctcaaaagaacaaatctaagcattacaggaggtagagagagagatcagcatagaaaatctattcaaagggatagtaagagagaactttccaaacctagagaatgatatcaatgttcaactgcaagaaggttatagaacaccaagtagatttaacccaaaggagactacctcaaaggcacttaataatcaaactcccaagagtcaaggatgaagaaagaattctgaaggaagaaagagaaaagaaaccaataacatgtaaggagatccagtatatcttgcagcagacttttcagtggaaacattataggccaagagagagtggcatgacatatttaaagaattgaaggaaaaaaaactttcattctagaacattatatccagtgaaaatattctgagatcaggagtttgagaacagcctgaccatcatggtgaaatgctgtgtctagtaaaaatacaaaaattaactagttattgtggtgtatgctgttaatcccagctactcgggaggctgaggcaagagaatcacttgaacccagaaggtggaggttgcagtgagctgagatcacgccactgcactccagcctgggtgacagagtgagactgccacaaaaacataataatagtaataataaaagaaaaaggcaaaaattcaaacaacagaaactgggcaaagccctccacaaaagaggaaatgtgaaggaatagctaataaaaacacgaagagggtctcagcctaacagggggagatgtcacgtgacacccaccagactggcaaaaatcccacaacccaatccatgcaagagttagggagaatggagagtagcaggaacaccaggcactgctaagaacggttgtgaaatatatttttgttatgcttctatatgaaagggtgtgtgttgtgggttatgagaaaaattacatttcttacctgggatgaaattttaaacattggaagctattgaccagaagaaacttgcacttttgtacaaaagaaatacccaagaacattcctaacaaaacagagtcctaaaggccccaacctggccaaacactcatcaacagggaaatgaagacatttcccatgctcctctcatatgaccggagatcatgcagcaataaaaatgaatcatgtcaatgtgggtgggtctcaggaagagaatggaggacaaaaatagacatcgagcagatgctcagagccatgcagtgtaggagcagccacacaggagaatttctcacatcaaagttcaaaactacagccaaggcaacagagcaagaccctgtctcaaaaagacaatggaaagttccaaaactaaatggcatattttttagggatgtacacataagtggtggaagaaatgtactatgaagaaaaatatgggaataataaagactaaaagaggaattgattccctctgtaggagaagggaaggggctagggctcaggcagggcctccggggagcatccaaagttatgtctcttcagattctattccctaaacttggtggaggtcctctgtgtccaatgtgtctgtattctttataccttacccatattgtacaaatgctttatttctattcaacatttagaagacaatcataaacaaaatgcattaaatagcaagatggcaaatgaacctcaggaaggaacatcaggaacatccatgaggttccatccacggaacctcaccatggatacgcttgtgatcaagggccttgtctcccctcaagacagtcagagatcagaggctgccctcatcatagcagtggaacaggaccagctgggacagggtccttctgtgacacctgctgtgtcaccaggctgtgcgaatggactcagctgcccgaactcacagaatatcagtaacagcaccgaaacttcacaggaaaaatggtaagttgtaagtttctccattaatagtaactctcagattagtctatgtcatccatcgcttctccattaaataactttttatagctttacatgggtcgatttttcaatttatattttattttactaactgaatgaaaagatatatattgtgtgtggtgtgtgattttgtctcagtcaggataatcatagtttaatttctattattattataccaatatcatttagtttttttaagctgttcaattcctgagggtattaatcagggtctttctgtctcatgagacaaaaaacaaatccaaactgtgtaagagaaagaagaatgcattgatcacgaggactgagaagctcccaggcttaacttgcttgggattcagctacatgtacagtttcaagtggtgtcctgtaaactctctctctctctctctctctctctctctctctctacttccccaacatctgctccatgtttagctccacgaacttcagacttaaaaagcatcactggctcctgaccaggattccagctccatgaacctcaaactagaacaccagcccggcttctctgcaggtctccagctccaaaacctaagacatcagtggcagtacaaactcatcccaggggctccagctccaggaccctcagacttgaaccgcagcaccaactcttccctggatctccatctccatgaccctcagacttaaacagcagcagcaccagttcatctgtgaatctccagctccacaaccctccaactagaaacacaccagctcctccctgggtctccagctgcacgaccctcaaactacaacatcagctcctccccgggtctctaactccatgaccctcaaactaaaacaacactgctcacccctgggactccagatccacaaaccttacactagaacagaaacaccagctcctccacagatctccagctttacaatctaagacattagtggcagcaccatctcctcctggggtctcaagctccaggaccctcagacttgaatcgcagcaccagctcttccccggatctccagcttgacgaccttcagacttaaacaacaaaagaatcagctcctccctgggtctccagcaccacaacccacaaactagaagaacaccactcccccatggatctccagatccatgaccctcacactagaacaccaacacctgctcctccgtgggtctccagatccacgaacctcacactggaacaccaacactggctcctctgcgggtcttcagctccacaacctaagacatcagtggcagcattggctcctcccatggattccagctccaagaccctcacatttaaactgcaagaccaccttctccctgtatctccagctgcacaaccctcaaactagaacatcagctcctccaatggtcttcagctgcacgaaactcaaactagaaaaacaacagctcctccctgggtctccagctctgcaaccatcaaactagaacaccatcagctcctctccaggtctccagctccacagctctcaaataagagcaacatcagcttctccctgggtctccagctgcacaaccctcaaactagaaaaacaccagctcctgcctgggtctccaagctccatgaccctcaaactcgaacaacatcagctcctccccacgtctccagctgcatgaccctcaatctagaaaaacagcagcaaactaataaaacctccccgggtgtttctagtttgagggtcatgcagctggacacctgggaaggagctgattttaatctagtttgagcatcgtggagctggacactcagggaggagcagatgtttttctattgtgaggattttggagctggagatccagggtggagcagtgttgttatagtttgaggtcatctgagggtcagctgcatgacccttaagccagaaaaacaccattttccccctgggactccagctccacaaacctcacactaaaacagcaacaccggctccttcgcaggtctccagctttacaacctaagacattcgtggcagcaccatctcctcctggggtctcaagctccaggaccctcagacttgaaccgcagcaccagctcttccccggatctccagctcgatgaccttcagacttaaacaacagaaggatcgactcctccctgggtctccagcaccacgaccctcaactagaacaccatgagctcctccctgggtctccagcaccacaacccaaaaactagaagaacgtcactcccccatggatctccagatccacaccctcacactagaacaccaacaccggctcctctgtgggtcttctgctgcacaatctaagacatcagtggcagcattgactcctcccatagattccagctccaggaccctcagatttgaaccacaagaccacctccttcttggatctccagctgcacaacactcaaactagaacaacatcagctccaccccgggtctccagctccattacactcaaattagaacaacatcagctcctctttgagtctccagctgaaagatcgtaaaacaaggacaacatcagctccttcccgagtcttcagctgcagggcactcaaactagaaccctcccccgtcttcagctgcacgaccttcagactagaacatcagcaactctcctggtctccagctgcaggatactcatattagaaaaacgccagctcctcccgggttctacagctgcatgaccctcaaactaaaaaacacccgctgctccccaggtctccagctgcatgaacctcaaactagaacaacatcagctcctccccgggtcttcagttgcctgaccctcaaactagaacaacatcagctcctctccaagtccccagatcacggccctcaaactagaacattagctccttcccgagtcttcagctgcaccaccctcaacctagaacatcggctcctctctgggtctctagctgctggacactcatactagaaaaacacaagctcctcccaggttctactgttgcacgaccctcaaactaaaaaacaaccgctcctcctcaggtctccaggtgcatgaacctcaaaccagaacaacatcagctcatccccgggtcttaagctcatggccctcaaactagaacatcagctcctccctgagtcttaagctgcacaaccctcaattgaaagcatcagctcttctccaggtcttcagctgcaggacactcacactagaaaaatgcaagctcctcatgggttctacagctgtatgaccctcaaactaaagaaacaccagctcctctctgggtctccagctccatgaccctcaaactagaaccaaatcagctcctctttgcatctccagtcgcatggctctcaaactagaacatcagctcctctcctggtctccagctgtaggacactcatactagaaaaacgccagctcttccccggttctacagctgcatgaatctcaaactaaagaaacacccgctcctctccatgtctccagctgcatgaacctcaaatcagaacaacaccagctcctctctgggtctccagctccatgacccttaaactagaaccacatcagctcctctctgggtctccagctgaaagaccctcaacaagaacaacatcagctcccctccaagtcttcagctgcacaaccctcaaactagaacaacatcagctcctctccaggtctccagctgcaggacactcatactagaaaaacaccagctcctcccgggttctacagctgcatgaccctcaaactaaaaaacacccgctgctccccaggtcttcagctacatgaacctcaatctagaacaatacctgctcctctgtggatctcaagctccatgatcctcaaactagaataacatcagctcctctccaggtctccagctgcagtatcctcaaacgagaacatcagcttctccctgagtcttcagcggcacgaccctcaaactagaacatcagctcttctccaggtctccagctgcaggacactcatactagaaaaataccagctccccctgggttctacagctgcacggccatcaaactaaagaaacaccagctgctctctgggtctccagctgcaggaccctcaaaccagaacatcagattctcccgggttctgcagctgcccaaccctcaaactaaagaaactcctgctcctcccagggtctatagctgcatgaccctcaaactaaaaaacaccagctcctccccagatctccagctgcaaccctcctattgctcctttgtttgttacccatatttctccaacttctaagaagttttgttactaccttggttcatcagaaaacttcagcacaaatgtattacatgaatgtcttgtaatacacaagtgtattacatgaatcactgtcgatctgtcttgcagaaagacctgggtagtgaagatgagagtgagacctcccactagtgagtaaggttctcaaatgggggaatgaagagagaggttaaagattagcccccctctaatcacatatgctatctctgaatgtcaatctatcacaaccctttcacgtgaaccccttagagttgtaagttcttaaaagggccaggaactctttcttcagagagctcagttcttgacatgcaagtctgctgatgctcctggccaaataaagccacttccttcttaacccggtgtctgagtggttttgtctgtggctagtcctcctacaccaccatgattctaactttcctgaggttttctcagaagccactatgcttctcatacagtctgcagaaccttcagccaattaatcttcttttccctataaactacccagtctcaggtatttaatagcagtgaaagaatggactaatacttgattattccagctaaacaaaatcaaagtagacaccatgccattgttagcaaattcaggctaaatcaccaaccaaaaatatgtgtgaatgtctcttgcaatatgtgtaatgcatctttgtgtaatatgcatatttgaatacaatttatatttatgttttctgaagagataaaatcattgggattcttttacattcagaatccatgaaggtccttgaactagaaggtatgattaatttcaaaataaatttgaaaattagttcataagtcaatggcaaaattaacataggtgggaattaatgttataatttcatatactgctttcataatttagcagtttttcatactgggaaaattataaataataataggaaatatattaatataacaaattgtatacttctggcccaatttcttcttcttttctgagaatatataattactatttgatatagattttttatgttagccatagacaatccttaattgaaaaatcatttagacaatctctcaaactttaagttaattttctatgccacattttcttaactcatcaaaatatgcattatattgattttcaattaatttattttgaaatgaatgaaataaaaatgtgaaaaaagttatccaaaatgaaacaacagtataggatgattaacaagattaacatattagtcaatataaaattccactgctatattgccatagctatggaactgttgtgatatgttcattctactaaatcctaatatttaaaaaaaaaaaaaagaaaaatgacctccagtacatatagaaaattggttgctttagtatgcattaactaattttgaagaaatagcaaagaaatgttcaaactttctttgttttattaaaacaatgctgtattgtgttagactattgaaaaacaaaacgaatagggacctgtattctttgaactgatgagcttcttgaaaatagaataaataaccctggcattggacttttaatatggtattgtttaaaggagcacttttggctagcaaaattagaaaggattttttattttttcatcctctatatatgctgttcctttctccagaagacaagccaatggtatgtgaaagagctttaaatttttcactcaaaataatcacgtagagataaaaaagaaccgaccttctattatatcaccggtctaagagaaacgtgcgttttaacttcaccctcaacagagtaagctcttgtggccttagtgcttatcatgcattttcagtagggaaagaaaatcacaatgaagaacaaaacattttcaacttttaaaaactaaaagagggaaaatttaaggcagaactaaattaagtagcaataaattagggctggtttagttggtggtttccaataagctctacagccacttccttcaccaagtacatgagtgttgcttcagcaatcattcctttaattcatgtcctttctctctctagaaaaactcatatattcattatcctaggagtatcaggtttgcaaagctggaccaaactaaagactcttcgaggtgcactttggcttcttaaaagagctaccaagattttggctgaggcatgtgacttaaaactcagcaggtatgattggcaagctatcctgtgaaacttgtaatcaatcaccatcggttttagtgaattgtattatctttgttcttgtaaacactttctttcaagttatcattgcttgtgattgaatcatgagctcttagatttctaagggaacagaaaacctatgaaacatttgaagcacttttgaaaagaaacttcgtggccagaaactcaccaaaacctgaggaaatcttttttattttgaaataaaagaatgcttcctttgtgtttctgtccttgaatccagttgttttacttgagattatagcaaagtcttctctgtcttttatataatgattctttaatatttgacctattcctcttcccccacctcatttatgagttatgtctattccatcttaaacattctcaggttcttaactgtatctgctactgtaaatggtagtttagtttttgttattttgattttttttgtttattttggtttttttctagctttattgctgtataattgacaaatagaaattgtgtgctacgagttgatgtgtagctattcatatatgttctgaaatggttatcacaatcaagttaattaacatatctattactttatgtagttaactctgtgtgtgtgtgagtgtgtgtgtgtgtaatgagaatatttaacacctaccctattggcaattatctccctattttcctttcccccaaccccacccttctactctgtgctgctataaatttgactattttagatttcacatgtaagtgagattatgcagtgtttttttcctctgttggattatttagcttagtatcatttccttctggttcatacttgttattacaaatggcaggatttccttctttttcaaggctgaaaaatactccaatatatttgtgtgtgtgtgtgcatgcacgtagaatccttcatggagtcatttatccattcctccattaacatttaggtttccctgaattggctattgtgactaatgctgcaatacacatcggggtggaggtatctctttgaggtagtgattttatttcatttggatatacatccagaaatgaaactgctacattttatgagttctaattttattttttgaggaatttccatactgctttccacgttgactgtattaacttacattcccaccaatagtttacttgggttttcttttctccacatctttgctaacacttgttatcttttatctttttgttaatagccattctaagaaatgtgaggtgataactccttgtggatttgatttacatttccctaatgcttagtgatatgaaacatttgtttcctatacctgttggccatttgtatgtcttctttggagatatgtttagtcaggtcctttgcccatattttaatagggtttttcatttttttcactatggagttgtatgtgttccttatatattttagatatgaaccccttatttgatgttttgaaaatattttctcccatttttcaggtgtgtttttatcctattcattgttttgtttgatgttcagaagcttcttagtttgatgtagccccactagtctatttttgcttttgtagcctgtgtatttggtgtcatataaaaaaaattgccaagaccaatgtcaaggacatttttttctatgatttattttactagttttacagtttcatgttttatatttgcatatttaatctgttttgaggtagtttttgttcagtatatggtataaaataaggtttcagtttcactcttttgcatgcggatattcagatttcccaacatattttattgaaaacaatattccttccccactgtgtattcttggcacccatgtcaaagattagttgagcatataggtgtgaatttatttatgggttctctattctgttccattggtctgtgtgtctgcttttatgccagtacaatactgttttgattactatagttatgtaatacagtttgaaaccatgaagtaggatgcctccagcatttttttccttgctcaagattggtttgactattcaggatttcttatgtttcagtataaattttggtttccaaatccaaatactgtttaatatagtgaacaaatctttgttttctttctgaaaccatctttccaatatatctcagaagtcagtggtcttaatgaattggtgccaccatctttccttgctactcaaatatgtgttacataaatttgaaaattatttgaaagaaaatggccaaatatatctccttcatatttctccttcatgtgtttttttatcctgaaaataaaactgcaagagggaaaaaacaaggaacaagcaacaataaagaaaaaaaaagaagtagagactaggtaactaagagcaagataaaaaggtgagttttttcactggaggattggatgaaagaactaattaatttgtctctcagtttgagcttttcaagagttctttataagtccttcatactgtgacatgatctgttagccattttcactgtggtccccattctagaagcattttactctctctctctctctctcttttttttcttttttggcgggaatgggggatgggagtaggggaatggagcctcactctgtagccaggctggagtgcagttgctgatctcagcttactgcaagctccacctcctgggttcaagcgattctcctgcctcagcctaccgagtagctgggactacaggcacgtgccaccactcccagctagtttttgtatttttagtagagatggggttttaccatgttggcaggatggtctccatctcttgacctcatgatccgccctcattggcctcccaaagtgctgggattacaggcgtgagccaccgcgcctggcagcattttactctctttcacatactttcttatatttatccttagttttttgaaaatataagagtgacattataaggaaaacttaaattgtgagtagctcctagtagaaatggcctcctacttgacttttctctcctgttttgcctcaaatcattcttcctggttaattgagtatgatttctaacatgaagaaacttgacttctggctattagcaaaaaacggaaattttttctctattgttatattatcatatggcttcagctcatggcaacacattttcactttagtcaattctaacagcatttggatttagcagtgaaattgtttgcatctttcattgataattttttccaaagcagtgtaaaataaaatgtggttttgatctggaatcactttttcctacatgcacatgcacacccacccacacacacattattaggtgctcacatccttacaatggcacaaacaactttgcactgaaccctttactagtcacttacacttctcttgacttgaatattctgcttatttatcagtgtaatggtttttatccaaataaagtaaaacaatagaattcaggccaattagcctttatatccttgttgaaaatatttaatattacaaataattttgtttttatttagtcctctttaaatttgtctttcactgtataagacaggcaatatattcatgtttatcatgtcaaaaaactgaatcaaatgttaaagtgctttaagaaagcaacagtatgaaagctgatcaagcccactgtggtctgcatcttctttatatgatatactgcctttcagaattttggagatgttattaaaaaatcaaatttttgaggtcattgatggcatagcatgtattacattctttatctcttcagttactagaactaaaacactagatcgattttatatgtatgtatgaattgataatctcaaatttttacatttttaatttaaatatttacatgtttaaattttcatctcttttctgctttttttcccaaaatatattgtgttccttagttctatgtttatatttaggaatgaataattgaacaaactaatttaggcagcttgagtggatgtcctcttcacatacttgcctctaccccagaacatgagaagtaactgtcagtaattattggcaagtattagttttcagagatgtgagcaaggaatggacatgccctatctccagcctacgtgtatcctcaattaaaaatgatttggattctgttccatgtctccatgcccactcttggatccccaattttgggcagacagatcgatcaatttctttagaatatattaatctggactcagcatgaaagaaaataccccattgcaaatatggcttggaaggcagaatagtttatctaatttatatacccatcttctcaaatctgagatctctgtaaataccaacttccaaggactcttttgtgaagagcagctttctccttcactgactcctttttctgctaagtctatgagcatttcagttcattcctaaatgtgatatcatttgccttcctactgcaaggaatgtctttgtctcctggtatcttccttttctcctattcttaatagatttatgaattattctctattttaatgtcttgtggttacgggaatctcatggaagttgacacatttctcaatatgtgttatatgttggatcccatcacattgctcaatttgcatttcataattgtgtctttggtacttgttcatcttcattgtgttcctagcaagcaaaaccatccccttagcctaacatcactgtaacataaataagcactcccctagtttctatgcatccccaaaataaattcagcttcatgtaaatatgactattgataaagatgtccacttattgaatacacttatcaaaagatttttctggtgtaacatggatataatttctgtcttaagaactctaattctaaagaaacctgtgtatggatttcacctttaggccttagtttaaacttatttaaatttgtcttcatagatcttaccctctcaagctattctgttttatgacaaagaccaacactaaggttttttatatttatatatgtgaactgaaataacgttctaaaatattttaaatcctacaaattagtttctttcattaaacagaatcctttctttgtgttggacattaattcagtgttaatgtgaatataattgtcatggattaatattaaatatttgccaatatctccctttacaacaggattttttattaaagtgtgtggatgtctttttttctttataatgtcttaaaaagaagaaaactttggtcatactataaaagttgagtctgataatgttttattatctgggaaaccatttaaaaatagtttcattgttattaaaatgacatctgggttacatgtgaataattattaaaataattatagaacaacatgcatttgtgaggaataatacaaagagattctgtatacactttgcccagcttcccccaatgacaatattttgttaaactatagtgtaatatcatgacaataatattgacattttacagtccgtccaacttactcaggttaccccagtttggcttggactcatttgtgtgtgtatgtgcacatgtacatgtataaattctatagatttttattaatgtgtaggtttatgtatctaccatcacagtcaagacactgagaagttccatcaccacaggaattccctatgctaccgtttgacaaccatgagaaagcatttttaatatatctatttttacatttgggaagggtcaaaagtcctttcattagcccagctcctgtccagataatttaaattaatgatgtctgtgttcttgtatggatggcatcactgcttgaaatatagatctccagggtgctcctgctctcactctttctgagccatgatctattgcatgtctgtacatcatcaaagcaaattgcttcttcaatgatgtgtaagtataatacatcatcacaatgggacatggtgataatgcattacccagaaaaagatgactgtcatatttgacagacaaggtcaaggagcaaattcaggcagccccagcacatttcatcagcagcattcttggtatagaagaaagtttgtttgcttagaatgatccacttgaaatgtggacaaggctaaatacatacgtatgccctgggttgattcctttggtaaattaaaaacgaggtggttgagcttccattaaaatgacatctggatgacatgtgaatagtttttctgtccacagggtgttttgaatcatgtgtgtttcttactcattcagcatcaaattgttttccagagaaagctcttcaacaagattgcaaagtccttcagggtagtaactgtcttatacatcctttgtttctttcacagtgtctaaagcattgctgagcacatggaagacactcaataaatactcgtttaatggaattgaatttgtaagcaccagagactcatgcttccttttcacatagcttgacacttggctgcccaggatccttgcatgcaaggtggtaaggttactgtgggaaaattctgttggcttactatcccatttgctgtctgctctttctttgtttcttcctcctttttttttttttttttttttttttttgtagagtctttcagccaggagctatttttataaagaatttcattttttgctcatgaggattaaacttttaagtttggcttcagggtgtgagagaagtacaacttatgaaggttgctctgcactgcaaaaaggataggatttgaggaagggatgtttctgacattggcacagcagtattccgttctcccccatcccccagttgctgccaaattggcctttctttaaagcatacagtatttatttctctagtccttggatcatagcaattttatttcaatgtcaccagtgaaggagagaaaggcaatattttgtccaagagtgggatttgaaaatgagtcctctgaggatatgttagagcaacctaagtattagatgctggaaaaatggatcatttcttgatatttcggtaggacacatctccatttcaaatatatgcatgctacaatgcagtgaatacatagtgcattttagtcagctctaaaagtaaccaagccaaattttatacaattgatacagacaatgggtgttcaagtgggaatacatgttactggctctctgccggcatgatgaaatagaggaggcaaatagatacagctcacgtgccaattctggttgctcagtcacagttatatcaatatcatgttgataaaagttataaatcagggatcaatttgcaacatctaccaggggcccaagtagaaacatgtggtatgcatgacagttatgaatcaaccctggtggaggaaaaagatggagagtcatggaccatacgcctaacaaagtaattgtacctggtccaattttggaccatgagtaaaccatttaataaaaatatatcatagaattgttttgagattacattttaagttgcataagctataatgtttgttatgattatgctaattgtatatatcattagagaaaataatcactaaatattttgaaacaaaagaaacaatgaatttaagtaataaatataatcccactcagccagagacgacaagttattgatactcttgtagatacatttattatataaaaacaaatatattatgtgatttatattttatcttacatattattttaatatcgatatttttctctcataatacacctttaatatatttcaatttcaaaagataatttctgaaaaactgtttttatatttgcatggtagttaattatatggctatacataatttttttaaacaaacacctatatttttacattgaagaaggatctaaattttgtatatgaatcatactcatattaaatatttttgcaataaaaatgtttctacttctttagtaaaatcccaaaggctgatatattggatcaaatgttctacagatttaatgggatttattcagtacttaaaaggaattgtattaaattaaactgcacaaagtctgtgccaaattatgcacctgcaaacaaatgtatctgattagaaggcagtgcagtaagttcttttaaaaggcttgttttttaaaaaatgaattagctccaaaactatttatatattaaggaacaatttgagcatgacacaaatttcttgtttgcctatgtgttacctcatctttgagaaacactaggcggatgcacaaaatggcacctggcagaacaaagccatgtagcaatacataaaatgtaagcataaacaaacctcaaacatccaacagctacttcagctcagcacaggtgtgatgagaccacccatctatatctggtgttacagctttctgtctgatttcagataattcttatttcaccactttgcaattcctcccaagctgaaaccctttcaatactcacttccacaagcaaaccttagtttttcttcaaaaaggaagtgtcatatttcttttatgaaactatatatttctttaccacttaatatggataaaagtatgctactatttttattaggttcctatgattttcttctgtgtatgtcactgaaaaagtttttgactattgtttcccaacaccagtctccccataagccatgtaatttttttttcataaatttgcatcgcaaggtgaattttaggaatacatcatataacggagctgattctttatgtgtgtatactttctgaaagattccctatgtgagataagaaaaataaaaagcgttttccttgctctcatattcaattcaaatttatgaaccagatgtattggttccccgtgacacacaacaagcagctaattctctaacagataccaactgggtatactataacttagctcaattttgacactatctacctagaattattatcagatgctacaggttaagcactcagtctcataggactaacctcaatttaaaatgccaattgcaagcctggggttttgacctgtgcttctgagtgattggctataaatctgagttcccatcaccccttcctcagattcagctaatttgctagagaagctcaaagaacttagggaaacactttacttagtttacccattcactataaaatacattacaaagaatatagatgaacaagacagatgaacaggtgcatttttaaaagagccagggcaacgtatgaaagctatttacccaccctcccaggcacctccagggaaccccgacttttggattttttatagaggcaacattacatagacgccattgattatatcatttgtccttggtgatcaactcaaacatcactccctctctcttccctggagggttggggtggggctgacaactccaactctaattatgccttggtccttctggtgaccagcccagtcctgaagctatctaagggtcccaaaccaccaatcatctcattaatatgcaaagacacatcactctagaaattccaagggttttcagagctgtgtgacaggaaccagggtcagagagcaaatggatagttcttattatatcataatatcacactccaataagtcaacacttgcctcattcaagactgattctaataaagaatgataactattatttttcactacttaaagagtcagacctatgtggaagttgcactaaatccagttacaatttattccaccacgaagcttggaagctctatgacccttaatacaatgttaatgtgaaagttttatattgtctgcaaaccaaaaactatctgagactggtctcaattaatttagacatttattttgccaaagttaaggacagtgcttgggagacaagactgtgtctttctccaaagatgattttgagggcttcaatatttaaaggggaaagggcaaatgctggagagagagaaagacatttttaaaagctgtgggtagttaagaggcaagcagttgcattcttctgagtctttgatcagccattcacatgtgacagtagggtagaaaaatcgtcacttatgcattcatctagctcagtgaatctacattttttacataaaataaaataaacttaaggctgaagaagcaatcagataagcatttacctcagatgagcgaagtgaagactttgagttctgtcctttgtcctgtatttgtgaagacaagctatcaatgtacatggtcagggtaaaattcaacataactgtctcaggataaagatcttggggcccacaaggaatttgctcttgggaaaattatgagggagctatgtagctttttcatgtttttagccatcttagaaacaaaatgggaggcaggttgcatgacgcagttcccagtttaaattttccttttgactgagggagtttggaatcctgagatttattttcctttcacatattttgctcaatttattcatgaactgtgattttattcaaaattattttattttcaaattcattgcattcaaataatcataaaatgtgtacctgcattaaatgaggcagtgttgttctttttcttccttcatttacaaaagcttttttccacttttttcattgaataaaaaagaaacttagttatggctaggataaataatgtaatatgtgactattttgccagttatgtttcttctactgtgaatagcctatgccataaataacccatttttcaaatgagcaggcatttcttctattattagtttgcatgagctctttaaatatatcttatgtagcaattttcagttggttagatacatgagtttatccctagcttttctaatagcactatttccaatgttacacacacacacacacacacacacacacacacatacagcactcacttataagttgagtgaactccaggtaagataaaccaaagaattccatgccaagagacatttacaaatcttgaagagccagagaaaacccacaccgtacctttagagataaataatacaaatggcagtagatttcttatcagaaaccatggagtcctgaaacaagtggcacaatgcaatgctgaaagaaaaggccttttaattgagcatcctagacccagtgaaaatgtcctcccagattgaaggggaaatcaagccattctcagatgagaaaacattaatttgttattatcaaacctaccataaataatggctaaagaaatttgttctctaaacaaaggaaatgacgttccaaaaatcttggaacatctgaaagaaagaaacaatacagtaagcaaaacttttgtaaatacagtaggatttgttgagttttctaaaatatgtttgatggtagaagaaaaaattataactttgatgtggttctaaatgcatgcagaggaaattttttttttttttttgagatggagtctcactctgtcacacaggctggagtgcagtggcaggatctcggctcactgcaagctccgcctcccgggtttacaccattctcctgcctcagcctcccgagtagctgacactacaggtgcccaccaccacgcccagctaatgttttgtatttttagtagagatggggtttcaccatgttagtcaggatggtctcgacctcctgaccttgtgatccacctgccttggcctcacaaagtgctgggattacaggcaggagccactgttactcagtaatgcgatggctgggtcaaatggtattatttctagttctagatccctgaggaatcgccacactgacttccacaatggttgaactagcttaccgtcccaccaacagtgtaaaagtgttcctattgttgtttcctgacctaccgtctggcactccccagtgagatgaactcggtacctcagttggaaatgcagaaatcacctgtcttctgtgtcactcacactgggagctgtagaccagagctcttcctcttcggccatcttggctcctcctcaatattagaattttctatccttttttgtgactcatttttctctctgtgttaactacattctcttcaactacaagcaatttcctccacgtggctgaaaaaggtgactgcagtcaggtctatatcgtagtggtcatttattctaagaacacttatggtttgtaaggtcaagttagtgacttgattgtatatgaagtagagtcaaccccacacaaattacatgaaatgagagcgaggggatttttccaaagatgagaacaatggacatgcttcatgtctatttgtgtcttcagtcagtcagttttcagcatgtaatgtacattcccttcagagaaaacaaatgaactaacattttaaagactggactatggagaaaataaaagctaatacccaacctatttgtttttacatttggatttctccccattcatatgttgaataggaaatttcacgtttcttaaatagatttttaaaaagtatttaaaatacgatttcctcaaatctttgcacgtattttttctggttcattttgtttcacatgctagagaaaaataaataccagctacaaatatgaagcagaaattgtctattgagcattggtatcaaattttctactgagaacactgaaaacattatctcatttaaatatatatattagagtcttaggatggtcataacaaagtaccatagaccgagtggcttaaaacaacagaaatgctgttggatcactgttctggaagcctgaagtccaagttcgagttgctgacagggcaatggtccctctggtgtatatagaggaacccttccttgactcgagttgctgacagggcaatggtccctctggtgtatatagaggaacccttccttgactcgagttgctgacagggcaatggtccctctggtgtatatagaggaacccttccttgactcgagttgctgacagggcaatggtccctctggtgtatatagaggaacccttccttgactcgagttgctgacagggcaatggtccctctggtgtatatagaggaacccttccttgcctcgagttgctgacagggcaatggtccctctggtgtatatagaggaacccttccttgcctcgagttgctgacagggcaatggtccctctggtgtatatagaggaacccttccttgcctcgagttgctgacagggcaatggtccctctggtgtatatagaggaacccttccttgactcgagttgctgacagggcaatggtccctctggtgtatatagaggaaccttccttgcctcttcatagcttttggcagttttctgcacacctttgctgtcccttgaagctgcaaaatccagcctcttcgttgccacattgttccttccttgtgtgtatattggtcttctcatggccacttcttacaaagacaccagtcgcattggattaggaaccgtccttactctggtatgacctcatatttaccacttacatccacaacaaccttttctacaaataaggtcacactttgtaatactgaaggttaggaaacactgggtgtttggacttcagtatatctttttgttgttgttggggggatacaattcaactgataatactgtggggctaatataactcacattttacagatgaagaaatttgtgcatattgagtcatttacatagtatcacaagtaacagagccaggatttaaacagattccatctaccactgaaaaaccacacacagaccagttattcacctcactacttcctgcagccgataactgttttccattgcctgaatagggtataactgccaaaaataagaacaagaaaaatgtatgaaacaagaggactttcatagcaaaagagacagccactgtatagaacccagcacactgcatttttcagaacaaaataatagatattttaaaatgaatttgttagccaaatagaaagtaaagtctggggcaaatatctctaccacatagataatccactgatgacttacagttcagttggacatataaaatatgatagaacttttcaataattatccttaaactctagaagaactttgaggagtccttgttcatattgcttttctgaatataattaataagattattaagatcagtctgcagcagtttccttgtagatggaaaagttaattctcagttcagggtataaacgagaaagaacataattactattattggactaattttcctaataaagttaggcttgctagcccttagtacaccattgttaatttatacacatgttgatgaaaggcaagataagtaaagtctagtgagtttggaatagtttagaggtccccctcaacttttaggtatgtgaaggggatttttaatgaatgcttttaagttaacaaggaaaagaagggactgaatgatcagttttttgtattaggtggtctgtttcccactggaaaagttgttatgtggctaaagagcctggtttaaataaaaacaaacagacaaatttatgcagaaagttaacgaagactaaaaaccccagtgcccattgtgctgggacagcagatgccatcagcagatgcactggagtttactccagttctttactgagcccaactatataatggctatgcacatttaaatactttaaacacaaaacaggtaataaacacgagtggattgaaacaatgggcaacatgtgtggatatgagaaagtggagcgtgtgagaaaaagtcttttagagctaaagtgcaagcctcttctaaagccattaaaatcctttttgttttttctttttgagatggagtcttggctgtcactcaggctggagtgcagtagtgtgatcttggctcactgcaagctccgcctcccaggtacaagtgattctcctgcctcagcctcccgagtagctggaactacaggtgtgtgccactacgcccagctaattttttgtatttttagtagagatggggtttcaccgtgttagccaggatggtctcgatctcttgacctcgtgatctgcctgcctaggcctcccaaagtgctcggattacaggcatgagccaccgtgcccggctaaaatccatttcttacccctaacatgctgtgctagaaataaaaaagcaactctgaggccctaatcagattccgtagtctaccaattcgatctgtcatcttcagaactctacactaaacttctccaacatataatcacagaaacaacacaatagttacaacagcatgaatgttttctatatcatttcaagtcttccacaccataaagtcactaagaataggaaattcatatttacttatacttgcccattctcatttctaatagaaaaataatatagcaaaatgatttgaatgcctacactttcacaatactcactgacttatttgtaatatgaaacaaaacaaataaaaactaacctagtgacccattcatatatgcatgctttctaaaaggttttgtttttgtttttaatgattctcatttgcttaccacatcagtgttgcaatgttagtcatctggaattctagaaattgggggaaggaaaaattagaacacctaccaagttaagctaatagaatagtattttgtaatagaaacctaaaggtacatagaagatagatacggttttatcaaaataaactaccaaaactatactaaggatagggatggagaaaggaacgaaatcaagctttcaaatgactctggagagggtggttggaaaaggctgaaaatcattcagtaacatttctgaacatatatattcatacagaggaaataaagaaagtaaccctctaagataaaagaagctaggagtgttaactgctataaatatgtgaagagaaagaaacatcaagaaaagaagaatttttaaaaatttcgtggactgggaggagaaagggagttgatatttaaaaagacattaggtccatggagggtgccctccagatgttcccaagtcttgggcattcagactctaatcctttgtatgatgcataggaataaattagccagcctcttgttacccacagtgtgatttgtaaagcatcagcttcaaggttatcctggagcttgatagaaatagagacctggcggtgtcactccctgcttaacaaatgagaatccacattttcagaagaccccaggtgattcctatgcacatcaaactgtgaagagcactgagccagactacagagtgcaaagccctgttctaagccacagtgatgctgactctcctcaccattttctctctcaaggtcctgactgtgggcaaaatatagaatcttagagcctggattatagcagttttacacaagcagcacactgatggaagcagctacagaggaaaagagaactggcagctcttgaactttcaccctctttcagaattcttaaaaattcagagagctgttctttaaagagacatttttctctcagcagttgaatctttgtagtctgacttgtgagaggacgtcaaagacttcctctcaggagtcagttccctgccattgcacccagctccttgcctagccttcttccacatctcctttatcacaggggcctcaaaactatagatggcagtgacttggcacggaccatacaattctaaaaggaagtcaacttagtgttatacttccacatggaatctgcgtttctaaagtagaggatagcattgaatataccaagaagtttcttcccagaaacaaaaccccgttctggatatagtgttaagaggaagctgttcctgtttcatgaggtcgtaatactcagatcggtgtgctgtcatcagccctgttgaatacatttccaaatcctttaggcttttgtcttttgccatactctagaaagtaaaaactataatcaaactcattttcttcgcccctttacgtgaattaatgttataatcaattgaactgcatggacatgccagtatctattttcaatctgtgtaggcagaatgaagaaagcataattgagcggtgctcatcttttaaaggcaaaatgaagttttcagtttggaattgattagttgttaggggattaagacctttgaggtaattccctgcagctggggcagttagacggcaggggatttgagtttccgccttgtaaacaaatctttaaagtggatttgctatttctgtggggaggggagcctctgtggaatttggtagttggcaagatttggcaattttctgcttgggaagaaaacaagatgggtctcaaatctaagtcctctttttctcagatcaacatcaccttttgaaaaataaattgattctttggccttaatgactactaaaggaaattaaaaacaaacaaacaaaacagaagaaaaatgattaaagaagccgggcgcagtggctcacgcctgtaatcccagcactttgggaggccgaggcgggcagatcacctgaggtcaggagtttgagatcagcctgaccaacatggtgaaacctcgtctctactaaaagtacaaaaattagttgggcatggtggcgcatgcctgtaatcccagctactcgggaggctgaggcaggagaattgcttgaacccggggggtggaagttgtggtgagccaagatcttgccattgcactccagcctgggcaacaagagtgaaactctgtctcaaaaacaaaaaaaaacaaaaaaaaaaaggaaaaatgattaaagtaagaatgaaaatttagttaatgttatttaggacagtaaaagcagatgtagtcacagaaagacaatgtgcagatgattatatggaaagaagaatgtgaaaccttcagatctctttaaaattttataatagctttgtattttcaaataaattgcaaagagtttctatacttgtatctagtttcccctattaacattgtacattagtgttgtgtagtgttttaattaatgaaacaatagtgataccattgattacgatttcatgaagtctgtagttcatttagagtcctttagtttttaagaagtgtcctttctctgttccaggatctcatccaggataccacattacatttagcagtcatgtctctttagtcgtctctttactgtgagtatttctcacacttctcttgtttttgatgattttgacagtttggatgagaattggttaggtattttgtaatctacacatcaactgaggcttgattgatgtttttctttaaaatatttttcccatttgtatacatgtgtggtatacaagtgcaattttgttacatgcatatattgcacagtggttaactcagggctttagggtatccatcacttaaatgatgtacagtgtacattgaagtaatttctcatttacccccccaaccccctcacccttgtgggtctccattgtctattatccactctacatccatgtctacacgttttataacacccacttatgagcaagaacatgcaatatttgactttttgtgcctggtgatgttttccttttgattaaactgggacacacatttatgggaggaagaccagacagataaagtggcattcttatcacatcatctcaagggcatacgccattgacatgacttattgctgttgatgttgaccatggacactgggctgaagtagtgtttttcaggtatgccactgtgaaattatattcccctgtttacaatactgtatactttagacataggttattatgtacaacccacacttaaaaagtggggagttatcttccacctccttgagggagtgaagtagtatctacataaattatttcatattcttatacaaagggtatttgtttatttcatttatttatatacttgtcttgatacaatgtaaatgaatcactacttatttatattattataaacatataaatatctatagtatagtttgggttacaatccaatacttattttgttactcacattgttcttgctttgaccactgggagatctttcagttggttcttgtaatacaccatttttaaaagcaaaatggagctaagtgtggtggcgcatgcctgtagtcctagatactagggaggctaaggtgagaggatcgcctgagcccagaaatttgagactgctttgagagctatgatcacatcactgcactccaatctgggtgatagagcaagaccctgccccagctaaaatgaaaacaaaaaacaataacaatgctacatgggaagtgagcatgacaatgtggtattttataattatatccaaagattagtaagcatgattcatggagaagtggctaaatctaagcattgttttcccatgagattgctgttggaaaagcaatagaaaaaaaaaaacaaaaaacaaagaattgagtgagtcaagagataggaagtctttcagttaccttagagtcacgttaggtatgtagagaagcagttcagattaacaaagttcaaaagatcccaccgtcagatctgtataacaagctttgcacacgaaagagctagagtatctgtgactctgatgtaagaaggtattaacccagtggaaaataaaaacaaaattaaaaatgcctaggtagactcatttatggttttatagtatccctactggggcacagatgggaagggagaaactgtttttaaataaaatgatcagaaacttagactgtgacattaatttgttggttcagtgttttaatttggaggtaaattatactaaacagtattatgacattttctgtagaaagtcttctacgtgtattgagtcactgcctgttatattggtttaatcagcaagtcatttttgctgaatctcttagtctccactaatattgtcttgaaggtgtaaatggcatgcaggttgcctaaataaagctacaacattctgtaaggcattttgtgaatgaactacttttgcagatggtacaggtgttcacccctgtaaactcacaattattttagaagtgatgtacaggttgtcagttgtccccatctgcctcattccccacatgcattgtcacctttgtgtcaatccagatctcattagctctttgtagacaaagatagaatggtagataatatataagtaaatgtggctgtgtttttgctcttcaagagaatgcacaagagactcactcttaattcttactatttcatgtatgtgcagcctcttaatgcttactatttcatgtgtgtgcagcttcttaatgcttactatttcatgtgtgtgcagcctctacaactacagtgcatctctattgtttgtacagtgacaataatggtaagaataataacttagtacataccatactgcagaaactgtttaaattacatccaatgtgcccatttaatcatcactttaaaatagtaactcctactcagtagcaatgtgcagtttatagatatctttcacatttgaagatatgaatctcagtgtacatatattggtatgcaaaaaaatcagttatatacatgtttagaccacttatattttaatcccaccaagcatatggaaagcttaaccttatgggtgtgtgtgtgtgtgggtgtgtgtgtgcaggggttctctaaacttaaaacctgttgtggatgcacatgaaattatatacagtgccaagaaggggcacaggccctgctcagtgagtcatctgactgcacgagttaatagatataacgtgaagggtcacagttctctatttgggtttttttgtacagcctctgtttctctgtctctacaaagcacgtagcctttttttcaagtctcgatgcctctttcacagctcagccctgggcctgctatcctgttttcactgcttcccttcttttttctacatgactttttattttactttaagttctgggatacatgtgcagaacatgcaggtttgttacataggtatacatgtgcaatggtgatttcctgcatccatcaacccatcatctatgttttaaggcccgcatgccttaggtatttgtcctaatgctctctctccccttgttccccaaccctccagcgggccccagtgtatgatgttcccctccctatatccatgtgctctcattgttcaaccaccacttatgagtgagaagatgcggtgtttggttttctattcttgtgttagtttgctgagaatgatggcttccagcttcatccatgtccctgaaaagggtatgaactcattctttttatggctgcttagtattccacctacatgcctatttctgagtcaagcacgttgtttatgcccagtgcattttctttatacacagaggctgagaaagaaccaggaagcctctgactgtttcaagtgtgttctctgctatatctatctactgattcaataagcacaagctcattgaatggaaaagggcaatatgcaaagggagcaaaatgagacatatatgtcaaaggaaagttccactgcaaatgtctttatttgatgtacacagagggatttgaattaggtctaggttttatgcccactttacagaaaaattgaaacttgatcaaacctatagaaccagtaaatgtcaggaccagacctggagacacactcccctcggtgcatattttatatcttcttcattttatcaccccaaatcatttactcctgaagtaaattcatttaatatttaacaaatgtttacaaaagttgactatagtaaaagtattatgttagctgctatgaagtagaaatataatcacacgattatcttaatgaagcatctctactttatagaagggaaattgagattctgaatcattaaggttttaagtgtcatcacagggattgttagtgatagaatacagagttgagtctagggcttattaaactgtatctgtcactctattcgtgtattagtctgttctcatgctgctaataaagacctacccaagaatgagtaatttataaaggaaagaggtttaatggactcatggttccacatggctggggaggcctcataatcatggcagaaggcaagggagaagcaaagtcacatcttacatggcagcaggcaagagagcacatgcaggggaactaccttttataaaaccatcagatcttgtgaggcttatccactatcacaagaaaagcataggaaaaacccaaccccatgattcaattacctctcactgggtccctcccacgacatgaaggaattatgggagctacaattcaagatgagatttgggtgaggacacagccaaaccatatcaattggcctatttcagtttgagaacatacatctgaatttcaaggaaatttgactacaattgaagaaattgagtatcattactgatttctaatggatgttgctgtatgtaatattttctatatgagagacaagatgtaaggatgaagatgagggacaagttcttcatctagaaagatcaagggtgctgtcaaggaagagttgaatttgattcagaactgaagaatatttgggctttcaactagctcagagaaattctgtagtcactagaagatccttgcatttgagagggcaaatttgaatatgttccacaagtaaaatcagaaattgggctttttattttactaaccagattaatgctctattccagaaatgcaaataggttgtacttttattttaacatggggctacttttgcctactgttttgctggtttttgttgttttattgcaaaaccacaattactgttacacaatggaagctccatcagtgaagatactttatctactttcttcactgttatattatggggtaaaaaagtgctttgcgtatgagaacaagtaataatgaaactggttacttttggcagagtctgcgttatacataggctcttttgtgaagatctaaatatggttatgtaatcagttgttcagacaagagaaacgtagattaattgaattagataatcccagtggtctctcaaagatcaaacaataaaacaaactattatcgtaccccatttgaagtacttttgtataacaacagcgttttaacatgtttatttggattaagattatcagcgactttggaagtcaattaagtgtgaaagcgaaacatggtatttgacgacagtaccagccctgtattgctgcaaatacattctataatagcactggacgcatcattcagattttatgacaagatgcaataaccagctacctgtgatgataaaatagacttttttcaaataagatttctagcaacctttactatgcatgttttctttgttgtcttgtaacattaaccatggacatcacatggcaagcatgatgaagagaatttctttagaatcgagttttataacaaagaatgtattccaaagtaaggatttatgttggtggataattatgagccaggccgactactatgaataacttacatcagggctagggttggagaaaatgaggagagagtagtacaattaaatgatcaatcataactagtctatttgtttatacaataatgaaaaatagtagtttctattggactgaaatgtttcaggtaaaattgatgttatatcaaattaattaaataataaatgtaattgccttaaatcaatgcatgcttaggattaatactgattaaaaatctaaggatgcaaaaagatttataacaaaatgacagtaacagtggtctttcctcaatctctttttctcccaaaagcaaaatctgtttataattttaatttttatgagagctacttatataaaaatgtagacaagaagaaattattttttctacttgtgcatctgaaagtatcttttcttttctttccttccttcctttcttccttccttccttcttctttccctccctccctcattcctttcttccttcccgcctttcttccttccttctttccctcttttctctttcacttccttcttctcttatcactcctcccaaatttaaaatcatctgtccattgtctttgtcatccagtatagataataaggaatctgatggtcttctcattaatagtgaacttgctgtttttctctcaaaaatgagaaagcttttgggagcttctttttatcttaagtgttctgaaatttcaagacagtatgcctgggttctttttaaattccttttgctggatactcaggtttcaaatcagaaggtttatgtccttcttcatttctgcaaaattatcttcaattatttcttgtactatctattcttcatctgtgttcttactgagataccgaatcatctgaatttgttccttttttgtatttttttctttcttcatattttataagaattattcagctttattttaaagtcctatttttattctctaagtgactattcttgtatttaactttttatagcatggtctacattttaatggttgtcatatatttttgaatgtttatttacagagcatcacttttaaaattgttttctttccataaattgggtctgtttgttttggaacaagcttttccatgtatttttctttttcactctctttagtgatctccagctgtcaattcatgttgtagaaggacagtgatgttggtcacagattccccaaatgctaaggttaggtgagaaccagcatactcatcaaagatcttcattttccccaaagacaaaatgcagtgcttttagaaaaaaattaattacttttgggatgttatttccctcatgataaacatggttgccatttacactctctactgctttgagagagaaatttctgtcaagctgtgaaattggtccacacacagcacttcaattaatttcagtttttgaccctcattgtcttctcaaaacgatcagcaccttctcaatctgaagtcacaggatggcagaggttctgcttagcagactctcccactttgaattgcagtgttttgttttacctctttcatctattttccaatttttagaaatttgttgactttttttgtaaactttttttgcatttgcacttctacatttatttatattattacttttacttctgtgggatctcagtaatgaaggaaacatatatgcctaggttaccatattgaattcaacatagagagtatgattttttaagtaaatcctgaaagaaaactttctataaatctacaaatcctcttgaaattttctttttatatttatttgcaaatttttaatttcttgtatttcgtaaactgagaattttagatacttttacatttgtagcatcaaaaataattttttaaaatgatgacatacttagagtcaatctattgggattgagtgtatttttaaaattagaattgttaaaatagtatttgacatttgctttgcttctggtactggtaggctagtttgctgcagaccaactttcacaccaaaaatctctagaaaaaaagacacaaacttcttatctcaaaatatccatgtttcagcagaggttagctgagttttgctgtattcagggtgtcattgggactgcgatctcgtctgaagcttgaggtcctctcctacacatgttcaggttatcgttccttgtggctacaggactgaccaaagttgtttcctttctggctcttggccggaggatatgtcaagcttctaaattatgctcacaatcccatgccaagtgtcctccatcataggacttctcacaacatagaagactgctttgtcttcaagacgagcagaagagcatctttctcacattaaatctgacttatcttgtccctaacctcttgacagcatttaataaaagctaaattcgttagatcagactcacactgacctaaacataagattaataaggatcagctttctattggttaatttaaagtcaagtgagtaagatgctaattacatctgtaaaccgctttgctatataaaataacaatcttggcagtaatatcccctcatattcacagtttcctcttacactcaaggggagatgattatgcagggtttatgcacatggaaccagacatcttgggagtcatcttagaattctgcctaccatgaagtctacataaccaaaaccaggagaaagaaaaagaaaaaaatatatagttcatgggaaatccagatattggggttatcttaagtaatttcgaaataaatatttaatatgttaagtattttaaatgttttaaatattcaaaaaattagatggccatggaaatgttcattagagaacagaaattaggattgctagacttaccaaataaacatatagagttccaagttaattttaaatatcaagtaaatagcaaatactttatacaatatatcgcatgaaatatttgggatatatttatactaaaagtttattgttactgaaattcaggttcaactgggtgccctttatttgacaacactaactgtaaactatcaaaataaataaaatttttgaaccttaaaatataacaaatacaattaaagactcaagaggttcaaagcacaacagactagatatgactagatataattgacaagaggatgagtaaagtgctaagtaggtcagagacaacatatactgaaaaacagagagaaaaaaatggaagattcagaaaagcataagaaacacatacgacatagtgaataaatgtcaaaaatatttattgtggttcagaacagaaaaagaatggagaaaaagtattatttaaagaaataatggctagggatattctaaaactgacaatagaaaacaagtaatagattcatgcaacactgcatttattaagaaggataaattcaaataagccatacctaccacatcatggaaaatagtaaaatgaaaaaaaaaatcctaaataagctagataagaaagtgtcatactacctttaaagttgcaacaatattataacacgtttaattgatttactataagaaacattggaaactagaagtcaaaaactgtgatccttgaatttttcttagggggcaggtaccatattgccaaactagaattttattcctggcaaaaacattctttaaaatgaaaagacaaataatggagaatgaacttgaaattgaacggtttagaattacaaagattttttcccctatttccaggtgagctcaacagccaattaagttttattataaaaaataaagcagcttatatctacttgaaaaagtgaaggcaaaattaaaatgttttcatttaaactaaaagtcataggatttatcactagcagaactacactaaagagctcttcagccatcatgagaatgttttgaaatataagcagaaaggaatgaaaaccagtgaaaaggatattatgtgggaacatctaaaagaatacttcccatacaaagcaacattattaattacatagtttcatgcacgtccgtgtgaagagaccaccaagcaggctttgtgtgagcaataaagctgtttatttcacctgggtgcaggtgggctgagtccgaaaagagagtcagcgaagagagataggggtggggccattttataagatttgggtaggcaaaggaaaattacagtcaaagaggggttgttctctggcaggcaggagtgggggtcataaggtgctcagtaggggagcttttgagccaggatgagccaggagaaggagtttcacaagacagtgtcatcagttaaggcaggaacaggccattttcacttcttttgtggtggaatgtcatcagttaaggcaggaaccggccatctggatgtgtacgtgcaggtcacaggggatatgatggcttagcttgggctcagaggcctgacattcctgtcttcttatattagtaagaaaaataaaatgaaatagtggtaaagtgttgggacagcgaaaattttgggggatggtatggagagataatgggcgatgcttctcagggccgcttccagcgggattggggctggcgtgggaacctagagtgggagacattaagctgaaggaagattttgtggtaaggggtgatattgtggggttgttagaagaaacatttgtcatttagaattattggtgttggcctggatacagttttgtatgaattgaaaaactaaatggaataagagaaggagaaaaacaggtataaaaggtctaagaattgggacgactcaggacatctgattagagagtccctaaggagattcagcatagtcctgccagcaaagattatttacttcaagagttaagagtggcagtttggggatagcaccaggagatatcagctgtgatggcttggagaaacagtgtaaaccggcagtgtaaacaagagcagggcatgtatgagtagttgagaatggtgaataggagtatgactagacagaagatagtagggatgactagttttttggggcacagtctaagttggtctggtgtctggaatgagactggggcctaataaaaaggagcgtctatacaggagctcaaatgggctgtactttgtagcattctgaggacaggtctgacttctgagaagggaaagtggtaaaagtattgtccagtcctttttaagttggtggctgagcttggtgaggtgtgttttaaaaagatctttagtctgttttacttttcctgaagactgaggactgtaagggatataaaggtttcactgaatactaagagcctgaaaaacttcttggctgatttgactaataaaggctggtctgttatcagactgtatagaggtgggaaggctaaactgaagaattatgtctgacagaagggaagaaatgactgcggtggccttctcagaccctgtaggaaaggcctttacctatccagcgaaagtgtctacctagaataagaggtattttagttatctgactcggggcatgttgagtaaagctaatttgccagtcctgggtgggggcaaatccttgagcttgatgtgtagggaatggagggggcctgaataatccctgaggagtagtagaatagcagatggaacactgagaagttatttctttgaggatagatttccacgatggaaaggaaatgagaggttctaagaggcgggctagtggcttgcactatagcatagcctgcctttgctgatgtgtggcgattaggcctggtggaactgccatcaataaatcaagcatgatcagggtgaggaacaggaaagaagaaaatatggggaaatgggataaatgtcaggtggatcagagagatacagtcatgggggtcaggtgtggtatcaggaataatgtgggaggccggactgaagtccgtgccgggaacaatggtaattgtgggacttaacaaagagtgagtacagctgaaggagccgggggagcagaaagtacatgcatcaggtatgaggaaggaaatagattttggaagttatgagaaatgtagagagtaagttgagcatagtttgtgattttgagggcctctaaaagtattagggcagcaggagccgctgcacggagacatgaggcctaggctaaaacagtaaggtcaagttgtttggacagaaaggctacagggtgaggtcctggctcttgtgtaagaattctgaccgcactaaccatgcctaggaaggaaaggagttgttgttttgtaagggattgaggtttgggagattaatcggacatgatcagcagggagagcacgtgtgtttttatgagaattatgctgagataggtaacagataaggaagaaatttgggcttgactgaagtaatgggggctgtctgtgaagctttgcggcagtacagcccaggtaatttgctgagcctgatgcgtgtcagggtcagtccaagtgaaagtgaagagaggctgggatgacgggtgcataggaatagtaaagaaagcacgtttgagatccagaacggaataatggattgtggagggaagtattgaggataggagagtatatgggtttggcaccacggggtggataggcaacacaatttggttgataaggcataaatcctgaactaacttgtaaggcttgtctggtttcaggacaggtaaaatgggggaattgtaaggagagtttataggctttaaaaggccatgctgtagcaggtgagtgatagcaggctttaatcctttcaaagcatgctgtgggatgggatattggcgttgagtggggtaagggtgattaggttttaatgagatggtaaggggtgcatgatccgtcgccaaggagggagtagaggtatcttatacttgtgggttaaggtggggggatacaagaggaggacgcaaaggaggctttgggttggggagaagggcggcaatgagatacagatgtagtccaggaacagtcatggaagcagataatttagttaaagtgtctcggcctaataagggaactgggcaggtggggataactaaaaaggagtgcttaaaagagtattgtctaagttgccactagagttggggagttttaagaggtttagaagcctggccgtcaatacccacaacagttatggaggcaagggaaacaggcccttgaaaagaaggtaatgtggagtgggcagcctccgtattgactaagaaggggacggacttatcctccactgtgagagttacccgaagctcggcgtccgtgatggtctatggggcttccgaggtgatcaggcagcatcagtcttcagccgctaagccgagaagatctgggaaggagtcagagagccttgggccagagttccaggggctctgggagtggctgccaggtgagttggacagtctgatttccagtgggttcctgcacagatgggacgcggcttatgaggaatcctgggctgcaggcattccttggcctggtggccagatttccggcacttgtagcaagctcctgtgggaggaggttctgggggaacgcctggctgctgtgattcaggcgtttggaagttcttgtgtgctggagatgtggctggggtttgtctcacagtggaggcaaggaattgcaacttttttctattattgtacaccttgaaggcgaggttaattaaatcccgttgtggggtttgggggccggaatttaatttttggagttttatttaatgtcgggagcagattgggtaataaaatgtactttgagaataagatggccttttgaccttttagggtctagggctgtaaagtgtctcagggttgctgccgaacgagccatgaactgggctgggtttttcatatttgatgaaagagactaaacgctcactgatttgggaaaggtctgataaagaaaaaggagcattaaccttgactatgcctttagcttcaccacctttttaagagtaaattgctgggcaggtgcgggagggctagacgtgcaatgaaactgtaagcaggacccggtgtgaggaggggaggtgataaaaggattatagggtggaggagccgaggctgaggaagaattgggacctagctcagcctggtgaggagcagcctggggaggaggggagaggtcagatgggtctgtagaaaaggaagattagaaagactcagtgacacttggggttgggactgaggggacaggcgggagggaaagaaggaagattgggggcgagttgcactgggtacagagactagggagggactgatgtgtaaaagaatgcctggacatcaggcacctcagaccgtttgcccattttacaacaagaattatttagatcttgcgggatggaaaaattgaaagtgccgttttctggctatttggaactactgtcaagtttgtattggggtcaactggcattgcagaggaaaataagatgcttagattttaggtcaggtgagagttgaagaggttttaagttcatgagaacacaggctaagggagaagaaggaggaatggaaggtggaagcttgcccatagtgaaagaggcaagcccagagaaaagagtagagacacggagaaggggtcgggggttcttgccctccagaaaagcagagaaggggttggggcacagagatattaggtcagggtgcagaaataagggatcagggtgcagagatataagaggtcggggtgcagaaataagggatcagggtgcagagatataagaggttggggtgtggaaataagggattggggcacagagatataagaggttggggttcctgcccctcctctagaaaagcgggacttgccgctaagagtgaaggagaaggggttggaggtttcttgccccccagaaaggcggtgaaggggtagagacatggagagaaggggttgaggtacttgcccctcccctagaaaagcgggacttgccgctaagggtgaaggaccaaggcaggtgtccctgtgtggtctgacacctctgaaatgtgggtgaataatcaggcatccctgcaatgattaaacaccaagggaaggctgccttcccagtctgtgacaggcaccggagttttgggtccatggataaaacgtgtctcctttgtctctaccagaaaatgaaaggaattgaaattaagagaagggagagattgaagtgtggcgccaagattgaaaggagaaagaggctgagggatagtgagggagattggagaagagagtaaaaagaggctgcttactagatttgaaattggtgagatgtttcttgggctgattggtctgaggacctgaggtcgtaggtggatctttctcacagagcaaagaacaggaggacaggggattgatctcccaagggaggtctcctgatctgagtcatggcaccaaatttcatgtgcatccatgtgaaaagaccaccaagcaggctttgtgtgagcaataaagctgtttatttcacctgggtgcaggtgggctgagtccaaaaagagagtcagtgaagagagataggggtggggccattttataagatttgggtaggtaaaggaaaattacagtcaaagaggggttgttctctggcagacaggagtgggggtcacaaggtgctcagtagggaaacttttgagccaggatgagccaggagaaggaatttcacaagacaatgtcatcagttaaggtaggaacaggccattttcacttcttttgtggtggaatgtcatcagttaaggcaggatctggccatctggatgtgtacatgcaggtcacaggggatatgatggcttagcttgggctcagaggcctgacacataggatttaaaatatggagagaataagaatacatggcaacaatagcataatagatggagtgaaattgagttaacatctaaatgccttgcatttttgcggaagctttaaactactatcttatattagaaatgaataaggatatatatcgtatgtttaaggaaattcaccatagaaaacaaaaaggatgtactatataatagtaaactaatgaagaatgtaataatgaactactctcaatataaaagaaataagtaggacaatataaaacagataggacaatttattttattttattttactctaagttctgggatatatgtgcagaatgtgcaggtttgttacataggtatacatgtgccatggtggtttgctgcacctataaacgtgtcatctacgttttaagccctgcatgcattaggtgtttgtcctaatgctctccctccaattgccccccaccccctaaaaggccctggtgtgtgatgttcccctccctgtgtccatgtgttctaattgttcaactcccacttatgagtgagaacatgcagtgttttgttttctgtgcctgtgttagtttgctgagaatgacggcatccagcttcatccatgtcctggcaaaggacatgaactcattcttttttatggctacatagtattccatggtgtatatgtgccacattgttctttattcagtctatcattgatgggcatttgggttggttcaagtgtttgctattgtaaatagtgttgcaataaacatacatgtgcatatgtctttatagtagaatgatttataatcctttggctatatacccagtaatgggattgctgggtcaaatggtatttctggttctggatccttgaggaatcaccacactgtcttccacaatggttgaactaatttacactcccaccaacagtgaaaaaacattcctatttctccacatcctctccagcatctgttgtttcctgactttttaatcaccatttaaactggtgtgagatggtatcccattgaggttttgatttgcatttctctaatgaccagtgatgatgagcttttattcatatgtttgttggctgcataaatgtcttcttttgagaaatgtctgttcatatccttggcccacttttggatgaggttgcttgatttttcttgtaaacttgtttaagttccttgtagattctggatattagacttttgtcagattggtggcttgcagaaattttctcccattctgttagttgcctgttcactctgatgatagtttcttttgctgtgcagaagctctttagtttgattagatcccatttgtcaattttggcttttgttgcaattgcttttggtgttttagtcatgaagtctttgctcatgcctatgcagataggacaaatttttaaaaaattcatagaatagtccatttaaactcaaatagttcagctattacattaagttaatatggacaaaatcctgcaattcgtaggcaaacaatttaaaattgaatactgaaacaaaatgtaactgtgttctgctgataagagatgtgtctttaatacaaaaataagaaagactgaaagtagaattacggaacatgataaacctaatcaaaacaaagcttgtaattctaaagaaactatactgaaaagcaagaaatatttatacataaagtttgaaattttataatgataaaaagataaaacaacagaaaaagatgacaaaaataactttgtaagcatttaataacctaatctcaaaatgaataaaacaaaaaagtacaaaataaataaacaatagaagaaaaataatgaatagctacatttacagtcatagttgaataatgcagtttttctcagtaactaaagaataagcaaaagatgattggataaattaaatatgttatatacatataatgaaatataattttgcaataaaaataaatgaagtattgatacatattacattaaacataaattcaacttgaaaactaagtgaaaatccagtcacaccctagacaaaaacttacaaaaagatattgtaaaattccatttttatataatgtatgtaataagtaagttcatggagttagaaagtattttggtgcttgcctgggactgatagatgaaggtgggggaataatgagaatgactgctgatgaggacaagtgtttccttttaaagtgatacaaatgttccagagtttgatgatggttgcacaaatgtgtgaatgcaataaaaaccactgaattatacactttatttgataaattataaattatttatccataaaactgcaaaaatgattttttaactaaaacttgcattcaatctcatccacctgtaaatggcattaaaattattttcagttcagtatattctagaccagtggttttcaaccaagcctaactttgtctcacaaggaacattcgtaatgtccgaagacatatttgattgtaacagtagaggtggagtgggtatttgcattaactaggtagaagccagaaatactagtaaaaatcttacagtaggtaagacagctttcaaccaaaacaatacaaaacaaaacatgtaactgccccaaaatatcaatagtgcaaaggttaacaagccctcttttagagacattgatctctattcctatataatttttaagcctcatggtaatagagtctatcttggaatgtgaatgaagcataatgtaaacattacaagcaacaacatgtcacatttttagaatttacatcattcagaataccccttagtatcacctgaccccaaagcttagaatgattttgccaattttgcaaatatgaaaacttagattatgttattctttttctaatgggccaagaaaggtataacactacactgtcactttttttttacttctatactaattactttctgaatatatatagatatctaatctatctatctatctattcttttaccacttaaaaatattattttaatctgtttaaaactaaggcctagcattaagagatatacctaatgctaaatgacaagttaatgggtgcagcacaccaacatggcacatgtatacatatgtaacaaacctgcacgttgtgcacatgtaccctaaaacttaaagtatcataataataaaattaaaaaaaaaactaaggcctaaaaataagaagtgctattttgtctgacagcaaaataaataagtagtttttaaaatagtaagctgaagtttaataattatgttaaaattatagtaacttttttctgcagtaattatttttgataaaaattaatgcaattacatgacataaaattaagatatagtttagtaagaaaaacacaaaacaataaccattgtagaatgaaaataagttttaatatatgaaagacttaagaatcctttaatacattaaactgactgatactagtgttctttgctgaatcataggtaacatatttattgatttttaaaatagggttagcgtagaataaatgaaatttataatttaatagtcatcaacttcacattcattttgcataccacaggagaaaaaaagaggctcagaaagattaagttctaaggataattgattttaaaattggggccagaattaggactcaaacgcatattttctgaggtctagccctttgtatattacacccttgctgaagactaaattcgagtgtgtgtcttattggcagtgagaaggcagatttgccaatatgtagtttctaaatcttgcatttatttctatacattttaaatttaatttagaaatagaacagggagagtaatgttagcaagatggtcaatcagagttgtttggcactcatccccacaaaaagggttgtggggttcccctccaacataacaaatgaacaactatatttcagtggaagttactgaggaagtatgctggggaacataaggggagtgaaaaaatccctgtgaagcacagaaactcaggatagaaccataaaagaagagggagacacacaaactctaccaaattgttccctcactgggattggctcatagccaggaggggctactgcttatcgagaaaaggtaagctggagacaccagttgtccccattactactgcagatgcctgcaggctgctacgggagggtcctgcaagcctcacagtcaacaaattctatctggggagctttctggagttcacatagctgtgttgccctatactaggagcccatttcgtatacccaccaactcccgtgacctaagttggaactgcatagtaccatcctgaaaccagactgactgctagagtatgtcctactctgggggccagtagccactgtgtctctccatccctgaggccccagcatcattccaccatgctcacaaggaaggccacagaactacaaccccagctactttaagcttaggcccagtggaatggcccaaatccatgcaacatcccctcctccctgggaaacaggcatatctgcacagcaagaaagccaacaagcagctgattggcctgtggtgcctgtgtgcctgacccaacaggaaggatggcagcagccccacccattgaagaacccacctcagagttggccagcccactatacctatgtaagccatgcctgacagccagactaggggtggccctgcagccctggaaagtccactacatagccagctggcccaccatgcaagtctgtctaaacagtgaggctggtagcgttgcccctaacaaaactgagccattacaatcacaaactcctgtagcctaggccactgatgaaattgcagacatcattgatgagaattatagctaatgaaactgcagagaaccacacagaaccaaagataatggatcatactcaactgacatcctagacacacctataggaaaaagtctctccttacaaaagttagcccgtaaagttggaaaagataactgttccaccagatatgcagatatcaatgcagagatataagaaacatgaaaaagtaaggaaacatgacatttccaaaggaaaataataattctacattaacagccccccataaaaaaatttatgcaattcctggaatttaaaataatgattctttttaaactatgagatataagagaatatggacaaacaattcaatgaaataagaaaaataatttattatctgaatgagaaattcaacagagggacagatataaaaaaagaacaaaacagatatcttggagctgaagaattcaatgaataaaagaagtacaactgagaggtttaacaacatactagccattttggcagcatatgtatttatgatttgtatagaagaaacagtttctaaatttgaagacagttcttttaaagtaacctaattagaggggagaaaaagtaaacaaaaataaaaagcaataaagaaagtctacttatgggacaccattaagtgaatgaatatttgcattataagaatgccagagggagaagatataaagaaaggcagaaatattgaaatagtatgtggaaacttcccagtcttagcaaacatatgaacaaccagatttagaaactctaagactcccaattagattacaacaaaaatgatctactccaaggtacattataatccatctatcaaaagtcaaagacaaggcaagaattctgaaaactgaaatggaatagtgtcaagtcacatataagagaattctattatactgtcagcagatcaatcattagaaaccttgcagcccagtagagaatggtatgacatattcaaagtgctgaaagaaaaaaaaaatactggcaaccaagaatactatatcagcgaagctgtccttcagcaatgaaggagaaataaaaaccttcccaaataagcaaaatctgagggaattcatcaccactacactagtctttacagaaatgcttaagatgatagtgctacaactgaaagtgaagataattactattatggaaacacatgaaaatataaaactcaccagtagagggcagctcataaccaaaatcagaatatcccagtgctataatagtgctatgtcaatcttttaatcttctgatataaagtttaaaaaccaaaggggtcaaaaaacaacttctacaattagtcattaagaaaaacaatagataaagacacacattaaggcaacaaatatataaattacagggaggggtcaggaaaaaatgtctagagtatttttatgtgaccaaaattaagttgctctcatcttagaatagtcgattataactacaagaacctttatgttagcttcatggtatccacaaagaaagaaattacaacaggtacacaaatgagaaagggaaaggaagcaaagcttagcacagcagaaaaccacccagccatagtagtaaataataaaagagaaaaaaagaacaaagagtctatacaacaatcagaaaacaattaacaaaatgtcaagggcaattcattgcctctcaataataaccttaaatgtaaatggattaaattcttcaatttaaagattgcattgttgaaaggattttgaaaaactaagaaccaactgtatattgcgtacaagacactcactattaaagataaacccagactgaaaatgagaggataaacaaagatactccatggaaaagaaaaccaaaagcaaaaggagtggccatatttatgttagataaagtacactttaagtcaaaaactgtaaaaagagacaaagaaggtcattatatttaataaagggagaaattcaacaaaaggatataccaatgataaatatatatgcacacaacaccagagtgtctaaatacataaagcaaatatcagatctaaagggagagatagactacaatgcaataatcacaggaaatttcaacttcccacttttaacaatagataggttgtctagatataaaatcagcaaagaaacatcaaacttaagctccaccatagtcaaaatgaatctaacatatacttacagaacattccctccaataattgcagaatataccttcttctcagttgcacatgaaacattctcaaggacacaaaacatgtttcaacatatttaaggtagagagtatatcaagtatcttttttgaacacaatggtataaagctagaaatgaacaacaagaaaattttagaaactttacaaatatgtggaaattaaacaaattgcttttatatcaccaatggatcaaggaataaattaaaaagaaatttaacaaattccttgagacaaatgagaatgaaagcacgtcgtttcaaatcctatgatatacaatgaaagcagttcaaacaaggtaagcttatagtaataaacacctatcacataaaaagaaaaagctttcaaataaacaacctaacgatgaacctcaaagaaataggaaagcaagaaaaaaatatataaattggtagaagggaaaaattaataaagcctaaaacataaataaatggacacaagaaaaacagttcaaaagatcattgaagagaattgttgattattttggaaaaaataaacaaaatttacaaaccttcagccagactaagaaaaaagagaaaactcaaattagtaaaatcagagataaaaaaagagacaatacaactgatactacagacatacaagagatcataaaagactattgtgaagaattttacaccaacaaatttggtaacctaaaaaagaaaagataaattactggacacatacaacctaccaaaattaagttgaaaatcataacagaccaataatgagcaagaaaattgaattagtaaaaagtcttccatcaaagaaaagcccaggatctggtggcttcactgatgaattctaccaaacattttaagaagactaataacaggtttttttgaactattttagaaaattaaagaggggagaatattttcaaattcattttacaaagccagcattacattgatgtaaaaacaagacaaagacacaagaaaaaaaataaataaactgcaggtcaatacacctaacaaacatagatgcaaaaattcttaacaaaatgatagcaaactaaattcaacagcacatcaaaaagatcattcactatgatcaagcgggattcatcctagggatggaaggatgttttaacataacatacacaaatcaataaatgtggcacaacacattaacagaaagaaagacaaaaacaatgtgatcatttcaatagacacagaaaatggatttgacaaaatttaacatccttttataataaaactctcaacaaattaggttcagaagcagtgtacctcgacccaataaaggccatacaaatgacagactcacagctaagatcacatttaatggggaaaacccaaaagattttcccttaagattagaaataagacaaggatgttcattttcactacttctattcaatatagtactggaagttctaactagagcaattagacaacagaaataaaataaataaataaataaatatagattagaaaggagaaaggcaaaatatctctctttttacaagtgacatgatgttacagaaggaaaacactaaagattataccagaaaactgttagaactaataaacaaatttagtaatattgcaggacagaaaatcaacatacaaaaattagttgtgattttatagacaaaggttaactatttgaaaaagaaatcaagaaaataatttcatttacaatagcaacagaacagaaagataccttggaataaaccagaggcttgataggtatttacactaaaaactatgaaacatcaatgaaagaaattgaagaggacataaagaaatgaaaagataaactctgtgttcatgggttgaaagaattaatattgtttaattggccatattacccaaaactgtctacagatttaatgcaatctatatcaaaataccaatgacatgcgtcacagaaataattttttaaaaatctctaaaacttatgtggaaccacaaaagacccaaaatgtccacagcaatcttaaacaaaaagaacaaagctagaggcatcacattacttgacttcaaaagacatcacctaactcccattacaatggctatgattaaaaagacaaaagaaaacaaggttggtgaggatgtggagaaaagagaactcttggtggtaatataaagtagtaaagcaattacaaaaaacaggatgcaggttcctaaaaaagttaaatgtgggaccatatgatccacaaattctactgaatatatacatacgaaggaaataaaatcaatatgtcagagacatctgcacttccatgtttattgcaacactatttataatagccaagacttggaatcaacctaaatgttcaacaaatagtaaatgtatacatatttacacaattgaatattattcagcaataaagaaatgaaactgtgtcatttcagaccaaatggttgaatacggaggactttaaatgtattcgtctgttcttaggctgttaataaagatatacccaagactgggtaatttataaaggaaaggggttttattgactcaccattcagcatggctggggaggcctcaagaaacttacaatcatggcagaaggggaagcaaacacgtccttcttcgcatggcaacagcaaggagaagaatgagtgcccagtgaagggagaagcccttcacaaaactatcagatcttgtaagaactaactcactatcaccagaaaggatgggggaaaccgcctcccatgattcagttatctccattggttcctcttacaacacagggtattatgggaactacaattcaagaagagatttgggtgaggacacagcctaaccatatgatatcatgttaagtgaaataaataagacacagaacgacaaacaccaaatgatctcattcagatgtagaatctaaataaatacgttgctcttacggaagtagatagtagaacactgttttaccagagatgatttggaaggggaaaatggagagaggtttgtcaatgggcacagagttacaattaaatagaagaaataagttctgttgttcgattgcatggtagggttactaaggttaacagtaagttgttgttaaatgaatttttgttgttgttttttttttttttttgagatggagctttactctgtcacccaggctgaagtgcagaggtgcaatctcagctcactgcaacctccgcctccccagtgcaagggattctcctgcctcagcctcctgagtagctgggactacaggtgcatgccacgacacccagctaatttttcatatatttagtagagatgggtttcaccatgttggccaggctggtttcgaactcctgacctcaggttgatccacccacctaggcctcccaaagtgctgggattacaggcgtaagccaccatgcctggacattaaatgaaatttaacctaaagctgcattcttacatattttaagttgagcctaagagtctcttcctacatagtgaactgtaacctaagtggatgtgtaaccagattataatttaaccttgtgccaatcactgggtttcagctaatcaaagcagccagttatccaaatcgtgttcaaataaggcaaacaccaagctgtaaccaatctcgctgtttctgtgtctcacttctgttttcagtacttcatttttctttttctgtccataaatcttctacgtggctgcactggagtcccctgagcctactctggctcagaaggctccctgctttgcaaatggttctttgctcaattaaactttattaaattgaatttgtctaagatttttcttttaacattacaaaacagctaggactgatgtctttgaacattctcatcacaaagaaatgataaatgcatgaggtaatgaatatgctaactaccctgatttgatatttatgcaatgtatacatgtattgaaaatcaaatggtaccccataaatatgtacaaatataatgtgtcaatttagaaaaaggaaaaaatagaacttgggaagaaatatatcttctaagaagatggcattttaggaaaacaatctctactaaacttattttcaaatgtttataaattgcataatttactttgaaagaggtatgaatgacttaaaattcagagtatcaagacttctaagttattaattgatatgtaaatacatatgctacattatgaaatataacatgttaataaatatatacctattgaaaaagtgtatacgtttatttctaagaaatataaactctagtacaattctattcctatttgaccagatgtctcctcacaacctaggtgtttgttttaatcatctctcttcctgctagactaacttgacatgtataaattctctactaatgcaattaaactgacctgcgtaagagacaaaatagccaatgacaaatctattactaagatcttgcattagtgtggtacatttgttacaattaaagaaccaatagtcacatattattttaactatagtccatggcttacattaattttcattccttttatcatacagttctatgggtgttgatatacaaactgcatatacctacagtttcatgaaaaatagcttcacctgtgattcacctatttatcctttctcttcctcctcacaagcctctggcaatgactgattttcttttttttttttttttacagtctctatagtttttctctttctaaaatcccatatggttaaactcatacagtatatagacttttcagatgggcttctttcacttagcaaaatgcatttgatgtttccctgtgtcttttcatggcttgatagttcattttgtcttcttgatatgccattacactaatatatcatagtttgtttatccatttgcttactgaagggcatcttggttgtttctaggttttggtgattataaacaaagccactgtaaacaggtttttgtgtggatgttagattttcacctcactcaagtaaatacctaaaagcataattgctaggtcatatggtaagaatacgttatgatttataaaaacctgccaaaccattttccacaatggttgtatcattttgtaatcttgtcagaagaaataagtgttcctgttgctgtgcctccttgtcgatatttggtgttggcaatgtgttgggatgtgatacatccattctaacaggtgcatatttcattgttgttttaatgggcagttcacatgtgtattttttttccttttctacagccgtattattccaacacttccacttgttgaatcgatggcctatgttgcttcattgggacggcagaaccaggtcttgaccataaagtaagtctttaattccaggcttttatatatgggagaagagtaattttttaaatccacaagaaatccttcacatattatgaatatatatggggcattatgtcaaaccacagtgtgaagggagaacatgccatctggagtgggggtttggaggcaccgggaaatgcctctgctttgaggagtcgtcgtccaggatttgagagagatttaaagtttattgttctagagaaggctttcattacccaagatttccccttccccaggctcttagccacagaagaaggggcgaggaggcagcaaggtgagtgagttgataggaaagggctgaaggaaaatgcttgaaaatactgtcagggctctggttgcttgagccttgcctcccactactccaccagcagagagcagcagaagagaagcaatggaatgggaagagctcctctataacttgtggaggggttcatttctcataggtgccatgggttctgcaaccagcaacacctgggaaagcagcatcttattctaagtcagagagaggctgagtccacttgccatgtccaagtggggcacctttgttctcactcgcagaaatatatagtatgagcctgtagtgccatagatggtagatgaagatggtctctacagacattggtcagtgttagctctcctcagcaggtatatggcagaaacagtcagcagacgtatggtggaaactcagaaaggacaggatcaatacacagaaggtagtggggaatgaagaatagggctgactggggacagtggttcatgcctgtaatcccagcactttgggacgccaaggcgggaggaatgcttgagcccaaaagtttgagaccaacttgggcgacatagtgagaccccttctctataaaaaacaaaaacaaacaaacaaaatagctgagggtggtggtgtgtgactgtggttccagctactcagtaggctgaggtgggagtatcacttaagcccaggaggccgaggctgcagtgagccgtgatcatgcctctatactccaaactggatggcagaattagtaagaccatgtctcagtaaaaaaaaaaaaaaagtaagaaaagaataaggctcagggcaaaagtaccatggcagaggctggtggtggacattaccaatgtgggagattaaagagtcccagaaagccagcagagtcagcaagattcaagatggaggcctagtcattgggccatctggctaagctccatgaacactattattgtctatccacacccttgcggatctcaggaacaatcaacacacgacagtagctacagacacatcagtccagacccagagagaacagaacttatgtccataactcaagtgacatatggtgttctccaatcagaggtcacagaagcaagccaaaatgaacatggaggttgatagagtttggatatttgtccccatccaaatctcatattgaaatatcatcttcaatattggagataaggcctggtggtaggtatttgagttatggaggtgaatccctcgtggcttggtgctgtcctcttaataatgagttcttgagagctctaggtgttgtaaagtgtggcacctcccctccgatctcactctgttcttactctcaccatgtgagaggcctgtccccccgaccttctgccatgattggaagcttcctgaggcctctgcagaagctgagtagatgccagtgccatgcttcctgtacagcatacagaactgtgaaccaattaaacgtcttttctttataaattaccccgtctcaggtatgttttatagcaatgcaagagcagcctaacacagagatccttgcttcttctatgagaatgagtaaacttaccttgaatacggtaacacccaggaaaagggcaaagaggaggtagaagggggagaaacctgaaataccaagcagttatccaaatgatgctgaggttacctgaaataaactgttttatactggaagcaacagaaatatcttgaagagatccattcaggatttttgtctttctccccaatactgagcaagaaaaaataatagcaaatacttaggcaacatttactatctaataggaactattctgcgtgtttcaaatatattaacctatttaatccttacaagaaccctgtgaaattattatacccatttcacaaatgagacccacagagattgagcaaattacacaaagttatccagctagtaagtttcagagccagaatttaattcaggctcttagccacaatgctatttttaagctttgtttctttttattttatttagaaacatggtctcactctgttgcccaggctgaagtgcattggtataatcatggctcactgcagcctcaaactcctgggctcaaacaatcctcctgcctcagtctcctgagtggctgaaactagaggtgtgagccactgagcccggccagccactatgctatgttgcctacctaaggcataataaacccagtgacggaaaataaagtttttgtggtcattgttttgttgttacacatatgaattgtagcaaatgcaccatgatccctactatagaaatgcaagagaataatttcaataacaacgataaagattggtgcgtagatgtactcaggttaatgggggcacaagaaagagggaaatggatttgtaaatacattcctgcagagggtaacacatgagctgggtctcagaaaaagagatctgtggttctgaaagttgactgtgtgctagaattaacaggaaggctttgctaaaacatgaaatactggggaccatccagagtttctgattctgagatctaagctagagccatatcacttgcatctctaacaggttcctaggtgctggtgacacagagggatcactcttcgaaccagagttagatggaaaagaacattgggaaagaaacactgggaaagaaagcaggttgagtggaggattaaatatgattagtttcatgcgcgtccgtgtgaagagaccaccaaacaggctttgtgtgagcaacatggctgtttatttcacctgggtgcaggtgggctgagtcggaaaagagagtcagcgaagggagataggggtggggcctttaataggatttgggaaggtaaaggaaaattacagtcaaaggggggttgttctctggcgggcaggtgtgggggtcacaaggtgttcagtaggggagcttttgagccaggatgagccaggagaaggaatttcacaagacaatgtcatcggttaaggcagggacaggccattttcacttcttttgtggtggaatgtcatcagttaaggcaggaactggccatctggatgtgtatgtgcaggtcacaggggatatgatggcttagcttgggctcagaggcctgacagtatgaagcaaggcaaaggagagagaaagcagaagttgggtaatgcttagtggtgtgaatttggagcagaaaaataacatgagccaatgtgtaacagaattccttggaaacctcaaaaattctgtttaaatgtgataattttaaagctaataaggcttaatgagaagaaaatagttctttgtgtataaacattttgagaaagagaatcaaaagacgctgaaatgcttcagtctgtgcacaaatatctgtgaatatctgtacctaacagaagttttatcttttgcctcttccctctctgctccatgcacaaacttactcatggtgacactccatccactgatgatgtctttttttgtcaaataaaatgttgaacattcttgaaaaaagcttgaagggactatcactgcccttctatatctagtgacgtctttttgttcaagaaggtaggttcactctgtgtaaagttttacctggacttgaatgtgagattgtaacactgccaacaaaagcaacattccatgtctcgaattgaaatgtaatctgtcaacccatttaaaacaaaaaaacaaaattacaacaaatttaggttagatatttaattggcttttatttacaattcatgaatgtgggcagcatctcattttataaaatagaataagaactccgatgagcttgttggatacagtgagttctaaacttctcttcaaagaatcagtatgtcagtatgttcagttctttgtcctccattttaaagtttaacttcctcgtagtttcagtaagcaacctttcccaccagttttaatcagtagttcacatctgttcccctggtcacctgctctgacctgagtcatcccagtcacctgctctgacctgagtcatcccagtcacctgctctgacctgagtcatcccagtcacctgctctgacctgagtcatcccagtcacctgctctgacctgagtcagttttagtcaccggttctgtcccaccaaactgctcaccccgccactctggctcatacccctgctctctttaaaatacccaatcagaattagcttagactgtgcagtccaaccctagccaacaggggaacgacacagcagtaggggcaataagaaccccttcccctccctcgttcaggtgtgctctcgccattgctccaaccatgagtcgcaccctactacagaagtaaaattaccctgctgagagaaaattatttgtttgagcactagttcgtcttttcggcatcgaagaacaagcatttgtttctaacaagctgagcagaggaggttggctttgtaggcagaaaagagttgaagaaaacagaacaaaaagcagattagtcatttcaaagttactatcgatatagagttaaaacagggaattccttattacactggttcagataaactgggctgcccctgattgtttcctgtgaataatgtgggttttttggtttgtttgtttttgtttttttaatactggcttgtttcaaagttcagtttgattatgtagcacctagcatgagtgaatccgttctggtttgttatagtctgttggggctgtgaaaggaaactgaatcttagggtccccaaatcactaagcaaaagggaaaagtcaagctgggaactgcttagggcaaacctgcctcccattctattcaaagtcatccctctactcactgagataaaagcatatctgattgtctgctttggaaaggctcatcagaaactcaaaagaatgcaatcatttgtctcttacctacctatgacctggaagcccctccccactttgttttcccacctttgcttctagttgtcccacctttcaggaccgaaccgatgttcatcttacatacgttggttgaagtttcatgtctccctaacatgtataaaaccaactgtgccccgaccaccttgggcacatgttgtcaggatctgctgaggctgtgtcatgggggcacatcctccaccttggcaaaataagctttctaaattaactgagacctatctcagatactcggagttcacagggccaagtataggcacttactctaaaacaaggatttcataaatttatttcgtacagcagtcattgacatttgttcagtttctatgtatgttcaggtgcatgcacattcatgcacacaacaaactgaattttactttttccctctgactctactgattgtgtaaataattgaattggtagacataactgatgttttgggttttttcttattgttttttttgtttgtttgttttgttttgagacagactctcactctgccagccagggtggagtgcagtggtgcaatctcgactcattgcaacctccgcctcctgggttcaagcaattctcctgtctcagcctcccgagtagctgggattacaggcaggcaccaccacacctggctaatttttgtattttcagtagagatggggtttcatcatgttggccaggctggtctcgaacccttgacctcaggtgatctgcccacctcagcctcccaaagtggtgggattacaggtgtcagccacagtcctggctctgatggtttcttttcccttgagttgttagagattcttcattgagagaactttgagcagacatgtaaagaataaagttttcttttccatctgtctttttctctctgttcccactttaatgtttcaaaattgttttacattaagctactcattgcatacataaaatgatttggattaatgtttgtgtgtgtgtgtgtgtgtgtgtgtgtgtgtatttaattgtggaatgactcaattggttcagcaaaacaatttcatttaacaaagaactaattttttcttcaaatatattatattctttttttcaatttttgtttttaagttccaaggtacatgtgcaggatgtgaaggtttgttataaaggtaaacgtgtgccatagtggtttgctgcacctattaacccatcacctaggtatgaagcccagcataacatagagctaatcttaaaccaaactgccttctaacattctatcccctatatttgtatctgaaaaggttccattatattctttagactcttccaacatttgcctgctagaaatgagaaggtttttataacatctgatcctatgtatttatcactcataaatcagaaactcaatttgaaccctgtgaagtatggaggtttaaagcaaacctttatttaacattttgtatgtcaacatttttccaaacttgacctgccaagtggatttaatagcagatgactctggaacctgaacaagtgtttgctcttatatttcaactattagtattgaattaaagactacaaggtttggatcacatggcagacttctttgatgccttatgctgctgatgctggccaagaagaggaacatctgagtatttacatgtttatgcctggggaattctaagaaatctttggacatttgacaaatatgtgcctataccactaagcctaagattgcatccaaatcatgtgcaaataatttctcatagatgggaaaaatatactgatgctaaaaagatgtcatatgagctgtttaaaaataacagtccaggaaattcactttttgtgaatctgaaattatctctcaattatctcaataattgtccaaagtataagatcatctggggaatgatgaaaccaatgagagactccgtttaacatttcttgtgcatttccgatgagtgcaaattataccacctttttaacacattactatctccttttgttctcaaagcaatccactaaaatgacggccagtgctacttccatctctaattttctctcccatcagcctactcatatgtatgcatttggtggtttacattcatcaaggttatggggctgcttgcccgtagcttattctacctgcaaaataaagtattacatatatatatatatatatatatatatatatatatatagttttctatttccagcaacagtgatttattttaaagtagtttgtcatcagtcttacccttggctatcatgatatacatttgattgttctctctacttgcaaacttgccctcccccaacatatacgaatttaggtttgtattgataaacattcaatggtttttttaatcaagcatagaaatgtagaatacatctgaactctttagcatggtctacacgcaggttgccaaatcaagcaaaatatatacataataaatatgtatgcataagtgttataaaatgttacattttctacatttataaagtatacatataaatatatacatttaattatctatacacacacacagagttgattatcattatttgcagcactcatattctataaagttactgacagcactgaatgaaggaacacagaatcactgcccctagaggaaatagttgttactgagaacctctacttaaaacattttcataaatcaatcaatacacaaccttgtgttatgcatgtttctgtttgaatacactttattttatacatagtgtatttaacactattatagtattaattcattaatggttgaactcacagccaacagtatcataactcattcctgaatgaaggttttctagcacacattattttcttcataagacgtagcaccgtcttcttgcatttagaaagaactgcatttaaaaagcacaatgcaaaaagcaaacataacaacaaatagattgtgaaaaagacacgtgtagtatgcgagttataatttaagatcgtgttatttatatgtgtttttttattttaagctgtctccccaaggtccatgcttatatccatcttgtgctaagcctgatataatatctgatacatgaaaccttttaaaatatttgatgaagaatgaatggtttaaagaattaacagaagtggtgtgaggatatatgaaacaagagaatccttagttatgtatctaaacctagttactcattatttcatttattggctcattctccacatagttagggagtaccttgtgcctaggcactattcaaggctctaaaaatgaagcaagtataagaagaccaaggctcctgtcctcatggagcttacactctgctggggcagacagaaagtagacagaaaattcagttataacttacatcatcgccatgaagaaaacaaatcaatgtgtggaaagccagtgcaataaataggacactgacatcttgacactcctccccccaccactgtttcacaatgtgcagagtaaattaaacacacacaaacacttccatatatattcagttaattttcaccactctgtatgcagagaacagtgtaaatgacataaacagtgatagagaaaagcaattaaattcaaaataatcagtatgttaataatgtaactttttcaaagggtttttgcaaagattttaatttatttatgaaacacaagtttattgaatacattttatgtcaggcattcttataggcacagaggcagaaaacttaagattgtatttcagggaagggaaacattctaaacaaattccaatcttcaggcatctgatttagagcagcgagaacatgatatatgaatgtgttagcactctatatcctcagcatgttaatcctcatgaaactaagcctttagtaaagctcgtgtattaaacatgcctgttcttttaaaacaaatggcaatcctcataaacagtgtgtccattaacaaaaatccacctattttgatttttaaactccataaagctcagagtgcaacctgctgctgaaagttgactttttctctgttgcttgggacatatggattttgacagtagagttgtagaaactgtttagctatttttaaaccatgagttgctcattctcatgttaacgcttgagtatttcttacaggctaggtagggaaacttgggtgagatgtttgtgattaaacacataattttgacaagttacctaaagctctccttatgtgtttgtgctatagtccacaggtataatgcctctcctacttaaccatgtgtgtattacatgtggtatatttttacatgtggtattattatatatggtatacattatataggtattatatgtggtatatattatataggtataattatatatacatatatatcatataggtataattattattatgtgaatcagaggatcacataaaataatcatgtcatcctctgctggaaacaatgcattgacttcccactgaatctagaataaaatgtaacctccttaccatttcctgcaatacttaaccttctaatagccttgatcacctttccagcttctctcctttacattgtcccacttattctttcctttctggtctcacttgacaactttcagtctttcaaacagactgaactctttctttgccactagttctctctgcctggagtatttttacttccacttttcacatacttggctgttttcattttccagatttctgcttaattttcacatcatcagaaagaactgcacttattatttaccactgcaaaggggccctactccgattcattgtctcatagcaccctgctcatcttatataatgtttatctgaattgttttgctatgtttagacatttacttattggaggtttctctacagccaaataggctctaaatcccgatgaggaaaggagcatcggtgctttattcaccactgtatgtctactacaagtacagggtggacacatgaggggtcttaaccattacttcagtataaatgaattaatatataatgtaagggtttaggatctttcactactagcttacttcaaggaaagatcagggacactgtgttgagaagaccttacattgttcttggtttagccattgtgtctcttttactttagccaagttgttccgcatttttagattttgattcttatttgtaaattataaataacagatataattaatataaacacactatataatgtaaaaacataaggtgctattataataatcaataatgtattttaaaagcagataattccatggatcctcacatttccttatagacttctagtttttcatcaataaagcacaaaagatatagagtaaatgcaagaaaataaaatctctgtgaccctttttgatttcctatttccaatcctctttttacccctagtttagcaatgtctttattgccattctttatttctccaatggtttatgtaatataaaattataataataaacttgataaatttagttaatgaggaaatttatggaatgagtaaaaaatacaagtaaggaagacaattttttttaccacttctgaagactgttgttagttaatagaacaatatagttgaccctgggcagtgaaattatattcattgtccaatcacaacatctgatcaatggctcattaatatctaatagtaattacttatattgcttcacagttttttttaatctaaaatataaagttcttattgagaaaagaaaaacagataagacattggtcttcataatttccaatgttctctgttatccagttatttattcagggagaaatcttaggaaaatctatgaaaaattagaggaatgatactctttctggagaattaatttacctgctactgcttcttcccactatcctattagaggcataattgacttagacacacgggatatgccaacctcattaaacctgagagcccataatgtgcagaatcacagatctaaatagcttcttttaagtttccttatgccacatatttgtatgccatagaatactgcctatggtgggacgtgcttcttgcaggatacttggaggccatctgtttattctggcatgagatcctctatgacatttgaagacttggtagcacttagtttttagtttacttcccattaataaaaaaataaataaaaataagtttgctttctatttgtatcacatacataatcaacatttccatgtgtaaaacagaaggtatgagcaaatctgaacataattgtttagaacttctcctgcagctccctgggggaattgtgtctcaaacgccatcagtataggttatcaacaagatgagaattgaaaagcccaattagagattagaatagggatagctgataagaaacatgaccaagcaccccaaattcagcttgggaagtcaaattaaagtacagagggtgaagtggtctgcatcagctgccaatgaggaatggcaatatttaaacaatataagcaaggaactcagaattcattggccaattggaggtcaaaagcccaggtttggaattaggataagattttgctgtgaaagtgagtgtctgattcatcttcattctagacagacagttccaacactttttaagtctcaaagtccctttctattgatgcaccccaattaactatgaggaatcactgctctgagatctaattaattctaatgttggtttcagggttcccttctgtaccagcagtagtagcacatggaattttgtgggattttgacaaggaaattacattactaacatatcttgaagggattcctataacagtttcttgataccataacaggttcaggtcactaagagtcctgccaaagtccaggcatggtggttcactcctgtaatcccagtactttgaaaggccaaggcaggtggatcatgaggtcaggagttcaagaccagcctgtccaacatggtgaaaccccgtctctacaaaagatacaaaaaactagccgagtgtggtggtgcacacctgtaatcccagctattcaggaggctgaggcaggagaatcgcttgaaccttgaaggcggaggttgcagcgagcccagatggcaccattgcactccagcctggatgatggggcaagactccatctcaaaaaaaaaaaaaaaaaaaaaaaaaaaaaaaagagttctgcaaagacttcagtttcttaaagaaaaagaagatgtgttaatttgtatgatttgcctatttttttctgttgtaaatactcacagcatggtcagtttcaagttatcaaaaagttaaaattcctgaattcttcacattggtgttctctaactgattcaaacaggctctggcccatcactgctggttatacaaaccttctagaatgaggaaggaaattaacttttccaagatctccagattatgagataaggtcaatctccttcttttgtgtactgaatttgaacccggtctttcttagttgggaaattcactcttacatgtgttatctttttattctgctatattggatcttctctctcagctgacacattttcaatagctaataaacagtttctgccatcagacattcttaataaaaagccataccttgaccccacacgtaatggcaacctaaattttctactctgcttcccagcaaaactttgtaaaataatttttttattgttctcatcacttctacttacattccacagggacttgactcttagccaccaataatctctagattgccaaattaaatagtgtcatttttacttctatctcaatcttttattagctttagacagggatcgctacacccttcttctgggagcttttttatcctcggtttcattgacactaaacaatgttggtttttttctttctaacctctccttcttgatctcagaattccaactcttgaaatgtttcaagacgttatccttgggtctcctttcctttttttgtctacacactcaggactggtgatttcattcaatacaaggtgttaaaaagtcccaaatctcaatctcaagcctgatttctcctcagaattccagaattatatatccaaatgtctattggatatttccatttgaatgtctgataaacatttcaaatttaacatgtcctgaacaacatttttgttctattccaggtgctggcaaactatagctgtgagtcaaatctgggtcacataattttgttcaataaaattttattggaactcaaccacaccaattgtttgcatttgtctatagcttatttcacactgccacagagacctctttagtctgcaaatactaaaacatttattatctggctctttatagaaagttggccaacagctgacctatataccaaatttgctcttcttgaagtacgtatttatctgagttgataacactaccttaagtttatatctcaagtcaaaattctcataattgtctttaatgttcatccttttcttgcctactacccccaacacatcagcagttcatatgggctttaccttgaaaataaaccctaaatctagttttaaaatgtccactgaaaccaccaatgttgcttgaagcattgaaacaacttcctaatgatttccttgccaatttttttttacccttttacaactttatagtcttcttaagttatagaaaattcttcttaaatcacatatcagatcatcttttccttgcttaaaatcatccaatgggtatgtatttctcttagaattttctcaactccctaccttctcttacaaagttctgcataatctggattcttactcctccgcctaccagttctcttctcgctcttggcccactgaactgcagctgcactgagctttctcttactccaacatgctaatttttcagttctggccctttgagctagctgggttctctgcctggaattctctcatgaacgcctttcatgaatgtctccttctcatcaatcaggtttcagttcaaatgtcacttctttcaagaagcttcttcttaataattcattctaacagagtcgtacaagtatatatcatattatcacttacctagtttttaatgttcttcaaagcattttaactataagataggtcttctatttacttatttttgtatttatttgtttgctggtgatttttctgcctcttcaaaatagaatataaattctccaagaataggaatcatttctgtcttgttcattgaagcatccatagtatttaggacaatggtgaacaatattggttgaatggatgaatactcagctattatattccagagaggtttctcaaggtggtcttgaagaatgtgggccaggttaattttcttagactaattatgaaggcagaaggaagagcaatctattctattaatttaagtaatgtaagtatccctataaaagaattaatttatttttattgtatttttcttaaatataaataagtgtaacattagttataaactcttatatttgctacttttatgcactaaaaccaaaacaattaccataaattaatcaaattaagatgtttacttatgcaattattttattagttgccctgataaactctttgagggctggatccatgtacgaatgtgctcactaatgcgtcatctgtggttgaaaacattggctgggacatagagtttggcaaatacttgtggtaaattagtgctgaatagtaaataaatacatggcctctgcaatcaaggtatgtgtgtctagtaggataggcttaaagacacaaaccagttgaccatccatctgctagaaaattcctcagaacaactctgagcttcaatattaattgtgggcatttatcggcactaactatggtacactcttaaagaaataacaataactgaacccttataacaagctttgaaagcatttatactctgattatttccttattacaagatgaaggtgagaagaaactgggaggttgtctggccacagttaataagtagtagagccaggatttacagccagtgggtctgtatatagagcctgagttccattgattcccagctaatgagggagtaaatgattctttttcattggcaatgacccagatcccagaatcacaagttatatcccactagagcagactggattttactcattaaggttgcatttttaacaagataattcattcctactgctcgatacagtagctatagacagttacttttatctaaattactcaccaaaatttgaaggtagaaggaatttagaaatactcttgtcccacctcttcatttttcaactgaggaatccagagttctagggagattaaagttacatagctaggtaataacaaaactaggaggagaaactagaatcgttttcctctgaatcacatgccctctcaaattttgcctgtgtttaatgccagaagggcaaaaacaaaaaaaacaacaaaaaagtttgctttcccttagcagaaaagtaaaaacagatcacctaaatatttctgtcctactgtgctttacttttggaatcattgccagaatgtggtagtctgctcatcaactgttggaaatataatccttctgtatctttcagatgatcgggaatccttttcatttatgcatgcatacttacactcacctttccattcctttatttacttattcatcaagcatttcttgcatggcaattatgtgcagagctttgtacttggtaaaggggaaaataaagaatagttgaacatgattttattcaaattgattctatcctctattacattttattttttaatttgcctgaagtcccttcaaaggtagacaggttgtaatttctcaataaaatagatatgaaaaaccaacaaaatcttctagcatcaatgtggcaattagctgctgactgcaacatgtattttcttaaagttgctatgtttctgcttctatcaatattaatagctaatattattgagtgtttaatatgtgccaagcactctgttaaacactccatgtatgttaactcatttaatctcctcagcagttccacaaggacatatagttattatatgtatttatagcataaggttacactcctattaagtggtaggaaatccaaactttctttctccagggagtatatgcttaattgctttatcaaatttgtaaattgataaatttgtaaattaaagttacatagctaggtaataacaaaactaggaggagaaactagaatcgttttcctctgaatcacatgccctctcaaattttgcctgtgtttaatgccagaagggcaaaaacaaaaaaaacaacaaaaaagtttgctttcccttagcagaaaagtaaaaacagatcacctaaatatttctgtcctactgtgctttacaaacaattgtttgtaaattgttagcttctatagaaaatatccaagaatttcagtagaggagtgttcaggagcctgtgagttatcccacattgaaactaggagacacactgctcttcattttctccaacaaatacacctcactttctcttgtatgatttttcacagaattcctgccctattagtaacatagctgtgattttatttaatccaaatactgataagcaattgtgaaaaatgtgaatatctgagaacctgtactttgcaaaatacatttttacttaaatatgattctcttttagaaaatgctgttgcaaagtggtgcttatttgggctctgtatttttttggggggagcgtcccgatttataagggcaataacaactcaaaaaatggtatgagtaaaaatggctgttctcctgagcttggtagaagattggagaaagcataaatagcaatctactcccctgatttattctgagtactcacacaactgaggcccaaataaattataaagtgtttggctccagtggtgttattaaattccttgtaggctggaagcattgatcatttgatacccttaggtttgcgtttcattcaaatggtggaaagatatatactaatactatatatcatttcaacttcatgcatgagacttgaagcaagaaacttctgttatagctagcaggaatagtctgtgaggtgaattggatgtacactgcacatcaaagtattgataaattgacctacatttttaaagccgaaatgtaaacctcattgtgcatcaggaggtcgacactgtcagttacctagatatttctcagtgttaagtagttatattatgaaagatgaatgattctgtacaaccctgtataaatgtgactgcatttggactttctaaaagaatataagcatgtatgcttggaaatcctctacctatttggaaatagaacacactttgcagttgatggtagaaattatagatttcttctagagaaacatagaagttacagggatttggctgatgacaaagacatattcccacagcaccactaaatgctttctaaatacttgttatacttaaatacagtattccatataatatgggagaaacagtttgatgccattttagttacattgtgtatttagcatgaactccaaaaggaaactcagctaaactccataatctctccacttactggttcaagagtcagagttgaggagactcatgtggaattcttgacctcatttacattcttgtgtttcataacttctggccctcggtttcttatttgcatagacatttagtgtctagtaatcaacgtgttgtagattctataatgaccgtataattagcatcttctgtgcattatttctgatcccctacagagctcactttgaacatgagacataagactctgggagcactgtagggtaaattttgaaacagctattcattctggctcctatatttattgtttctgttttaaacttaatttcctattagttgttaaagtgttcacttatttttcaaagctctttgaaattacaaaaatgggtagctattctctaaatcttgcctgattttttttccctaaatggaaagtagtatagatttggaatccactaaataatacttaatttattcctttatctgggtggagaattaaatgtcacaattagtcattatttatatttattgtattctagagcaatgttttcttaaatacctcagttaccttcagataaagtcctttctaagagatacacattaactccttcaaaatcagggatatcatttcatagctgccttaagggcacctctgaaacatctaatgtgtttgcaaagattgatttagatgaagcatgaatactcccataaaatactaatattgactaattattccttgcttagaaatcatacatttaccattttatacccttgctcccttcactgctagaggtattgccatagatggtagaataagttaaatcagaatgtgtttccactttcaaatttcatcatctatcatataaagtacttgttttttgtcatattttgctatgaaattattaatgctggtgggcatgaataaaatatgtcatttgtatctgaactagtaatatgaatcttagagaaatgatgagttgctgaaaagataattggaacgagtggaataacttaatttatcatattatgaaatttatttctgggcttttaatctttattcgtatacgttggctccagatataatgacatatccatccctaccattacaaattattacttctttcaagagaatatattttcatgtgacttttgttttataactaaagggaaaatgaaaatacgtatatataaaacatcagttcagaaacattccccatgctatataattaattctaagtgatatatgcacagaaaacggagaccatatgtggtagagaggaatctgacgaagtcccccaaatactcctgttttctggttattcaaacaaacactaatctagatgtctgtgtaaagaaatattacagatggaattagaatcactgatcggctgactttaacttaggggaattatttagcattatccatgtgagtccagtgtaatcacatgggtccttaaacgcagaaaccaacgcagaatatttagtcagtagagatgcattggagatacgaggcaaaaagagaaaagtcagaggattcaaagtcccattatttctggctttgagggtgatgggaattagcctagatttatcgcctctcagagccagtagtgaaatgaaggccttaatcctatgactgtatagcacttatggaaccaaccacaccacactgtacctagacttgggacccttgtgaaattatacatttgtgtggttttgagctgctaactttgtggtaatttgttaccataacaaagagaaaataatattccatatttacttgccataaccaatgcttaagcaggcaaaccttactttttaaaccatgctttagagaagttatgccagtttgcctcattaacagcctcctttttagtaacattccggataatgagtgggctcatggaaatgataagaatttcaaggggaccccaagtggtcatatttattttgctattgagttcaagtattttcaatattgttaacacaaatgctgcatccagattggacttttcataattcacacctcacaatgtcacttccccatcatatcttttgcttaaacgctttcaacgacttttgacctaaggaaaattgggcatttttaaaaagtccatgcctgatttcacctttatctgtgtctccagtgccgtacttcattcctctatgattccttgcttggaatattgtctttatatcttcaccactttacccacttgatacctagaagcactgtggtataatggttaatagggtggactctggggttattctgtcctaatttcaaatcctggccttaccacttccttgctctacaacattaggcatgatactttacttctctgtgcctcaatttatttatcaataaaaccgggaaaaataataatacctactttagcaagttgtcatatgcagaatttactcatttgtgtctcctccattttttgtgtactttcatttttttctcttacacatttaatgaatatttatttctataaataagtgtctatgatcctagacataatcaggagatgcaggtataaatttgatatttttctcctcataggaccaagtaactattcccatagctgcaaacatagattacttataactatttttttcattcactgaaaaaacatttattatgtacctactgaatttcagaaactaaggatacatatatgaataaaatatagttacttatctattctattgttaactatatgtttgatggaatatagcaaaaaatgtagtaaatctggtcaaattgtcatttattgataaactagaaatatttcagccagtagagttaggtggatataactagaatttaagcaaacttttgcactggaagaatcttttatttttacaaacttgttctattgagtgtttgtaatatgtgaagcacattatagaattataagaaaaaatgcatgtgaagcacctaggataatgcctggcatataatgagtgtttattttaaaaaatatatattgtttgagcccctacaaagtgctaatcattttctaagaaacaaggacatatcaggaatgtgataagattctgttccaatggaagaaaaacttgttgagcaaataaaatgtgcatagcttaatagcaaccagcatggtttaaaacacatggatagcctgagctacttttgatatggcatcagggatgatttgggagaggtgacaattgatctatctcctggggcccagagattgaaaaaaaacaaaaacaaaaaacaattgcttgcaacttaatccttagtgtcgtgcccctttttgttcaaaaaaacccctttcccttttgtaattcattgtaggtttttcttctcaattaaagttatgtcagaaaactaggcttaataatttagcttagtattccatatgccaaactgattagttcatattatatattgtcatggttaatactgagtgtcaacttgattggattgaaggatacaaagtattgatttgggtgtgtctgtgaaggtgtagccaaaggagattaacatttgagtcactgggtcgggaaaggcagacccacccttaatctggtgggcaccatctcatcagctgccagcgcagctagaacataaagcaggcagaaaaacatgaaaaggcgagaccggcctagcctgtcagcctacatctttctcctgtgctggatgcttcctgccctcaaacatcggactccaaggtccttagttttgagacttggactggctctccttgctcctcaagcttgcagacagtctattgtgggaccttgtgattgtgtaagttaatacttaataaactcccatatatagatatagatatatatctcctgttagttctgtccctctagggaaccctgactaatgcatatatgtttatgttatttgttctcatgtccaccaaaaaggtcaattaaaaaaaccttcccttagctgtggtaataccacacacacacgcacacacacacacacaaaaccttcccttagctttggtaatatcacacacacatgcacacacacacacaaggcatgcacaagcgtgcacgtgaacacacttaatatgtactttttaaatcctcttttacattaatggcctatttattttaaaacttgagctaattttcagaaaatcaaattttgcaagtgttgctttgtgtgtttaattgtatcaattaattactgtatttgcaaggtttaacagcccaaaagctatcaaagaaagaatcattttaagagcttcaagttgctgacacttctaaggcaaaactggaaaagacacaagctgaagaatgattgatttcttagggatatctttctgtcataaacccaagatatttgagaaaggcatgctagattttattcactgcatagtgcactgccaatatcaacattttaaaagcttgaagatatgaaaagtagaattgtgtatcaacagtaaaactttacaaacatcctacaacttatattttaaatacaataacttttaaaggtcctagcggtcagtgggaattgagagttattttattcggtggttcagaccctgtgtttatgcagaaacgatcttctagtaattttaactgtagtgagctttctaatgaaggctgtgcaaatattaaacagctactacaattatgcttcggttttcttttcaatattgaatgtttacattcttaaagcatctctgatcgatagcttttattgactgtgttttctccttcctcagctatttctttacttgttttgctttattcatttcttcatatggtatgttatttatttatttcatgttgatgtgggaaaaaagttgccctctttttattaacagattgaattatcagcaggcactgaggcttagtgccaagcaagaaagacacagacaagcttattttttctgctaccactttgaaccttgaatacagacctctgggtaatgtcacactggatacttgctgaatatttgctgaggacttcttttatgtttgtctcagcattggtttaaaacaagatcagggctaagaagagccaagctgctcttgcaaaggtcttccttcatttgccttttctctcccagactttccagcaactcctgctctcctgcatattgatctgtgacttgactctggacttcatgtgttcatgtgtttatatgttaactacttggtgatttcaatattttttacatgatgcatgaactcagcatgaccaattcaaacctataatctctcgacacaagtcttcaaacctggtctacttcagtgtaatcttatcaatgaatggagaaacatgactgtccagctcttacacaagccagaaacccaggagtcactttttgaacaactccctccctctctcattgttcgtattcattcctaaatattctatgattacccacttctccccacctccatggccatcagcactactcaaaactaaatagtcactatctgttttctggagacgggagtgtcctaactggttaatcctagaaacttttgtgtctctttacatggttttcacactggatttatctaaatagatatgaaatgatatcatgtgctccatctcatatatgaaacacttcaatggattctcattacaatcaatgtgacttataaactctacaatgtcttagctcctttttacagattctgcccaaaccacattggaccatgtcaattttattataagacttcaccatatgctatttcttttacctagaacaccatcgttcattcataccctcaaacacacgagcacacacacacacaatcatctttcgcaaagttaatttttttcttattcattcatttgtttcagaatcccattcaatgtgttcttccatgggaaaccctttttgacctctctaactagaccaatttcttttcttcaaagcacttatcacagttgtaacttcacatttatttctagaatttattagattctgagctgaaatttccatgaagggaggtaccatatttgcttttgctcaatatctgatccatgccatccagtttatcatctgacacataatatgtatttgataaatgtttttggagtgaactgcctttagttcatgtgaaagaaatgtaattcatttttggcctaatagttcttcaggcaatcccgagaagcatcatacttcccactctgacttggactttctcacttcagaaataaaatgacctgaatttatttaaccattttcatgttaaatatttagtgaccctttgtcatcctgattgtcttgccctgcacatgtttttcatattctatataaaatatagaaaactctgaaaattgggtgcctagaaatgaacccaattctctaagtaacaagcctttctttttttaccctccatacatcactgaagtccatgttcattcaattttgtagatggtagattagctaataaaatagccataaacatttctattataaggctaggcaccctaatctgttttatcagggaatttatttacctttttctgacataactcccagtttgttttagtttacacagtagttctgtcttacccacttgagtcaattatgactaaacttagaatcatgaaccccaccacagaatatctcattactgggttcttttattttgatttttttcttgttcttgagatgaggaaaggaagttaaaagaaaccaacattatttctctaaaacttccacaaagatcaaagttgaaactggaacatagctttcctgatttatagaccagaattctgaaaattacaccaaaggtggctaataattagaataaatcatatctgtaagaggctttaaaaaataagtattctgtttttcacattattttttcctattttatgcccattatccaagatgttgtttcaccttatctgagttagaaactagcaatcagtagcaaaaaaaaaaagaaaaaaaaatcctaaactaactttttaaaccttacaatgtatagacttgttgtactatgcaacttatatcatgttaagatattaaatgaacaataataaaatataagagttgaaagtcaatttactcaatcattacataaaaaatgaaatacttctaaatttttaaaacccttagattttatgtagctatgaacatttagaaaaactatgctatgcttttaactgggatccctctatattggtacccctttcaaattccttttttttttttaatagaaggactcaaaccacccctttctatttctaagcctcccagcagcaattgtgagaatgtatgccacaccacccatatgttcgtctccagatggctagcctgcttctctcagctcccccacctgcctgggccaaaggcatgctgtgcccagaaccctgtgtataacatgaaagatgctgatgcctgctgtcatccatacccttgcatgtccacagtttaatccgagcacaagcaaggaaagaaagagaggcaaagctggaaggaagcagaattagagttaaaggagagggaggatggaggaagaaaagaggagggaaaaaagagagtaagaaaggatgcaaggaggaaaaggttacagtgtgatgagaaaagtatagttattttatgagagtcaatcattattttggtaagattaagaaaattgatattgcacactcaaaaatcaaataaatagacttaaatttagtcacatgaagacaagcacaaatggtttctttgtgtaacattagaattgatgctgtgttgtactggctctgaaagtggatggtaagctgcaagtggttgttcgtctgctattctctatgaaagacacaggtaccatcctatggatttgagagaagtgtttcacatctaatgttactgagcaataacacccaagattaaaaacataacagaaaacacatacatgttgctgatgcatatgggcatcacgtgtgtgagttgcaactcaagcagaaaccctcagataaaggagggcggtcaaaaaagttataaaggagattttccttctttctaatgtttcttccctgcccttagcccagtgtatcttcaagtatgaccctgaggtaacccactttagagtcaccttgagtagtcaaggagacccatagcataaataattaatcagccaacaaggatctattgagtgatatctcaatactaagcaggtaatttgttcattcaacaatatttattgagaatcaattatgggtcacatactaagttcagcactgggatatattattttgaaaaaacatagttctggctcttttattcaactaatattctttgaaaacctactgtaatctaagcactgttttaagctttaggaataaagcattgcaaagaaataaaaataaaaatcattccttatgatgtggaggttcttgttattgaaaaccataataaataaataaatgagtcatttgtatgaatacattatgcaaaaagacaaaatgtgctggagagaaaatagagcagagaagggagtatcaggagcaagaggtatgcaatgttaaatagagtggctaataaagccttttctgagatgcttaaacttgaggaaaaacttgaagatggtgagggagtgagccatgtagctatctggcagatacctggaagaaatagccagtgagaaaggctctggttcaggatggtgtctgtgactgaagagtgagtggaacaagagagagagtggtagcagatgagaccagagagtggcaggatacctttacaatggcctgcaagacaccacaaaatctggtatcttgtaggccattataaagtctttgtcataacttgtctaaatcaatttgtattgagggatccacccccatgacacaaacacctcccatcaagcctcacctccaaccttgggaatcaaatttcaacatgaggtttggaggagacaaatatctaaaccattgcataagccctccccgaatccctcccttctttagagtgaaagccaaattctgctatatagaaaaagcctgaacaggactaaattggaagaagggaaagcaggtgggaggcaattgcagtaatccagtgagagaggatgaaagtgatggaagtgacagagttgaaaagatgtaggtacattctagatatattttgacgactggatttatagaatttcctgataaatcagtcttagaatgagagagcaagagataagtcaagttcgactcaaatctatttggccagagtagctggaaggatggaactgccattaattgacatggaagtgtggatggagaaggatttcacggaggaatgttaattattgattctgtttcaacaggttgattttgagatcctagtggagattttcattagtctagagttgagaggaatagtctgaggtagagttgccataggtgatattttaaaaaattagattggcaaagatcccaaaggtacttagcgtcatatcaagaaatgaggaattacaaagaatgtgcaatagggtactccatattagaaggtcaagaagcagagattattccaccataacagactgagaaagattagacattcatcgaagaataaaaaatatatggtgtcctggatgacaagttaaaaaattatttcagagttgaggacatgaaaaacaaggtcagaggctagagaagtaagaatgcaattattcgatcattaatagaagaaacaaaaggttaataaaataataggtaagtcagatactgttaataatacgaattaatataaaatataaaactaaatgctacaaaaagtacatcattttataataataaataacaacaaatataaggatagtggcggaaaacatgggatgaggaaatgcttgtttaaagaagtaatcttgagattaaagataaaagatatgtacaactcactgaaagtgaaactgtgaaggttttggagtgttacagccagatcagatgacatttgcaatggccttttttggaagaaaacatagtgtattcaaggaaaaggaaaaggctagtttagttttagcattaaaaaaatgaatgtaccaacttaaataaggaattatgtatgtttggaaagaaaagtcttgaaaatcatgggcaacataaaccaagatgagaattaaatgacattatgttagttaggatgttttgggcaacaaaaaagaaaatatcggcataaaaattacttacaaaataatagtttatccataagtctcaaaagagacatatggaaccccacaattctatatctcaaaagagacatatggaaccctacaattctatatctcaaaagagacatatggaaccccacaattctatatctcaaaagcgacatatggaaccccacaattctatatctcaaaagagacatatggaaccccacaattctatttctggacatctatctaaaaggactgaagggtgtgccttgaggagatatctgtacaaccatgtttatagcaacatggttattacaataacataaaggtggaagcaacccatgtgtccatcaatggatacatgaataaacaaaacataatatatataaacatggaatgtttgttattcagccttaaaaaggaaggaatttctgacacatgttaaaacacggatgaaccttgaggatattaaacttagtgaaaaagccagtcatagaaaacaaataccatattattccacttatgagagagagtagtcaaatttatggaaacaggaagtagaatggttgctcccaggggcttaagttagagagaaacagtgagttactacttaatgggttcagagcttcagtttcgcaagatgaaaattgttctagaggtagatgggtgtagtgtagtgtacatatgagtgtacttaatgcctccaaactctacatttaaaataggctggtaaatgttatgttacatgtatttcatcaaaattactactaataataatgaaaggggtcactggacccaatgaaaaagaagaaagaagaggaggaagaggtgaaggagggcagagagatgtaacaccagggatgattttagtaaattcatgatacctgggctccaggtaacttctgcatgactcttttagtcttcccttcgtggtcacaagatagctattgaaactgagcatcaagtttttccacaaaaatgtctaaggcaggaaagaagaatcagggacttttttctcatacaaccctttctttctaccaattaatagaatatgtttctcagaggccttcaaccaagatcactttagtgtaattggccagaaccataataaaattgccatacttgtctgcaagaaaaattgtgaaagaaggtttctaatgatttcagattcactttcgagggcaaaagtcagtggtgtgctgatagatatttaacaaatcactatctgggacgggagagaatgtgtgtacatatataagtgtattatacattttattgatataaaagatttgtgggacactataaataataatagtaatatataaagtattctttattgtcaattttgtatagccaaatgatctacacagtgtgcgtgcttccattgattttttttccatgcttttttatccatagccaaaatatagttgcaattcacaagtgtagttccaacaagaatggtgatagatattttcctcgtagttaatgagtgatacgcagtgaaccaatgaacacatatataaaaacttagtgtgagtaagctttttcccaaatcttctgaataccagaatatttcctcaatttttttgcactatttacaatgtaacagctattgatatgatatacttttaactttaatctctattactaatgttttctccaacacgcttaagtctaaacaagcgacaggagagtgccaagactggctgactagaagcagctgatgtgcaccactctcatgcagaggagaaagagtagcaagtaaaggctggcccttcagctggatatgcaggtagacatgctgggattcatcaaagaagcaatatgacctacacaggtcagagaggagcaacataggacagttgcccacccaggattggcatggagcaaggggaggctttccactataggaaattgtgagtaatagcccccgaaagcccactaccaattggagggccccccggcataggctgatcactttcattggtagtggctctgcatttctctgggagagagcccaattaaaaggacctctgcctcttaccgctgctaaggacctgctgaggaaggaacataaggcccgagcttaccccagggctgctatgtgcagccaaggaggaccaagccaagatctgcatccagcactcaagtgagatagaagcctacacttcctgagcactgagagggtatcatggctgcaattgtgaggaaatacaaagaagtcatgttgctgagcgtgagcctacaacatggccattacacctaagcaccatctactagatcacagcccaaacttcaacaccaaaaatacttttccaatatacccccaatccactgcaatccctgtcctgtgaaaccaaggacaagaattcagctacaaatggagacgctgcacaaagcctcgtccctcgggaaacatccagaaatgaagtcaactgacttcaacacaaattccaacacaattgaaggaacatcagcccacacagatgagaaagagccagagaaagaattctggcaactcatatagccagagtggcttatttccttcaaacaactgcactagttacccagcaaaagttctcaatcaggctgaaatggctgaaatgacagacatagaattcagaatatggataggaatgaagatcatcaagattcaagagaaaattaaaacccaacccaaggaatctaaggattacaataaaataacagggctgaaagacaaaatggctattttaagaaggaaacaaattcatctgatagagctgtaaaacacactataataatttcataatataatcacatattaaccgcaggaatcaactaagctaaggaaaaaaatttcagtgctcaaagactggttcttcagactaagtcagacaaaaataaagaaaaaagaataagaaggaatgaacaaaatgtccaagatatatgggattagatagagaccaaatctatgactcattggcatcactgcaggaaagggaaagaaaataagcaatttggaaaatatatttgaggatattgttcacaaaaatttccctaaccttgctaaaaaggccaacattcaaattcaagaaatgcagagaacccctgtaagatactatgcaagacgaccatccccaggacacataatcatcatattctccaaaggtgatatgaaagaaaaaatattaaaggcagctatagggaaggggcaggtaatatacaaaggtacctccataaagctaaaagcagaacattcagtagaaactctgtaagccagaagagattgcgggcctgtattcaggatccctaaagaaaagaaactccaatcaagaatttcatatccagccaaattaagcttcataagtgaaggagaaataagattcttttcaggaagcaaatgctaagaaaaatcataaccactcaacctgccttggaagaggtccttaagggagggctacatatggagaaaaaagactattatctgccaccataaaaacacacataagtacatagattattgataatataatgcaatgacactatcaagtctgcataatatccaggatcaaatccacaacatagcaatgttaaccttgattgtaaatggaataaatgccctgattaaaaggcacaggggagccagttggataaagcagcaagactcactgtgtgctgtcttcgagagatctatctcacatacattgacactcacaggctcaaagtaaaggaatggagaaaaccctaccaagcaaatagaaaacaaacaaaaaaatagtggctgccattctaatttcagacaaaacagactttacaccaacagtgatcaaaaaagaagaagaaggacattacataatggcaaagggttcaattcagcaagaagacataacacaacacaagagcagacagattcatagaataagttcttagagacctatgaagaaactcagataaccatacaatagtagtgggaaacttcaacactccactgacagtattagacaggtcattaaggcagaaaactaacaaagatattcaagatctgaactcagcatttgaccaaatggaccttgcacacatatacagaactctctacctaataacaacagaatatacattcctcttatctgcacttggcacatactctaaaatcaaccacacagtaagccatataacacttctcagcaaatcaaaaaagaaactgaaccaaccacactctcagatcacagcacaacaaaagtagaaatcaacaccaagaagattggtcaaaacaacacaattacatggaaattaaacaacctgctccttaatgacttctggtaaacaatgaaattaagacagaaatcaagaaattctttgaaactaataagaacaaggatagcacataccagaacctctgggacacagctaaaatggtgttaagaggagagtttatagtgctaaacacccatatcaaaaatggcagaaggatctcaaattaacagcctaacatcaacatcacaccttgaggaactagaaaaacaagagcaaactaaccccaaacctagcaaagtcaagaaataacgataatcagagccaaactgaatgaaactgagatgtgaaaaagcatacaaaagatcgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagctgggcgtagtggcgggcgcctgtagtccaagctactcgggaggctgaggcaggagaatggcgtgaacccgggaggcggagcttgcagtgagccgagatcccgccactgcactccagcctgggcgacagagcgagactccgtctcaaaaaaaaaaaaataaataaataaataaaagatcaacaaaatcagaggttgtttttttttttttaagaataaataacatagaccactagctggactaacaaataaaaaagagagaagattcaaataaataaaatcagaaatgacaaaggggaacataacctttgaccccacaagaataaaaaaaaccatcagagactactatgaacatatctatgcacacaaaatatatgacctgcaagaaatggataacttactagaaagatataacttcccaagactaaatgagtaataaattcaaaccctgaacagaccaataatgagttgaagtacggaatcagtaataaaaagcctaccaaccagaaaaagcccaggatcagacagattcacagctgaattctacaaaatgcataaataagagctattaccatttgtactgaaactattccaaaaagttgaggaagagggactcctccctaactcattctatgaggccagcatcattatgataccaaaactggaaagagacacacacacacaaaaagaaaacttcaggccaatatccttcatggacatagatgcaaaaatcttcaatgaaattctttccaaaaagtccttgtttttttgtttgtttgtttgtttgtttttagaataaataaatccaacagcacatcaaaaagccaatctactacaatcaagtaggctttatccctgggatgcaagattggtccaacatatgcaaatcaataaatgtgattgaccacataaacagaattgaaagcaaaaaccatatgatcatttcaatagacgcagaaacagctttcgatataacccaacatgccttcatgataaaaaatactcaacagaataggcatcaaaggaacatacctcaaaataataagaaccatatattacaaatccacagccaacatcatactgaataggcaaaagttcgaaccatttaccctaaaacctgcaaagggtgcccactcaccactcctattcaatatagtactggaagtcctagccagagtaatcaggcaaaataaagaaatgaaaggcatccaaataggaaaagaagaagtcaaactatctctcttcactgacaatatgatcatgtacctgaaaaaacataaagactgcataaagccttctagaactgaaaaacgactttagaaaatttcaggataaaaaaatcaatgtgcaaaagtcagtcacatttctatacactagtaatgtccaggatgaaaggcaaatcaagaacacaatcccatttacaatagccacaaaaaagagaaatatacaggaaaatagctgaccaaggaggagaaaaatctctgcaggtagaactacaaaacactgctaaaagaaatcagagatgacacaaaaaaatggaaaaatattccatgctcattgattggaagaatcaatatcattaaaatggccatactgcccaaagcactgtacagattcaatgttatgcttaccagtcaaggccattcttcacagatttagaaaaatctattctataattcacatggaaccaaaaaaatgagctggaataaccacagaaatcctaagcaaaaggaacaaagctggaggcaacacaatacctgaatttaaactatactacaaggctacagtaaccaaaacatcatggtactgatacaaaaatagacacatagaacaatgtaacagtatagagatccccaaaataaaaccacacatctacaacaatctgatctttgacaaagttgacaaaacaagcagtgaagaaaggacttcctatgaataaatggagttgggataactggctaaccatatatagaaaattgaaactggacctctttcttataacatatacaaaaaacaactgaagatggattaaagactttaatgtaaaacctaaaactataaaaacccttgaagaaaacctagaaataccattctagacttaggcctttgaaaagatattatgacaaagatgctaaaagcaattgcaacaaaaacaaaacttgaaaaatgggacctaattattaaagagcttctgcacagcaaaagaaactataaatagagtaaagagatagcccatagaatgggagaaaataaatgcaaactacatatccaacaaaagtctaatatccagaatctataaagaacttaaacaaattaacaagcaaaatacaaccccattaaaactaggcaaaggatatgaacatacactttccaaaaaagacatatatgcagccagcaggtatacgaaaaaaaatgttcagcattactaatccttagagaaatgcaaatcaaaaccacaattagataccatctcacaccggccagaatagctattattaaaaaatcaaaataactatagatgttggcaaggtaatggagaaaagggaatgcttatatacatgcttttgtttggaatgtagtttagttcagccactgttgaaagcagtttggcaatttctcaaagaacctaaaaccaattgaggcagaaatgtcattattggatatatacacccaaaggaatatatattattctaccataaagacagttgcacatgtatgtccatcacagcactatgcacaatagcaaaggcatgaaatcaacctaaatgctcaacaacagtaaaccagatgaagaaaatgtacatatatatacaccctggaatcctatgcttccataaaaaaggaatgcaggctgggcacggtggctcatgcctgtaattccagcactttgggatgcccaggcaggtagatcgcctgaggtcaggagttggagaccaacctggccaacatggtgaaaccttgtctctactaaaatacaaaaattagcctggcatgatgcatggtgaaaccctgtgtctactaaaatacaaaaattagccgggcatggtggtgcatgtctgtaatcccagctgctcaggaagctgaggcgtgagagtcgcttgagcctgggaggcagagatttcagtaagtcgagactgcaccactgcactccagcctaggtgacagagcaaggctccatctcaaaaaaaaaaaaaaaaaaaaaaaagaatgcgatcatgtcctttgcagcaatgtggatgaaggtgaagaaaattattcgaagcaaacttatgcagaaataaaaaaccaaatactgcattctcacttacaagtgggagctaaacattgggtacacatggacgcgaagggaacaatagacacttgggcttgcttgagggttgagggtgggaagagagtgagaatcaaaaaactacgtatcaggtattatgcttattatctaagtgatgaaataatctgtaaaccaaacccctgtgactcacaatttatctatagaaccaacctggacctacacccctgaaactaaaataaaagttaaaagaacaaaaagagcaaagaatttggagtcccaagacccctgggacttattagccgagtgagattgagaaggacattcacttgttttaagtctcaggttccttatctgaaaggatatcatttgaaaacagtacacatcttacagggctgtgatgaagactaaataaaactgttgacatactggaaagttttgaaaaatgtacctgacttcaaagactgaaatttcactgcagaaaaaaacttttaaaaaatcttcatataaaaaattactttaaaaaaataagcaacaaagcaataactcaagacttcatttatagcattggcctatttccacggagtaaatactcccaatatatccaatttcctggtacccacttgacaccattgaatgtaaatttgagattgtgcaatagcaaaacattctataggatttctaatattaagatataatcaatgcaaacaaactcaaaagcataggcaatagtaagaggtaataatatatttggaaaggatgaattttgagctttaattattttgcatttaatgtaattaaattgttcattaatatagtttgatgtttaatcatatctgtttataatatggcttgcaaaattcctgaaaatttaacaatcagccctcataggcctctttggatcaaatgaccagcaaggcataatactagcaagtaaggaggaatgagatggctttggctttacagattttaaacatttaaattcacttaggtatatagtagaagcatttttacttccaattgtgcttaatctaaggaaaatagcatctttgaatcttttcctttttctaatcaacttttgctcctaattttccattctagcttctaatatccctagattaagaacaaaaataacattgatttccaccacagataaaatgtccaataaaaggcaaagtaaaactggaatcaattgaatattctctgtttaacaccaaattgattttaaggctgccagataaggaagggagaaatagaatgtaaagctgtcctgagaagagatcactcagtctaagcccctcattttgaagatatgaaaatggagatacctcaagattggcctaaaatcaccgaacccactagcagcagagcaaagacaagaatgctgggctcctgagttctgaaagccatacctgttctattgctgtgcaccaaaccttaattcctgggccatctttattagaagagtgtttggcaagttctttgggtgtgaaaagagaaaacagttctcataaatcaggtttccatgcctggtctgttaaatccaccactggcacgatcacagggaagtgctgctccagctcattgtgctagaaataaactgaggtctcatagcagccattagagtctaattatatgtgacagccaacctgacaggttttgtttatttgtttgtctattctttcagtgcttatggcttgaaaaaaatgaataatgctgtcaaaactatcttacccttcaggagctctttctctgcttcattggaaagcataggaaagcatttacttctgacacgcctggtaaagctaataaggaaaaatgatttcactgagaagtctgtataattatgcatggctcatgtgacacctactgatggtcaactgtcactagtacactgtgatatacttgataagagaatgagaatcaggagcatcaaatacatagaaatcacataagaagtcttttcggaagaaatgcgagctatgaaatcatctgaggatgaggcaacagatatatctagaaaacatgagcaaaataaaacataaaattgtataaatttcataatggaactagtggacaattgacagattatatttaaccctgtcttaatttatttttcccagaccactcaccttttaagaatatcaacattatatttgtactgaaagtagatgtgataggtagatcttgattattttcgagtcccaagcagatctctatgtttttcttgaatgattccaattttaccaatgatctagctaaggacattgacatgttcctgaatgcctctaaacaaagtaaaaaaaaacaaacaaaaaaaaaaacaactttgaatggcagtattaagatccaattccttatcaacatgttgaaatgataatgtgaacttaataaaatatagtaagactcaacatattaaacttaagaagagttaaataagtaaaggaaaacaaacaacaacaacaaaaagctggagtggggaaaatagaatctaatagccatctgtatgagaaaagattttatttggctgcaaactcatgagttgatgttgtaacaagactgcaaacagcaagaatgtgaatatattgaatcttgccttcctctgggaagtgccaatgagagcttgtactagctccactccattccagactggaaagatcatgcctagtgtgccatcagcttgagaaatatgtgtttttatctcccatggctttgattaagttgggttacatctggctactactcagtctcagtttggacagtgtgggctccacagcatttgtccactcctcatttacttgcagaattctgttgtctaagttacactttttacactctgttctaatgtggctactggtgaggtgtaaacgttgttttgccactgtgaaaaatataaaaataggttttacagtgctccattgtatatacttttatatacatagtgatttctagaactaaagctttctacattattaagagttgattgtactgtgtttaattgtaggcaagacattaagtggtatgtttaaaagttgggtgtgcttacataagaatccccaagaagagaaagactctgtaaaccaatatctatgaggaatagttgaaaaaaataaagaagacttatttatgcacaagaaaaagagaaaaaattagtgggtaattcttaatggaataattacttagaagatgaattgtcattttttttggaattcagtttatttttgtgactgtcaggatgaaagttgcaaggtcacagattcaggtcagctttagagcaggttgaagtattagaaaatggaatatgatgctttataatcaattttccattcatggaggtgtccaaagggtactgaaatatacatgtattaacagttttataaatgggagtgattaattagatagtcttctaatcagtgagttacaatattcttttccactgcaagaatctatgagtcaatgttgtatcattgatgacatgatgacaaagaagctctatacaaccttcattttggttattttaatttgtaatctctcatttgaaacatagcactgattgaaaggtattttaaagtattatccctaccactcattaacacaaatcactcaacctagaagaacgtgtggtggctgtttatagacctacacctactttttgatattaatttttccttctagattttcatatatttaattagcttacaaacaactcacctattaaattataaaacttatgtatagatttgatatagcatagtttttacataagaatgtttaataatgaagagtggtgtttaatcaacatgttgaatgtgaagccaattcataatttgaaaggtcaacaataaaggggcatcatccatcatgatttaatcagtcgtatcttattaagagcagttgcaaaacaggtgagaacattcacaaaaggattagtttataatatttaggttaacatttaaaaaccatcactagccgtagtgttcatgatattaattatatagaagtatgccattttctaaaggagcaggaaaacttttaaaatattaacaacactgagattagtcttcagaaatttaaaataaaattcaagtgtctttagaatttaaatttctttatgaggatgtcaaaatgataggataaaaccccaatgaaagatatatattgcaatattcatatccaaatgaaacttctcagatcatgagtctattaccatactccattatcccgagatgaagcgattacatgttctgtttttatttttcaaatactgttgactgccaaaaagaaactagtgaagatattctttatgccaaatttccttgtcttctttcattttttcagtcaaccaccatttgctaagcagcactatgtaccaagtgtcagttactctgccactatacacatttctgtgattcaaattagctcaaataagatccacaagtaaaggaataatgtttgtattatacaaaatttcattggtttacctgtgattttcataagccaaagtagccagatgagtgtgaatagattacaaccttcagtgggaaaggaaaaagccatcatcttagctactgccctggcagtgggagtcctttcagaacattccaactaagtgcaagcagttggagcttccttcccagccaagttcaccatcagttttgttcagccagtggtaagttgcactatcttccaggtttacttcaccagcagccccactctctgagatctccattttcatcgatttggactcagtactggccaaatcttcttaactaatgttgtttgtgaattactaaaatcatctgtggcaaccttcagctacactaagctgcctgcctaggtggtctaagttagctctgcagaaacttattactgtgtttgcttgtgctttggttaaaacatttacataagattttctttatcattgcctactattatgcagaatatgaggtttcctaataacatatataattacagagaaatgtctctattgtgatagtcgcaggagattcagaagtgaattatacgcagctgatgccttcacactgccaaggtttagtaaaaatgacatgcaaactatgagttttactacaatgtgatgagtgtcattgctatgctaaaaaatacaagaattcagaggttagaaggcccaaataccatgagttttactacttccctaatagctcatttcacaataaagaatttctgatcatcagaagcttattatattgaactagaattttcacttctttatgcaatcaacaaggacttattgatcagtttctataagtcaggaatgtttctggacaactggagtttgcttgagaaggaaaattggacctgacttagtgttacagagtttatattttagattcaaagattgaaaatcaacaaacacacaagaaaataaatgaatctgtgaacaaataaaattgtttcagatagtaaggaaatctctgaaggtaaacagagtaataggacagaaagtgaccgtgtagattaagggtgtcaatactctataggctagtagaagttaagctcttctgtggagaagtatgggtttcagctaatggaagtcaaggagagatttacagcctgaagtcaccaattatgcagagccttcaggcagggacattatgtttggcaggagggcagacatgggaacactggctgcttgggaagataagaagaagccaggcaatatactagtccttaggaatttggatttgatttggcatgagatagaaagtcactgaattgtttttagcaggaaaaggacatgagatgatttattttgtgaaaatataagttgacggccagatgaagaaacaattgttaggttataggcatggaagcaggcagttaggtgttgggagacaatagccatgtgctaagtgaggcgttgcagtggtttgacagggaaaacaggggccatgagcaacagagatgaaatagataaactagagtatattatggtgacataatgtgtacattatatcatttggggatagatggaatgtgcttgtgattaatccacaaccatcaaagtccaccaagtaaacaagaacagttctctgcatctccactccattactgatgtggtttggctctgtgtctccacccaaatctcatctcaaattgtaatccccacgttcccaggttccaggatcacgggggcagttcctccatgctgttctcatgatagtgagggagttctcacgagatatgatggtttaaaatgggcagtttcttatgtgcacactttctgtctcttctgctaccttatgaagaccttccttgcttctccttctccttcctgcatgattgtaagtttcccaaggcctccccagccatgtggaactgtgagccaattaatcttctttcctgtgtaaatcagtctcaggtagtatctttatagatgtgtgagaatggattaatgcaattaccttttttcgttctttgccctcattcgctgaggttttcaaactacaattagatgaaaactttttgtgactgttacagaggttttcctgcctctatttagacattggaacaagattacctttaaaagggggtctagcatatgatatgtagatgggaatttttaaggaatatgattcatttagcagcatggactattagtaaaaaaaaaaaattatattaaatggcattctttccatatctatagggccaagtcgaaagctctccattatagctggagatgccctctttaagcttttacattctccttccgcccccaacatacacgctatacttatacacgtatacttttcaaccttcaacctccctttagaaaaataaaaattatcattaagtgctcagatcaaaaagtaataggcaatgaaaaaaatattgatttgtattaaatcaccggtgcaaatatggtgtgcgaggataagaatgtttggcaagagctacagtattataaaataaatgatatgctagtcatcgaaggcccttgtccatgtaagtgagcagaaatatatagcatttgcttattatctccagcccaagtagtaaattatcactgaaatggcaaagactgaagtggacataaatttggggttcgctgtgctgaggagtgtgggggcttggtatatttcaaaagccttaggaggctaccgatcatcatgatctgcagacagagctgcagataaagtataaggtgatttctagttggaaacttaaccaaggctctcatggcttacagttagaaaattattttcctctagtacagagtttacagattaccttttatttctttttagcttcaaacctattgttaaaatatcaaattatttgtattttcctactctctgtgaaagaatctttttaaaaaattaacctttctaccatttgattttgattacagaatgactgatttactcattaattacctattcattcctacactatagcagatgctattctaggtactagagagtgatgaacaaaagagatgtagactctgtatcagagaatttataatcatgtaaatgttataaagatagtgaaacaaaaaatgactcataataaaataaaataggagtgatgacagaggagaaaaatttaacttattttgaatgaaagtgtgtttgcataaggtaaggtacgtatgtatattggaattaactcagtccaggaagtggccgattttagagaacatagttgtcagtttaatctcctgatattgcagttagcgtattatctgattgtggctattagcttgcaaacagctgttgtttagccaaagcagaagccatatagggtttgcaaggttgaagacagacctgttaccacttctagtaagagactttcaaatatatggcctactgatggcttggtagtaatttcagcaaaaaagacaagtcctgttttcctcccttattattctcctatagattcagcactatctgttcgcagtctttgtatcaaggctgttctatttacattccatgcaaaagatgtttgttttcttttcatggtggtgatggctaatggctccctccattgtggcaataccttccagtgtcattccctatccttctgctcctttctctgcctcctactcccatgtagagtttctccaagagcagacttacttgattacctcagaaagccaactcctgtaatgtcacagaggcatagtactctatgaaactaagacgatctaagacacatgggagggaaatatgactggaaactatatttgctggttgctactaagagcctcactcagtttccagtgtctttctggtggttttacagcttttttttggtaacttacgattgtcttctctagtacccttcccaacaaaagaaatgtaggatattctaattattttgcactcattaaaatggacattcattttgctgaaatatagcttattctatatatgtttataatgaattatcttgtataatttttttatcttgacctatttttgtatgtgtaatgtcattcttttatgggcctgtgcattctctttagcattctaattcccattctagggaacaaattacagcacctttgtgttttaatcatcaattatcctactcaagtgttttaagcaccctgcaaacaatatctggtatgtgccttgcctagtttaattattgaagcacttttgaaagcaccaggatttcattagtgatcaatataaattgggccagtgttcaaccaatttgtgttcattattaaagccttcggttccaacaataacttggagacagagaactgatgaagctggttagacaattgcctaatgaggcaagcagactctgcctctgaccttaaccagcctctgggctctgaaaactttaaatggtcccagtgacagatatcacactagaaatcagccattgtccatctaatcactacctctagctgagctgagaggcataaaataacacaaatgaattgaatgaaagacagaatctatcatgctacaggtaattgtgtttatcaagcattaatatctgagactcaatcctagggctctaatccatctcataaaacaaagtccagagacaggagcaatcctcggcaaagaagccattcgtagaaagtaaaatttgtgggatccaaaaataattgacataaaattccagcaaaacagactgacattccaaaagcactttaaaattacaagggattgaggacacagatcttttagcagaaggtacagattaaccgggtcttcgacacatgcacaggatgtaggtgacgtgtacaactggagttaaatggcagttgagacaggtaggctttttctagttggagagctctcagggaaccggtgaccactttggtctggtacagatgagagatatagaaattatatcaggtgggaagtagacacctggccagggagaaatgcagggacataattaatcccatttctgctgagggtgacaacctgattagtgcccttaattaaggtcaggctttgagtatctttataaattcttgctatgggagctttgtgccaaatatatccatgtatatgtatagatagttacattatttttccctacatcaatttcatgatctctaaaatgaactgagagagatctgatttgaaatagtattcttacctgttctcaaaatctgaaagtccaggagtccatggggaaataagatagagtttttattacatattgaggtatcataactcttcctcaacatggaaacaaagagcttgcattatgtcaggtttgagcttgttagagacatcatttcagcaggctttttggattctgtgttggttgctactgaagtaaatttgcacagtactgttagcctttgggggtctttcttactcaaccactatagttgttgcagaattttgtgccttagttcagctaaaacctggttcttgtcacacgaccaggaaaatttggacacgttgaagggtgagtagagcaggattttattaggcaaaaagggaaaaaacctcacagattaaatcccaggccaccacacagaaactgaagagaccaggctcctcttgcctgcccatggctccaccctgttcccccagtgcacatgtgggcatgctccagcaaggccctgggcagcttccctcatctgtgccaaagcctctgatgtaaacacttatggagcaggtcggaggttctccagggttccctttttatctgcttaggcattcggctatctcgtagttaagattgagtagatctgggcaagaaaacaggggaagaaatggatataaatatgtgcctttcatcttcattaatttgaagcctcaagtttgtataagtatgtttccccaagggccttaacatcagatgttatgtaagtaggattttgattattcagaaaataaacttaccaagttaaacacagcgatattaccttgatttggaaaaaaatcatttagcaatggaattcaattttataccccggtacctaatacatgattccacagggaatcatgcttgattctgttagaaatactaatctggatgtaagcacttgccttcaaggagctttaaactagtggaatgtaaaaaaatgcactagaagataatgtagactgtgagggaaaaaaatgttatgtgatagagatgagtttcagttagcaagattgggcagattttaagaaagagggggtatttgactgaatcttgaagcaaggatagatagaacttcaactgacgagtaataaaggctcaaaggggaatagcatttgtttcattaatgtgctcctagagctcagcttgcataactcattttttataagactaagtttatgcttaaaaactcaccgatgtcatcaaaaatctaataggaatatgaacattttctgctagtggttttggtctctatgttagttctatacttttttttttttttgataagaagtatggatggtgggaaaccaactgctttgatggaaattcaagcaacagacagatcccctgtcagctccacacaaagatatcctgatgaagttctcctgacttctaggagggaatgtttcggaagtgcacatgagggagaggaatcctgctgtcagctgactttttcctttgcttactgtatttgttttgttttgttttgtttttaaaacaggcttggacatacattttcaattcgaaaactcccttctgagatccaaaagtaaacatgtttacagattatgcaaaagtttgagtttagtttcagaatttttctctcaaaggctctagcacaaaaaaaatgggggatgtccaaattctggaatttgaaacaaataacaggacagattgcaagctggcagctggcagggagaagtccattatttcccagctccattcctttgacttcagcctagggaaaggttaccctaaccttgcctcaccttattacccattctatttttaagcatttctcatttactgaaaaatatttaccacatacttctagtggatctaatcattagattcttaggtggacgcttctcaatcaatgaaggacagaacctatcgagcttcctgacctctttagttcctaaaacgcggcattctgttttctctttttactactaataaaggcagttaacattcactggtgggccacagtgaaaacttcagatagttttctgaaggtttactactttctatttagttttgttctttttttttccctaaaaattagtgggttccccagtttgtgtattgtaattccctttttttgagtcttgtttttcctcttcttctgtgatttctactcattcccgaaactctgcatagtaatcatgaccaaatgatttctgaattcatatatcaaatcccccaaaggcttaatatcatctcagaatgtcagccaagctcagatttccaaaagttttatattattacattggcttgaatcatagacttgtgtccttctgtagtcagcacccattccttcacctttaggcatagctccagttctgagagacctatccttgcctctactgacaacagcctggtagggatatcagtaaatgtagccagacatgtatattgccacatggctgctgcatggccctgattaggccatcttgatctgattgaaacaaagattagaaatagtagaagttgattcattccaaatacttgatgggacagcacatcaaatcccacagctcagacccctggagctgctctggtctgtgtgttttctaagcatacctttcaaaccctccctctgtttctacaaaaccctgtgtatttttcaaaggaatctctttttatgctaggaagaggtggtctctattgtctgcaaccacacacacacacacacacacacacacacacacacagatattctcaacaagtagtttctacaatgttgataggcacattgttagagatggagttaaaaaatcaattcctgagtcctaaatataggcaacttttatttcaatgaggacataatacatccataccagagatcattataataccatgtattggtaccaggacctggaggatatattgaggcatcttcctaaaacttcaacctaagttgctatctgagatttaaaaccaaaacttaagggacaagacataagccgcctcatataataaatacaggacaacttctttgccatcaggacataactgaaaactaaaacacatatttgtcaaaaggtgtgttggtaaatgttggaagaatagatttgtaaaagtgaagtttggaagttttcataaaagaattaattagtagagaggggagtaccttgaccaatgagcttcctatatcagaggaaggcagatgagacacaataatctgaagtctaatgcagtttgttcaaatcctggataacttgcttaacctgtctaggtgtcagtttccttagttataatttgaggataataacagtataaattattattagtttattgtgttgattatatgaaataatccatttcctatagtttttactgcacatgggttaatataaaatattatcaacttttttactattattattgagttggcaaagttattcctattatgggaaaagattatcagacattttagcccagtgccttacaaaatttggatcttatcattcttttagttctgatcctgggctcatgaagcaaccttctgttgctaactggcatcctacataggcctgccttgagggaagaattgctctgctaaggccaattagtttctaaggaaactctattttaatacataaaccaataatttgatttttttttaaactttatagatcagatttatttggagaaaacaaaacaccgacaacccaaaggatgggattttacgtcaagacatctcccaggtaataagtctacagattaaatcattttcatggaagatatttttgtacaaattttacatgtattcaggagccggacattaatcaatccctgtttctattttaaaagggaggacaaagtaggggagggggaaaacagttttggatataactatttggaaggagagtagacatgaagagggcaaaccctagcttttcattatctacaaccaatgttttttttcttttaaaaaaaaaataaaacaaaaacttttcaatcttcaacactctttaaaagcccacttcttagctactggccaatccacagcaattatttaattcacttggtacacacctttgtcctctgggtaaattatattcattatgcccactgctgcagcacgcataaaccaacacccctgcatggctgaacagggcctaatctaggactgatgggagaagggcttgcaaaccaagatcaaggtgtcgtttctctgctaatactgtctacaaagctgatccctacaaaaatgcacataaaagcaggcaagtttatctactgtgttgcaagggaaaccaggactttgttaaatagttctctccattaccatttgttctctcaagggaagcttaaaaaaaaaataaagaaaaacagcacattggtctgcccccctcatgaatccaacaagcattggtgtggcatttcagtggagaaggaaacttggggggaaaaagcccatcaaggttgtaagaagactcccaatttaactgtccctttccctatttatccaccatccaagaccatccattattctagagcactctgatctataaaaggggtcaaagcatcaggagcaggcaaggagtgagaaccaaaagacatcaagaaaccgatttgcttgagaaaagcagcgattcttcctttcatagctctccatggctgagagagaaaatgcccgagacatcatgtatgtgacttagagactgcttttcgggaggttaaaagtagcatgaagagcttaagatgacgataagagtctaaatttttagtttcaaggtttcagtagaatgtggatatattcaaactttcaaaaaggacagtgtttagaaagggtaaaactaggacacagaaaacattgggaattaccacgacctccaagtgcttccggctccaggaaataaccattcatgtgtttgctggaggtcacataattttcccctattacctggtgcagaatgactcatcacttcccaaaagcttcttttcagtccacaattttcccatttattttggtgcaatgcagtcccattctttatggcctaccgtctcactcccaactaccctcctgggagtaaaaaaaaaaaaggaattccccctaggctggcccccaaaactcagaattaaataagaggaggggctggcagcctcctggagactaaaacaacttgaggctaaatctacctttccaagggtggaaaatttattcagataatgtttgagaattcatatatgccaccataggataaaaactaaaaggtagaaatctcacacttttccttctacctccctcccatactgcccaaccaggttccaggcgttatatcactgtcattaccacttctgctaaatggagacctctagtttgcttttataaatcaaacttgtgattttggcaaatgaatgccagccttttcatccagctcctagaggtaggacatcctatggtagacacaaaccctggggccttgtggaagcgtttaaatggctgaagcatcaaggaagccttctgagaaatgtttaagagttaaccaggtcaaggagataatgaagttctcactgccaaggtagtatagggcaaacaaaaagcttaaggtgtcaagatatataaacagaatggggatgggggtggtgtcatgtgaggggactacaagtacttcagggttgctaaaataagagttaaaggcagatacttgtaggagactgggcaaaaagtctggctgggtcagtatttaattgtatgcccccccccaaaaaaaattaataagctgaaatcctaaatccaaggacctcagagtgtgaccttccttggagatagagtctttactgagataattaagttaatgtgaagtcattagaattggttcaaattcaatatgactgatgtccttataaaaaggggaaatttgggcacagacatgtatagaggcagggtgatttgaagacacacggggacagatgaccatctttcttccaggctaagcaaagggacctggaatagatcctttcctcatagtccccagaaggaatcaaccctttcaatacattgattttgggcttttcacttccataattgtgagttaacacatttctgttgtctaagccactaaatccatgaaactttgttatggcaacccaggggactaattcagccagattttaaacctctgtatgtatctgctaatgagcttataccttctttgcatgataggaaagcattgaagtgtgtgtgtgtttttttaatgtgtgatatgagaggacttggtgtttgtatgcattagtgtgtgtgtatgtttatagatcattatgatatccctgtggaagatggattcctggagactaaatattcaagtcaaggacatcagttagaaaattattatgttaatccaagtgagttattactatgtgcactaagggtaagaaaactttaatatcagaaggactcaggaattgtttacaaaggtagtggaatgacattcagatgggctagaattggagccacactctcgggatgtgtgttatcctctgccacctgctagctgcgtgaccttgagcaaggtacttaaccttcttgatcttgatctcatttctttacagtttgtctgtccactgaagccaacaaagtttccaaatcataaacctgattgtcatttcattttctcttcttaaaaataaaatagtcccatggcgcctgctcttaaggggctcacaagtgggacaagatttccttccttccttccttccttctttccttccttccttccttctttccttccttccttccttctttccttccttccttccttctttccttccttccttccttctttccttctttccttccttccttctttccttccttccttccttctttctttccttccttccttcctaccttccttccttccttccttctttccttccttccttccttctttccgtccttccttccttccttccttccttccttctttccttccttccttctttccttctttccttccttccttctttccttccttccttccttctttccttccttccttccttccttctttccttccttccttccttctttccttccttccttccttctttccttccttccttctttccttccttccttccgtccttccttccttctttccttccttccttccttctttccttccttccttccttccttccttccttccttccttccttccttctttccttccttccttccttctttccttccttccttccttctttcctttcttccttccttccttccttccttctttccttccttccttccttccttccttccttctttccttccttccttccttccttccttccttccttccttccttccttccttccttccttccttccttccttccttccttccttccttccttccttccttccttccttccttccttccttccttccttccttccttccttccttccttccttccttccttctttccttccttctttccttccttccttccttccttctttccttccttccttccttctttccttccttccttccttccttccttccttccttccttctttccttccttccttccttccttctttccttccttccttctttccttccttccttccttccttccttctttccttccttccttccttttcttccttctttacaccccatttttctttaattaaagtatctaaggctcaaaaccccagcccaattttactctcatccctgacatgagtttccaatcacgatagatactaatttaaaagcacctttcttgagtccttttcctttactttaccatccatctgtatgatcagtctgtctttagtcactcctggcttccaatgagtgatttcctctatacaataatgttcaacagcttttcagtatctgttgcattaaatgcagaatctcttttttagcattctagatcattcatcattctaaaacacctttcaactttatctcccattcttcccctttgtattccatctgcattgatcaaatgagattatctcatcactgcctgattctacgcagtcccctctcaattcatgcacttcttctccattctttcctatagaaattctacccattcaacagggtccttcctaaatgccatttccaaactaaaatgttctctgcattagggtactttctcagtggtgtgtagtaaacatttactcagacttgaatgagggaaatgaatttactggcttaaataattggagagtctgaaagttattttcagttttctctaagtggtgtgtgtcttagtttcctgttgcttataacagaatacctaaaagtgggtactttatacagaaaataaatttatttcttgaagttatgaaggacaagaagtctaaggtcaaggatcctcatccggtgaggaccttcttactggtggggactgtctgcagaatcccgagaaagcacaggacctcacatgagaaaggatggagcatgctagctcaggtctctcttcctcttcgtataaagctaccagttccactttcatgataactcattaactcattaatcagtgaatggattagtccattcatgaatgcagacccctcatgacctaattacctcttaaaggcctcacctctcaatactgcaatattgagaattaagtttcaacatgaattttggagaggaaaaatatgcaaaccatagcagtggggaaaatggctccctttccccatctctccatgcagcagctctaggctacaatttataagtgtagaagaggagtgaaactattatttttattgttcagaaaagaaaggaaggaaggaaggaaagaaggaaggaagggagggagggagggaggcagagggagggaaagaaataaattccaattggctctacttgtgacagatgatcacctgggccaattacttttccaagagatttggaaagtctgattggatagcttggataatgttgagagtggcatggcttttgattgacagcccagacaggaacagatgaagtgacaaagaggcatttataaaacaatatgtagaaaagataggagtggtttggaatctggtgctgcttagtcaatggtagaagtagagacagtggtctgaacactgccatagaaacatgtgctagaacgtttattggctaattatatttcttatcgctgtgtgcatgcccctgtatagtgtgactttaccatatctcagttaagaggcatttcactcccttgatcctgggctggatttgtgatttgctttgaaccatacaatctatcagaagagacaaggtatgcaatccagagctaggtccccagaggccttggagattttgtttttgatgccttaggacactgccctgacattaccatcccaatgagtaatgaagacagatagccactgtcccagcagttccagttgagcctagtccccaagcaacccaccttctgaatgcagcacaggtgagcccagcaaaagaatcactcagccaaaccacagaatcatgagaaatgatgactagttattattttaggacactaagtgtggggtggtttgtaacatagccctagaaaactgatgaagaacaggaccaggcttgcactcccaggagagcacgaagaaaagttctcaaaaccgatcagtattactagtgtgttttggaaataaacccaatgagaaaaaacataggctatttattgagagtttgttatagcaagaaagtcagccaccatcacttgtgtttgggcagagactcaaagtcaggcagaggagtagaaaagccttagagtggataaaaaaggaaggcttcagctgtgccttggtgacagggtattggcaggaggaagctggaggtgagctgactagatacagggtccccatgtgattgattggggggcatatttatctatctttgtttggctctaagttggaagtggggtaaaaattagagaagctgtcaattaaattgtggcctttttgagccagttgtggcaaggcttgttgtttggcttcctggactggttgctgaagaaagtggtccgacttgtggcctggttactgtaactagcaggttaggtgcctgtgctgttgttgcagactatgagtcagagttctatttttataggcactctaattattgtccatttgtctattccgtttcttaatatttcactttgttacaaacagaaaaaaaaaacctctctctgaattgttcggaacatgaaccccagaatgggtttaatcaagataaactaaactgtgagaagaagacctttataaaatgttcattaagatggaaagatatgggtcaggagagctgggagtttgagtcctcgagggcacaggagtcacagcatttcaggggcaaagtagcaaagaaaaatcctctaaatggaacattataaaaggtcagcagagcaagacaaaaatatatattgctgtccatgttataaaagctgtcaaaaatccaaggcagcgtcactaagaagcctctttctaaaggcagatgcctggagtgagaataaaacattaactcattaacctttttattataaacatgtttattaatttcttaagagagaagggagttctatgagggaattggacttatgacaaataagttgtgatgagttcaatagaattgaaaaaagtgaaacacttctaattcacttagcaagaccttattgtgcacaagcaatatgtaaatcattgtttatcagtgagagcaatgcaaaacgtatgtgacatggagcttccctttaaggaatggttagtctggcagcctcgtggacactaaagcatgcctataaattcctggatatgatgtaaaaagtgataagtgtggtaacaggcaataggccatgggaatatggaagaccagaatattctcctttctctttagaaacatgggcaatgatggcacggagtagaagctgttaagaagaagtttaaaggaggcgtaataatggagctcttaaaaaatcaagtggaggacaagttcaagggctaaaaagggactttgggatctggaaaacaaattattaaagctacaggataaaggttaattggttggagtgttgagttagctgaacaactgaaaaaaaagtgaagagtgctagaaaaaaatatcagtttcagtcagacagtggaagacattgaatgcctagataagaatgctgacatttattctacatgaaaatgctcacaaagctttcaggaagtagaatattattcagaacagtgctctgaaatgaacaatcaagcagtggcttttacaacagataggtctgaggtaggttgtaatggcaccagataataattcattggcaaatatctaatgggggcaacagaaacgaatgagaagagataatagatggcctcaaatttccaagtatctgaccagataggggctgagaactgaaaaaaatggaaaagagaagtataaaatcaaaataccaaagagttgttgctaacttcacaataaagagccaaaagttatcactccatgtaatttcaaaagcctgctctccccctgtgacatcctaaagggacacatggaaataagttttgaaatggcatgtggccatatgattcattgtcatacctggaaattaggactcagagttatgttttcttttctcctttttgctatttctttgaagagctttctacaacccaaatactctgccagttttccaatgtatttgtgaaatggtgatcatgattttggctaccctcatgtggatttagagaagaaaataaattgaattcatttctgcaatgcacgttgaggatttcagagattttcttttatttgaagaaaaatataagcttctaaaatactcataacagccaaggttgggcaactgaaattgccttttgctctgcggagactgcgtaatatgagctggaaggaaaaaaaaatgatcctgaaacctgaggtttcacatcaacaactgaaaaaaaaaaatgtagaacataaattgtagttttcttgcagaatatttataacagctcacttgtagtactccggtctctagctgaacagggccaatggagaaacatttctcgattcagcgttttgtttgatccttactacagagtgattgatcacagcaatttctttcacataaacaaaatcctctagacaagcttgttggagacactcagggctatgaatacactgcagaccaaaaactaatattttgcttgctgtgtttaaactcagtgccaatagggctcaaatcacttgtatcataaaagcaaaactcttttaagcatcctgatttaattaggttccagggaaagggcattgcctaaacatgtttctcctgtagagaggtatctgtcttttcattagagccccaacatacaagcaacaaaacgtatggtttaacacggtgagcatctttaatcattaggaaactatccagcaactagctcagctacctcattttggagagcagagagccgtatcgggaaggaagagaaatggaggacagcatttcccgtgatcctgaacatgttctcatattgatgatggtcgtttctgccgccggagtagccggaattgtaatttgagaggagtgtcattttctgcagatacaaaccttgtgtaatcctcccatttaaatgacatgatcctgcaggctgatgatttcatggcccacaatttgtcacctccccactgcttgagagcgaaacggtagctaaacgacaatcaatagactgattttgtcatgcctgactgttcaccttgtttgaactaatttttagtttgttaattgtgttttaatatgccaccaaagggggaggtgatcattatttttttttaaaaaaaggaaagagattgtcaaatgaggtgaggagagggtgatttaagtgggatacattacagaaaatctataaagtcacccctgctccctggagtaatttccatagaggaaataaactagttacatttaatgtttgtgtgcaaaactgattttttttacttcttgttaatatgctttattttttctatcaggattcaaataattgtaactatgtaaacacctatatatgttactatgaatagatttttgtagtttcgatatggaaatataatttttcagagatagtgagcattcagttagtcactgattcatgtgtggtagaagtcatgcctggtaagatgtcatcttttctgtttaagaatctgtaagtagactggaaaagaaaggtttcagagtttttttgaatatcatgctttttggacaaagacaaatcttaaatataaatagactttaataaagctttaggacccattaattaaatgtcactttcaagatgcagaagtgaggctgaatgcagtggctcacaccagtcatcccagcactttgggaggccaaggccagtggatcaattgaggtcaggagtttgagaccaacctgcagaacatagcaaaagcccttctctacaaaaaattattttttaaaaatttgccaggcatggtggtgcatgcctatagtcctaactacttgggaggctcagatgggagaattgcctgatcccaggaatttgaggctgcagtgagtttgatcatgccactgcatgccagcctgggtgacagagtgagacccctaatctctaaaaaataaaaaataaaatttaatttaatttaattaaatgatgtagcaataatacagattagggtgtgggtgcctggattacctctgagtgaaggcggcttctggaggttcttaatcccccagtgattacagtaatcggtagtgtccctggaagattaacatactatggtatatgtcctctttgaaactgtttctttcctcttttgttggtatctgaacattaatatctttaggatgatgaccgcattcatcatccaaactgagaggcttttgaaaatgaaggaaaagagttattagtatgtatcctgggaatattgacaaaaactggggcagtccccaccaaactgggatgtatggccatgctaaatatctgctctctggactttcaggtggtatgatatgaaaattcacccacatctttacataaatatgggaatcgtacaactggttaaatagagtgtttctatatatggtatggtatggtggcaggtgtgacagaaaaaactagaaagtgaagaaagaagcatgtgaacatctttgcataaagaaactgcctagactttattactcatgaatgtaacatattagtgatttccagaaactagatagaatgaatgatctctaatagagaaccctcctcccccaatggttttgtatactattttctcaggatacttaataatttctttctaaactgcaaatgagaaaatgaagcataaatatggtcttgactttggcacacccaattatttgaattgttggtatcattttaaaataaaattgttttatattcctcttcctaaatgattcaacctcaagaccaattcaagtgttattcaaataatttgaatatctttcacttcatcccttaagaagtacaacaaacctatggttgggttgatggagagagattgatgtcatgccccgacctaggaatcagaggtgctagctaggctctgctcattagctcagagactagaatgagctgacctgcctctctattctaccagttccacttctaagggagccatttgctgaatagctgtgaccccttatttacagaaaattgcatctgtaaaatgaacaaatgtaaaagcaaaatgagtctgaaccagcatctctgactttcttcatatcatcaattttatgtttaatttttatatatataatcaaagttattatttcttctattgaataagtttttactattaggagctttgaatttgttgtcacagttgaagctataaaaagttaatccaggaacatttttgtaatgttactttttccttaaaatatttgaaaccttatatatctgatatacccatctttcatttttttaaatttcctttccattttgagcagaatcagatataattccttccatcctctcttcttttatcccttacttcacacaaatatttatatagtgtttactatttttcaggcactattcttggcacttgggatatattagggaataaacactaattccactgtggaggagctaatgttctagtggaaggaggaagacaataaatagggtaaataaatattgcaggttagacaataagtgtggtgggaaaaaaataggacagattggaggattcaggagtactgggtcaagacgtgagagtatacatttcaattttaaataagataagccccactgagaaaataacattcaagctacatgatattgtatgagcaggagctttttattttgcaatcagctgtattgtttcacatggggaaaactagagatgaaactcaataatatgacatggttgagataataaaataacaaaaaatgtataatattgggtgctctggtaatgactttgcatgtgtcattttatttaatcttcatgacaatgttatacaattggcactgttatctgtctgtgaggaaagtgagaccaacaataaccgacttgccctgggtcacacagatagtaagcggtgattccagaatttgtatctaggtagtctgattctaactctactcccttaattactagccatgttctcttgagttctttcataccaaggaaaatgtcgctattattcctgacgtatcttcaataacctcaataattattttgcactgtgtagggcctttgaaaagatggaggacacacattaactttccaggaaagatggtggtgctcacatttgataaaatgagagtttaacatcaggaatgaagaaggcatgagacttcctcttctcactaaaaatgggttatgcgtgattaggtgtttctcacccactcttaagagaaaaagcatgcatgattaatatgaatgggggttcaagtgcatatatcaaagggagaaacatcctcttgcattttaaagattgcaaataaatatagtttaatctgctatacataattcatattagcaacaaccacctcaaaattaatgtcagcccatgttaagatttgtgaatgacatctctaaagctttgcttcaggctattctcacagagactggttaatgcctttatggctaatttcctgaggcttatttttttggtctttcctgatgaaatattaagctctttttaaaaagagatttatctgataaaaaagtaaacccttgttcaacccgttacatagatttttctttaagatagggtgaggctttgcataaaaattgaaaagattgcagagggttcagtaacactagaggatctatgagatgtttttttcttattgaacttgacctcttactgttcagcacactctaaataagggatgttaatttcactcccaaacatactttattgctttggatattgagaagactgttaatctgctacttaaaaaatctcagaaggcaggaagtaattgcagaatttaacactgaacaatattaaactctaatttgactactcattctgatattaggggttatttcaaaagtaaagactagaagttctaagagtaaagagataagagttgtgtgctgtatttattctttcctcttcttttgggaagatgccagcaccccttcagtaacaacgcaagagcgtcttttcagacttctctttgcttttggtaaaaacatttatgtgtgtatcgaaatttgaacattctccctgaaatggtactcaaggagatttctaatcattcaaataatctcctaatttctcttatttccacctcaacgttcccaggcctttcctagctctgttctttttattttgttttttttactgtattggaggaaaaaatgcctatcttcactgccaaggccaacacattcatctctgccagagcagcattcacttctagtttcctctgggacattactcccttgggtacctattttcttactggtgttttttcacctctctttctaatgattcaaatcagcttccaggtatgctcagcctccctaccctaatatcataatccttctaaagtattttttctccttagtccttttctgccctctcctctctcttctcctcttgtattttctcccctgtgttctatccctcctctttatttattttccctcacttgattgccaaacttctcaaaagtgcaaactgtgtctactttcttagcatcctggcatatgaaacaaccatggccttggaggtaagatgactgggatttctttcctgattctatcttctggtgtgtaactttgacaagggacctgaattctttggcttgcaaataccgtattatatccctctagtttccagtgatggttacacaaactaatagatgatagaatcacatatcatttctcttggaagatagcaaattttcaagaagtaataactaacatgtattcttcagggtacacccttctcctttcccctaagatgagctttttaaaaatatcatctggaaaggagaagaaatagtacaaaagaataagtaaacattaacaaaaaatactgagtgtacataatacataacgtaacaaagcattagatgcagggaacttgggtcacagaatagacattagaaattccatttcttttctcagagctatgatgctgtggcaatacatgtaggagaggcaaagtgatgagagagaaccagaagcagactaagatgaggaatgtggttcttctaggttgtcctattgtgatagatggtctcacaagatgtccacaattaagtttattcctcccatgttgctccatggaaagatgggttttcttcctctccccttgaatctagactgcatttgtgatttgctctgactaatagaatatggtagtagtgatagttccaggcctggactttaaagggatggtggcttcaggatcctcccttggcagtgagatgccatgttgtgaggaagtccaagccaaccacatgcaaaagccaactgggaaaggagagatgactggctatcccctagtggggccagccattatggctgaggtactgctcatgtgaataaagacacatcttgtactttccaggctcagaagaaagtggagcagaaggactatctggctgagtcagcactgattccccaatgattagatataataaagtgttattgattcaatccaggaagttttgaggtaaatttttgcacagcattagataacagacacaattactaatgaaaccagcccaattgtcccatataaatgatatttacaggtttttgaatcaacatagaaattgatcttcctcatcttaaaacttgaaacatatctgagttccttcctaagaaaccaactctggggcaagggaatgagactcagcagatcaccgcatccagacaatgaaatgccagacccctcatccatcatgattgcttccttacccctccctaattcctctccacacatagctacatcccttccccactatataaatccttcaactttagttgtttggggagattatttgaaactgatctgtccctgtggcttcagcagctgattaaagccttcctccctggcaacatttgttgtctcggtgattggctttctgtgcagctagcaatgagacttagactgacactaacactaatatacttcagcaagtcatctgcatttgctgatccattctaatttatcaaatgagacaactgaactagctcattgcaaacatgccccacccagcctgaattctggccatccatcagttttgcatgtgcaagtatttttactgataaaagttagaccctgagttcaaaaagtcttagaacttcactcttatttcctttatgacttaagtcctctctcatctgtctttttctactttaaatgaagttaatatcatggatcaactagattaaatgagatagtctatgtaatacataattctggaatgtgataagtacaccactttccatgaaagctcttattattaatgaaagaaagaggaggtcccacagcctgacccagagttgtgtactctgatccacaccatcagtggaaaagaaagtgccgtttgtgagttctaaagataaatgctgtagatgttttccaacatggtgacatctctgtgtttccctccttaaaaacctgataataatcttcatacttctttggaaaacttaatagaatgtaatgtactgaggcatcacatccttagtccctcttaaattttctttgttagataatcagggcagagtatcagaagtaattaaaattaaactctgcctgaaaatatgttaataaaaagtatgatatgagattataagtattgttaagcaaaagttttagaactatgtagaaaaaaaagtacagaagacagtgttaaaaaaaaagaaaggaaggaaagcatggctagataaaaaagctgaagaaaaagttaaaggacatatggctctgtagcccactacaagtttgcaaaattcatttctttttgtagacacagcttgatataagctgaatcctgacaaattattctttgtattcagagtcacttaatttaaaacaatgtaaattcaaaggaagaagataatgttcctaacctcactgtgaccccagtccaattttgctacaccacctcaagcgagtcaaattcacaatttacatgcaggaagttaaccacaaaattagagcaactctttataggccccaaggttaagcatcaaaggcagaaatccaattaaaatgttatttggattttccaatagcaaacaatctggaaaacttaccagattatgagaaggatatgtatatgaaagctagagattatgtcttgcataaatcaataaataaaatttaaaaatgtttattcatttcttcaacagagatttatatttttgcagattacatacaagattttttaaagaattgtggagaaaagataaaaaatgacttcagccctcaacttaagaagataataatttttaaaaggtagctaaaacattcaaatatctatgatggtaggtaggatattaaaattctagatgagtgatgcacataaaatgagacagctgtttaagggaggagaaactccttccaggtttagggatggtaaggattgcaaatacttgtatacaatatctaacaagtacattagactttgaagatgcacacatggcacaagcacattgttacacacaattcatattcatttatttcagtcactcagaagatatttgtgcatacctgcctagctttcacatgctgataagacagtctctttcccgagctgtataatatgtgagtgggaagaaaaggtgctttatttaaattaaaattaaactataaggctgatttgtaaaatataaaagcaaaaaacctcaaatgaagagggtagacagactgacgagttagcaaatagaatcatctatcaattaacagtggggacctggatgtcaagttgcccggtttgaatcctgaatataccacttcctagcaaagctgaatttagtcatctgtaaaattgtgataataaaattagtagctgcttcttgaggattgctatgaagattagataccgtagtcctcccttatccacggttttgctttccatattttcagttgcctgcagtctgaaaagagatgaaaaactacaacaagatattttgagaaagagaccacatttacataacttttattacagtatattattataattgttctactttattattagttgctgtgaatatcttttggggcctaatttataaattaaactttattatagatatgtgtatctaggaaagaaacagtagtatgtagggtttggtcctagccatggtttcaggtatttactaggggtcttgggaagtatctcctgcagataagagaggactactgtaatacagtgcctggaatatagtacgtgcctggaaaactgaataattgccgacagtattaagattgatgtgaaactacctagacctggaagggcttggtggaggttcaggaaagaagaaaatgtttgagctaagcttagaatagtctttggacttgctggtcacaaaagaagagctttgttaaaacaaggacactgttggaattagcaatcactaaagcttcaaaatcttttaacttagaaccattaggttctcactcatctttggaatacctctgagatttacctgcattggcattgtgttcatctttttcttgatggaatttaggctcagagaattttagaaactcgtgaaagtcagaaaggaaactaattttctaattttcaaatatgatgccttatacatcaactagagaaatatactctcaattttagtttgcgaggtagactcgagtctaagtgatcctttctttgtgtactacacataactagttatgtcactaaaagacaaaaataaggaaataaataaatatataaaatgaacggtaatgtctctaccttaattcccacatcagtaaaacaaagctaaaaattatctttgcctctatatttctaagtaatgtttgatataagtatgaaccatgacatcttaaataaaaacctgagagaataaatgatctaaggggtgcttccaaggaaaggtgttatataaatatgatatattttcattaatagctataaactgtgagtccctgagaggatgggaccttaagcacttctgttaaacctcaatgatcttgtgaagatgtgtctggtcatcacattttctataatacaaacagttaaaacaccaacatgattagaagttaaattaacgataattagaaaaggcgataccaggaattgatttagtaattcaccctctgagatatcacttgtattgtgttcagtttcttagcttacctattctattttcaagtaccttattatgagtttatttcacttccccccaaaataatagattttagctttgtacgtatttgaaaatttataatccatgttttgtgcatgtgtaactctcagctcaccaatatatttcattatctgaaacagcctaaatcattccatatatgtatgtattactttataaataatgcacatgtgagaaagtgaggagaggctgcagatgttcagtaaagtgcttggttagacgcaaacaatattatgactggaagaaactcaactaattatccagttcagggttggcaaatttttttctgtaaaggccacacagtaagtattttagactttatgggccatacggtctctgtcaccactacttgactctgccattgtaccataaaaatagccatagataatgcaaaatgagtaagcatgacatattccaacaaaacctcatttacaaaaacaggcggcctgccaaatttggccctagggctgaagtttgccattgtataaactaatgcgactcacctatttcacgtgtgaggagattaaggcatagaagatttaagtgccattattggctattattaattgaattttcatggggagaaacagctctgtctgctaacatttttattctgctttgtcaatgaatcaaccttccacaaggcttgctggaatgatctttatgaaatgcagagcaagacgtgtcttttctgtgtttaaattcctttaacagatccctgacttccatgtgagattcagtctccttgtctagcgtatttaggatctgtaatcatgagatttctgatcactgcatcgattccatagcctactccgttttgcaggaaggctctattaagcccccacagtatgataaactgcatgacacataggaagtggtcctattttatttactttatctcccatgtctaacataatgcttgatacacagtagatcctgaataaatagctggaaaatgaatggataaattaaaagctgagatcagaaaagagttttaaggcaaatttgacagaatacctccttgcttggccctgactaaagtttcctgggtctcaccacgtgttcatggaaaatgaaaggactaggatcagaaaccccctcccaggtgaccttcatcagagctcacttcatcagcctgtctccctagtaacccatttctatattaatgtctggttactcacagggccccatctgtaccgctccttaattgtgcaaaaatattccacgaactaagtaaggacattgctatcgtattatccagcatggttttcatcagctggtcacacttccttctgcttcttcaatgtctctaaggaatttgattctccaaatgttcaatttgttgtgaggtagcacaacctagagttacaacttgtattcctagggctattacagtgactcacagtaggagaggatattttgatacctggatcactgaacccacctgggatgctaatgtatatgtccgtgtaatgtgtggaattaccatcaccagaaggttgtcttccccaaggcagtatccccttcctccaggaaaatgcagaattgttatcactgtaactccataccagcagcatcctttcaaggaaggtctcacagtcttagccaaaaagagcacactgtgatgctgatgacactgtttttactaagctagacaaggtttctttttaaaaatattggccaccaaacaatgggattgtgctttcttctgcttttaaaagcatgattttttttaactatctccactcaagctattaaattaactgattaaacatatttattagccaaatacttcctaaatcatcagattgatctggagactattcagaagggaaaactttttctctacccttttacattcagtattggaggcctatgaattaaaaggacaaaagacagattagcaagataaaagataaagtatgttcatatacatacaggagagcctgcagaaaatgtagctccaagaagtggttggaatagcatctgaactagtgggatgcattaggatttcaagggacaataaatggtgagaaatgactgtgaaatatatgggggaaattaatggaaggtaagatttgagtgagaaagtcctgtttatgcaatttctcatcccagtacccacttctcctctaaggggacaggagtcactccacgtggtacaggaagacttccttaaagggggatttatgacagttgatccttttggaacacttggcttttaggcagacaacaggaatgcagagaaagctccttcctgcatgtttggattctcaaatgcctttagttcaagataatccttatgccacaatgacataacgtgaaccccttcaagaaaaatgacactccacaaagaagaaaatcaaggcaaagaattcaatcattctggaagacaaaccttttgactaaggtacccaaataatattgtagatgtgttcgaaagccctaagttaatgtgactaagtattcactttatttttcaatcaagcagagccatcttattgaaagttgaaaccaggaacactctaattgaatatctcctcccagaagattaagaatttcttattaatattttatctctaaatgaatcaattaacttctcagtacaaactgtgcctctttttaaaatatataatttggtaaatttattatccaatatagcagagctgaactttttgaaaaagaagggttctctgttagtgtgtggcagcatccataacataattagaagctcagaatattggggctaaaaggtgtcttggtaagctcagcaactgatccttggctttatagggagaaaaagaggcccagagtggttaactggtttacccaaggtcacatagtgagctcgtgctttaactaggacttgaatcttgggctcagtcccattgaaatacttgaaaagagtatctaatgacttgtaggttaatgaatagaagcacattcatcagattaatgcagcaaagccctggatattgagaaaacacaaaatgacttagagctaattaaatacagacacaaattagaaaatgaggcttaagacagaatattaataatttctggtagatatctcatctttctgctcttaaagcaccctatgctgtcttctctcacaacataatgtcaccttcttgatttcaattcattatgcatgggttcaattctgtgctaccctcccatttatatgttgaagtcctaacccccaggacctcggaatgtgaccatgtttggagatgaggtctttacagggatcattaatttaaagtgaggtcattagagtggaccctattcctatataattgatgaccttgagaaatttggatgcagagagatgcacagagggaaaacaatgtgatgagacatagagataaaatggccatctacaagtcaaagagagaggtctgacacatatccttctcttatgcccttagatggaaccaatcctacagataccttgaccttgaacttctagcctgcagaactgtaaatcaataaatcccagttgtttaagccacccagtttgtggtactttgttagtgcagttctagcaaatgaatgcacactatttactcaatttttccccaaggcaacccgcacttctaccctgcccagcaccaacagagatggtgcggacttctccttatcatctcagaaacttccagtgtctggcttttcctgggtactcagttagtgcctgtaactgaattgccttacactaaatagagtacttgtactactctaactcaactcttattcacaacagctccctactttgggtagagtagtttatattattcttatttaactgatgattttccaaagaagataatgacattcccatgtaaggttacaaagtattacaaaggaaagagatgacaatccactgaaatgctttccaaatataatccaaatataatagtccagtctttaaaatctgagttgctttttgttgaatctgaaactgcctttaatttaccacatgcagcttgaggggtctttccagtggaaactgttttccgtcagggaaaaaaataagtaaacaaataaaagccctcaaaactgatcactaaatcagctcagcttatcaaaacaaaacaaaagaaaatcccccaattaaaacaggatttaaaacaatgaattcaattttggaaaagaaattgccaagtttgatttgtactgattattacgtgtttcaacaaactatttaaagtagtggatctttctggggttttacagagctctgtgtccatagaaatcctgaaataaactcaaatttaccaattttgtattgttttccaagaggagtatccactaacactgattaataataacaaatggataattatgtcattttatatgttcttttgttacacataaaaatctagtatttcttaaatgctggctacatgctttatacatcagttagcactctggcagaaaataaaatggtttaatgaaaagagtttaactgaagaaaatttaatgaaggcacatttgtgcagagtgacaggcaaagtaagggaaaaatcagtggttggtgaggtacccaaggctcagcaaaagtgagaagctattacaaccttaggcctgaagatgtggggagttaccatcagagtccagaggaggattgtgggggatggggtacctgagagggagtgtagccatggaggaacacagccacttctagaagagtggtaaggcaaggcttctctctggtcaggaccccctatgacctggcaatcccacacagaagtcccagccctgggagcccagatgatacactctgtaaagctctgttggtctatttttgcattgctatgaaggaatatctgaggttaggtaatctgtaaagaaaagagatttagttgtctcatggttctgcaggctgtacagaaagtatggcaccagcgtctgcttctggtgagggctcaggaagcttacaatcatggtggaaggtgaaggaggatccagtgtatcacatggcaagagagggagcaagagagacaaggtggagtgccagactcttttaaacacccagaactcacatgaactaatagttagagcccactcattactgcaaggatggcaccaagccattcatatgagatccaccctcatgacccaaacacctcccaccagtccccacatccaacattggggattacattttactatgagatttggaggggatacacacccaaaccatatcaagagcttaatctccagagaccagttagacaatgaatgggaggggcagtttcaaatggagaacagagtattttatatgaaccatctaactgaataatcttcaaaccccatgacatattttacaaatttagaagcacaagatcagagaagttaaaaatgtgcccagtttttaatgagcaagtagaatgaggagtatattagtctgttctcatgctgctgataaagacatacccaagactgggcaatttacagaagaaaaagtttaatggacttacagttccacatggctgggggagcttcataatcatggtggaagtcaaggaggagcaagtcacatcttacacggagggcagcaggcaaagagagagcttgtgcagggaaacgcccccttataaaaccatcagatctcatgacatttattcactctcacgagaacaccacaggaaagacctgcacccgtgattcaattaccactcaccgggtccctcgcacaatacatgggaattcaagatgagatttgggtggggacacagagtcaaaccatatcaaggagcaaatgaaatccaactttgttttagatctaatgaagaagaacaaaagaaaaatattgttttgctttcatacaatacatttcttttaaatgaaggaaggggaagagggcattatgtgaaacttgagaaaattgtagatgagttttatgtcaaaggactttgtgtttacttcagaatgtggaatgacttgacttggtgtggaagaggagcagagtcagtgaattgacaggaggatggagaacgtgccagacgagaaagtaatggacatatgttgataaggatgatcaaagaccaaagaatgaggcctgcccaggtggtgcatgcctgtagttctacctactttggaggctgaggctagaagattgattgagcccaggggttgggtcccatctaggaaacatagcaagatcctgactcaaaaacaacaacagcaaaaagaccaaacctcataagaaacagaaaatattaagaaatgagtgggataggaggttaaacaagataactagctctcgtataacactatataatttactaaaattttagtatagctcatatgacttgatactcaacagatccttgagagatctattataactatttcccgcctcatgttgtagataaaaaaacaagttcacagaagttaagtaaatggtagatatggaatttgactgctagcctgaagattgtctaatgaaccaagaataattacttgtttgagaagtctggaagtagtctgtgatatgaaatgtcaccaaactatgatgcaactctgtgagtactaaagtagaaatttagttgtttttagtcatttatctaatcaaataactatttctaatcaaggtatgctagctaactatgtattccaaatccttttaaaattttttattagacaccttgtgccccaaataagaaagctactaaacatgagtatagcccagggctttgataattttcattagcaccttagtttaactaatgcattatctgttaaataagtctgattaacacttctctacataatcattttctaatgcgtgcaactgttgcctctagagattaattgccaagcttttatgttcaactaacagtagattgacatttagcatcttagatttatagatttcctggtatgttattggactgttttctttggatggattcctccaaccatttgaaattggatttctccaaggataggtcgatgtaagcagtggagctaatcacatcattttacttcagcctcttctcacagaacttggtttattatgatcttaaaacctcctgggatatttttctagctctggatgtatctgaatgtaccaggtaaaatcaggactactgtaattcatccatttgctgtactatcttctcgttccatatagatacctttatgttgacatgacagtattagaaaaagacagctaccagagccctgcccacccatctacaaggtcaagaactattcccaccaaactattgaggccttgtatatactaggtgcttaaatgacatttgataacctggtttattgactttgaagaatactaatttagttacttatttaatattccaatgcacaccttcttcaggtaaagtgcaatgttggctattgaggaaaagataagtttgtggcttcaactatgggaatagtgttttagttcaaatcctttagtttcaaaagagataaacctttcaaactcagttaaaataatgaatgaaattaagtggaatcaaaggcaaggagtacagagaggtcattgcttctctgaacctaaacattattgtcattgtttctctgcatagctctgtgtttctgtgtcaatggccatcactacatttgattctataatatttctactgcaatcaagtcactaacataggcaaaggttaacttgttccaggtcaaaattcctaggaaaaagaatctgattcatccaacctgtgttaaaaattaatacttgatacaatcaactgctgccaatggatctggctcccgtaataaatcctcggccactaaggacagctgggtagaaatgactattatccaggaaagaggaacacacctggccaacccctttctttctgtagtacatagggtatctactttgaccagtttctgagagtagtttgcttcaactctccctcttcctctatgactgatggcagacaatctaacatttaactctacctctgtattagtcagggttctctagaaggacataactaataggatatatatatatacacatacacactcgtatatacacacacacacagatacatatatatatatatatatatatatatatgtaaaaggagtttattaagtattaactcacatgatcacaaggccccacaataggccatccacaaattgaggagcaaggacagccagtctgagtcccaaaactgaagaacttgaagtctgctgttcaagggcaggaagcatctggcataggagaaagatgaaggctgggaggctaggccactctagtagtttcacatttttctgcatgctttatattctagtaaaactagcagctgattagattgtgccaatacagatcaagggtaggtctgcctttcccagcctactgactcaaatgttgatatcctttggcaacatcctcacagacacacccaggatcagtccttttcatccttcaatccaatcaagtttacactcagtattaaccatcacaagtctacccattgtcaacttgaacccacacacatctcctgagctcatacataaccttcaaataaagacaataataaggtcataattacacctaacataatacaactatcttttgtacaactggaaacacaccaatacccaacccaaatactattacagaaagttaacaatacttaaatgctgctatgaggtcaataaattttatgtcacatgataaaggaaaaaggaaataaaatgaagatattttcttagtacaagtatatatgtgcacaaacatgtttttaaaaaaaggaaggaggaaatactcaagggaattacagtccttgtttctgcagctggtcttgggatcatagctggtattgatgactaccttcttctactgcccattctatattccctttgccttcagcaagaacctcagcaggtcatggttttgttttgttttgttttctggtggagtgacccaaacctttattcctgaagggtgtgtgccatttgtagtcctgcctggattgggctgttgtagtttcccattgaccttaatcagagggcatggtaatactaagagacgccctaatggatctcctgtattccatgcatactctcccttacctctgttgtagagtggtagatgatttcatcttgatagtctggatcaattgccccagccaacactgtaactcccttcttagcctgttgacttaaaggtaggaggagaccaaagtgtccaggtggcaatcctaacttccagtttagtgggatctgggatcgttgttgtgtatcctggtggaagtgttcctccctctggaactaagacctctagcccagcagaaggtaatattgcaggaacaggaagcaaaaattttgctagtggatcacaggggtgatggtgagtggtgccacttccacttccaccccttgattccaagacccatgaatcctggctatgggagaaacagtaccatatattggacactgattcagagcatacacgggcttctggagaactttgcccctgccctgcaaagtattgtcacctagttggcattgtaattgtgacttcaaaaggccattccacacttctatcaatccagctgcttcaggatgatggggaacatggtaagaccagtgaatttcatggtcatgagcccactgccacacttttttagccataaagtgagtgccttggtcagaggcaatgctgtgtggaataccatgacggtggataaggcattctgtgagtccatgggtggtagtcttggcagaagcattacgtgcaggataagcaaacctatatccagagtaagtttctattccagtgccctttccatgatggaagaggtctaatataatcaacttgccaccaggtagctggctgattaccctgaggaatggtgccatatcaagggcacagtgttggtctctgctgctggcaaatttggcactcagcagtggccatagccaggtcagcctttgtgagtggaagtccatgttgctgagcccacgtgtaacctccatccttgccaccatggccgctttgtttatgggcccattggacaatgacaggggggtggctggggaaagaggctgaaccgtgtctgcagaacaggtcatcctatccacttgattatttaaatcctcttctgctgaggtcacccattggtgagcactcacatgagatacaaatatcttgtttttgaccactcagagaggtccatccacatacctcgtccccaaatttctttctcaccaattttccaatcatgcttcttccaagtccctgaccatccagccaaaccattggctacagcccattaatcagtatataattacacatctggccatttctccttccattcaaagtgcacaaccagttgcattgctcaaagttctgcccatagggaagattttcctttacccttcatcattcttcaggggtgtcctacaaagcggctttagtgctgcagctgtccacttttgggtggtgcctgcatattgtcagaaccatttgtgaaccaggccctagtcttctcttcctctgtcaactgatcatggggaactccccatgaggccatcagtgcatgctgggggagaaaagccagggtggctggagtggagacagtgagtatttgaaccacttccttatgtaacttacttgttccttcagggcctgcttgagcccaatcacatatagaccacttccgtttgatgatccagtgctgctgtgcgtgacccactttatggccagatgggtcagaaagcatccaattcatgataggcaattcaggttgcatggtgacttgatgatccatagttaaatgttcagtttcaaccaaagcccagtaacaggccaagagctgtctctcaaaaggagagtagttatttgcagaacatgccttgctctaaaattctagaggcctctgctgtaattcatgtatgggggcctgccaaagattccaaacagcatccctatctgtcactgacacctcaggcaccactggatctgctgggtcatatggcccaagtggcagagcagcttgcacagcagcctggacctgttgcagagccttctcctcttctggaccccactcaaaactggcagcctctcaggtcacttgataaatgggctggagtaacccacccagatgaggaatgtgctgcctccaagatccaaatagacctactaggtgttgtgcctctttcttggtcatgggaggggctaaacgcagcacttattcaccttagaaggaagatctcaacagaccccacaccactggacccctagaaattttactgaggtagaagtccttgaattttagtcatatttgtttcccatcctcaggcatgcaaatatctcaccaataagtccaatgtgtttactacttcttactcactagatcaaatcagcataatgttatcaatgtaatggaccattgtgatgttttacagaagcaaaaagcaatcaaggtctctctgaataagattattacagaaagccggagagttgatatacccctgaggtaggacaataaaagtatattgctggccttgccagctgaaggcaaatttcttctggggtttatggacaggaatgaagaaaaaggcatttactaagtcaatggctgcataccaggtaccaggatatgtgttaatttgctcaagcaatgaaaccatatctggtacagcagctgcaattggagtcaccacttggttaagcttatgataatccactgtcattctccaacatccatctttcttctgcacaggctaaatgggagcattgaatagggatgtggtgggaattacaacccctgcatctttcaagtcctgatggtggcactaatgtcagcaacccctccagggatgtgatattgtttttcatttactatttttctaggtataagcagttctaatggcttccacttggccttttccttcatagtaaccctcaccctaccagtcagggaacaaatgtgggggttctgccagctactaagtatgtctatgctagttatgtattctggctctggggaaatgaccacagggtgagtctggggactcattggacccactgtaagtcagacctgagctaaaacactgttaattacctgacctccttaagcccctactttaaccggaggaccacaatgacgttttgggtcccctggaatcaatgtcacctcagagccagtgtcccatagtcccccaaatgtctagttatttccctttccccaatgcacagttaccccggtagaaggccagaggtctccttggggaaggatgagagaaagattccttgcataaattgttggtaatgtagtggagtccttcctcaagggggaccagcctccccttcattcaagggattctaggtctgtaaactggcttgtctggaaattgaggagctatgattctgtttttataattgaaattagacttagaagttttctgcttgtataaattaagtacgaatgccgtaggctctctatcaatttaacttctaagaacaccatgattaattagccagtgccagagctctacatgagtcaaactgttctgattgccactttacctctgctgtccattacggtagctatgcctaccttgcttttgacagttgagtgctgccacttggcccatgccaccttgggatccaattattcccattgtatttaaatttcatagttgggtgactgtggttcccactgttagatctgacatactgagaagagcaattacagggctcttcaaagatgcaggttttgccctcacaaatctattttgcaaggcattggtcaagggtatatattctagacctaaatctccctaagcctttgcatcccttcctctacattaaatcaagggagatcaggcatttccagctcactcacaatgggccatatcaatctgattatctaatgtcaagagatccgggtcccatagtaaatccttggccactaaggacagctggtagagatgactcttatcaaggaaagaggaacatacctggccaaccccattgtttctatagcacatagggtatcaactttgaccaaattctgggagtagtttgcctcacttcttcctcttcttctatacctgatggcaaacaacttaacatttaactctaaccctaggctgttaaattttcatgctagccaaaatgcttatctgcctttaacagcagcttgaatacttccccctaccctttcaaagatttatctcaggaacagtgcagggggacaaggccaaatcctgttttgtttctaagtacaggaagcctgaactgtactattatttagataccaccacttctgaactaactgcaagcaggagagtcaactatatcatttcaatgtgtttttataacacagcggcagattttagaggtgaaacttggaagagattgatctttttctacaaggaggtagagaatatgatgagaaatttctctatttgcactgcaagatatctttagtgaatctcttctctattcctcagctacaaacattttaactttttctctacagcaggttcatcacagtaaagatagtaagccaagtcctcaccttttctctggaaaatataggaagaaacaaaatagaggtcagataaaccagaaattgcatttaggaaacatacaaattgaccttgtaatgagcatgctgtgtagtttttttcccactatgttttctttcttaaaatcaaatctaaataatacagccatcatgtctagttaatagttgtgccattggctgggtgcagtggctcacactggtaatcctagcactttgagagaccgaagtgtgcagatcgcctgaggtcaggagtttgagaccagcctggccaacatgttgaaaccccatctctactaaaaacacaaaaattagccaacagtggtggtgtacacctttaatcccagctacttgggaagccgagagaggagaattgcttgaatccaggaggcagaggttgcagcaagtcgagattgtgccagtgcagtgcagcctggacaacagagggagactccatctcaacaataacagcaataacaacaaaaacataattgtgcccttagggggactaaaacataaagttattgaggggaaaatgtcacatcacaagcttcccttgttttacaaggacttgaggttaagtaatttcttccttccttatggttgtaaaatattgacttcagaagttgtcaaattagcctggcatggtccttgttacaagtaaataggttccttctgtggaggcactagcaatcaactttcccaaggatgaggtgctgatatcccaaggcttgcctttctccctattgaatttatctatttgtgcacctgtacacttaggcagacaatgtaatacatctatttatcgctaccaccagcgtatctgtctaaagctataactgaaggcatgtgttctcataaaagaagagaggcacattagtctagtttgatgcagcagtcacaggctttatgtagtgacttatctggagataagagtcttgactgttgttagacaccaccgaaagtcattactttgtgactgcaaggaggatgacaactcaactgagtgaaacttccagcaggttgtgcattagaacttagaacaacaaaagtgagagaagtgggggtcctggatttctattgattacaaaataagctgtttatcatcataatataagctccttatgaccagtgactaggaatttatttaatattatgcacagaagttttttaaaaacagaacattgtatgtgataaatttttgccagcaaatagatgggtgcatgcatggatggatgaatggatgcacgaatgaatggatggatggatggatggatggatggatggatggatggatggatgaatggatggatgcacaaatggatgaacgaatgcatggatggatgaatggatgaatgaatggatggatggatggatggatggatggatggatggatggatgggttcatggatgcatgaatgaatggatagatgcatgaatgaatagatggatgcatggatggatggatgcacaaatggatgaatgaatgcatggatgggtggatgggtggatgaatggatggatggatggttggatggatggatggatggatggatggatgcatagatgcacaaatggatgaatgaatgaatgcatgaatggatggatggatgggtggatggatggatggatgcatggatgcacaaatggatgaatgaatgaatgcatgaatggatggatgagtggatggatggatgcatggatggatgaatgaatggatggatgagccagactacttactttcagagttttcacgaataatataggatgctaggttactaaagttattacaaatgtgtgatttttaaggaatctacaatcagaatgatgcctacttctctggctgcttcttgtaacctccacgccttgcccacagagttctagtcacaccatagttctttctgttcttcatgcctgtttagcaccagggccgttgcacaggctgttcctcaggcccaaaagcttttctttatgatctccacatatctctttctttcctgatattcaggattcacctcacgtgttctatcactaggagtgattcttttaaccactcagtctgaagtagtgaccagattgttctccatcatggttcaatttcaattctctcctcaacatttattgtgcctttatgtatttatttgatagttttattttttctttacatttgtggctttatttatctttcattctccaataacgtttgagcttcacgattatttcccagcttatttagcactatatcctctgcatacacatccagttatagactgaatgaatggaagggaggaaaaaatcaaacattctcccataggtttaattactaaaaattccctaaattatatgcacccataaaacatttaaaacagtgtaaatttatacaaattagatatatactttgaagtgatcaaatttcctactttaaaaaggtggttgtgttgacctgtttatctgtcagccttggaaatatatcaaaggttaaataaatataatcatgttatattcttaaatcttttcggaatgaagtgaggtataaacacatgtgtgcttttatatatataaacacacatgtatatatacatgcacatatttctataattcagggatttgttggttcagactaagaactcttagttcctagttctttgctctatgatgatttagaaacctggaattttttaaactgaaagggctaatgtcttttcgtgcagtggttttcactggaggcagtaagatcatctaccgttgcacttggcattttgtgacatgtgttagttattataataaatgggagcactaaaaggcatttggtggccaggggctaggtttgctatatatctcaatgcatggaaaagccttatacctgaagaaagctttcatatctcccacaactttcaaaaatctgttcacaatcacccgagccttatacataattctgctttacttttaaacacaaagtattttgcactcagacctgccaactaaactctagccccaggtactaagctttcaaataggaactgtggcttattacattttactccctttttcctgaaaattcattaaaattcagttacgaagtctgtctttaacaatatcaaatggagcctttaaacgatgaccacaatgtatagtcctttcaaggaggaatgtctttgcccatcacatatctttctgaatttctagaagtctgttaaataaaaaggaacaaatccagacttaggtaaggagatattttgttcggaaagacttttatagtgagaggaaaaggactattgcaatacagagaatactctgaccataagatctgcaaacatctcaaaggacaggcagaaagggctcctcttttacaggaaggagtaaacaaagctagaaggagctgtctgtgggagtgtgaagaccagatggtgtggtagaacaactgattggggaatgtttctcctaggtgtcagtggactcttgagaggggccttaaaggatgagctcttctatattctgatgcttggttaaagtcaagggagagtcaaactccaggtgtctgtggagtgggaaaaccctaacaaaattttggtccagacaagtcagcagatacttttcccagattgattaaattgtataaactcagtaaatcaaaggatgatttcattttccttccacaagatcacagtaaggtttgtttgccgtttggggaagtcgcattcctaatggtcgcagtgcttgtggtatatgagcagtcagtacaaccacttgtatcatctgcatttgtggttaccaaattcgtgataattctggaagaaccaatgcaaacaggtgacgactgtgttttatcttttagtgtactaaagcagttggagaatatttcatttttaattgacttccttttgtttctccgttatattaatttaaggccttatatcagttttccacttccctagattatgtgtagagctagacaacatggctgtaaatgtaatttcaggaaaataaaggtggcattatgaaatatttgttctcaaaaagggctgtaggtcctttaaaactgcaattcctattccactgccagattattatttatgtataatgactctgaaactaacagaagttgagaaatttgcccaaagccacagagaatattaatacaattacacacatacatactcttaaattgttaaaaaatgttgacatgacaagcatggggctaggaatgcagatgaataaaaatgcctttttctgtccagtaaaaaaataacttctacacagaaatgataaaaactcaattaagaagtgactggtttagcaagcaaaaagtcctagaaaatgttatttctgataagtacattaatacaaacttttcattgctggaaactttcttgctatatttaagacatgtgaaaaagcaaaaaacaaaaacgtctagaaatctatttcttaatctgcaaaatggggataaaaatatgtacctcatagcattgtgtgactcaaacaaggtaagtgatgtgatccatgatttccaaacattaatgttcttataaattacctggaaattttgttaaaatgtagaatctgatttttaagtttctgtgggaattagaattctgcattttgaacaaaatcttcagtagttaccaataatactggttagagataattttgaatgggaaagatggaaaccccttggcacattggaaggggccagttttggttggaggtccttggcttccactcttgtactagctctttttgaagaggcattggctgtttccccacagatctcacttgcttcttttatttttagatcactcccatttcactcatttataggttttaagaatgaggggagtgattagatgaagactgtttgagggactggtaattaatactcaaaaataaatttttgaatatgcttctttcttcttcctattaaaagcataatgttctggtactttgtccacgtttaaagcagcctttctggattaatatagctactaatagaaaggggagaaaagttgctatggttagaatacatgtgttcctctgaaattcctgtgttgaagcttaaccttcacagtgatggtattaagaggtggggcctttgagtggtaattaggtcatgttgtaattaggtcatgagggctctgccttattgtagagagaggagaaggactattgcaatacagtgaatactctgaccataacatctgcaagcatctcaaagggcaggcagaaagggctcctcttttataggaaggagtaaacaaagctagaaggagctggctgtgggagtctctctctctctctctctctctctctctctatctccagacagacagatagatagatagatagatagatagatagatagatagatagacagacagacagacagacagacagacagacggatagatagatatagagagagtctcacatctcactctgtcacccagcaggctgagatgcaatggtgcaatcgttgttcactgtaacctgaaattcgtgagctcaaatgatcctcccacctcagcctcctaagtagctattttttattttttttttttagggttggggtctccctgtgttacccaggctggtttcaatctcctggtctcaagtgattctccaaccttgcccttcaaaaatgctgggattacagtcatgaaccaccatcctgagtgtttaaatacgcttctaaaagaggcttcatagaactgcctgtcccttccatctcctctgccatgtttttacaagattcatcctcttttgcccatctgccttccaccatctgatgagatgcaaccaagtgccaccttggaagcagaaagtgagccttcatcaaatatggaaaatattggcatcttgatattagacttcccagggtctagaactggagacataattttctttgcttataaactaccctgtctaaagtattttgttacagcagcaggaatagaataagatataggtattattattatattcttctggagtgacattcttattactcatatataaatattcatatctacttatctaaaacaatcacatttcttattttacaaaatagttttacagttcctcaactgggatacaaaaagcccacttttttagtgagaaaaaatgataaaatgaaatacaaaacagttctactagcctcaatattctacagatgcttcttcaatggacctaagaatggtaaacagatttttttaaagacatccaaatctaagacaccttgtatttttcagttttaccaatagatgacactagtgatacacacgcacgcacgcacacacacacacacacacacacacacacgtatataataacattccaagaaaattcttcaagtctgcagtcttggggataaaagcccaaggtaaagaaaccggtaacaccgagttgttaacatactaacattgtttttatagagtttttttattattttcatagaatttgcaaaagcatcttcaaagacagtttttgtggcagatgactgagcatctaaattatttttatcaacacacaattataacactaatcctgaaataagaaaaaatcagagggacttcatgaaaggaatatgtgaatatatatttcatcttgtaaaaattggttgcttattccttcatctataaaaccatgtggtctgaatatattgtttctcaggccctggatggagtaccaagaatgcagcctagtaaggcaagacactgcctaaaaagatggtcaaattatctagaaaaattagtaatgtaatcacactgtccaaagtccccatgacatgggagtttcaagggttgtcatgccttccagatgtgagggaccatagtttgtaacctgcaaaacaatattattgtgagtggtgcttttctttaaatgacgtctctaaaagcgattcacattcttgataccactttggaattggagatatttcatttagagcccttgaaatctgagtactagtgtgcatattttattcctgccttttctcttgttactatatgcacctaaaccgagtatttttatcataggttttttggttgtttgcttgttgttttttttttttttttttttttttttggtagagattgggatttctccatgttgcctaagctggtctagaactcctggactcaagcaatccacccatcttggcttcacacagtgctgggattacaggtgtgaaccaccatgcccagccaatttttatcataattttaaattggcaactaaccagatgctttatgttacccccccatcatcccctacaaatgactccatgtcagacacagacattaatcggtttatggagttaaatttacaaaaaggaaataggaaaaagcgacaggtgcatggcattacgtgctgtgatgtgtattaaaagagagatctcacagattgaaaggagatgtaaataccagcaggacatatttttcaaaggacacattcagaagaatcccatataaggttgcctgtcaaaggaagccattccattttaactgaatatttaagaattttatagtgacataggtttcatttggttcatatgtgatatattttattagtaaaatatatagtgcatgattatcactacccagatatgaagcaaaagttgcataaatcattgtaatttttgatgaaacaaaagaatatttcgtaatgctaatcgttattttattttttcaaaaatttgtaaaagtgagaggctaatgggaagcctaaccattggcaatgaaataaattccattttgattttcttttttaataaatattgctgcacattcctttccaggatcaagttaaactccttgctaattctttcattgaacaaaataatcgtaaagaaaactcataacatattccgatttcagcatccgtgggtattagtagtcacatgatctacctttagagacagaaagttgaaatctgatttttttaaaaaaagtaagtgcagtggcttaagtgattctatgcttttagacagtattgtcttcaataattaatttgtatagataaatgtagcgtagcatctttacatattattaaaatattgttttgagattgtcatggcaatatacatgcacaaaatatgtagactggaacaacaacacaaggtactcagtaacatcattaaatgaaaaataaggtttttggttatgtacatcctggttctactctttttaaaaaaacttaaattaattcattaagaaatatttattacagagaaaatgatatatattcaaatatgtatttatatgtattcacatatataatacataagatatatataagctatgaaacacattaattaaaataaccatcactaccctacttaacaaaaaccatatattgcagtcttagataaagttgaaaaaaattattggtaaaagtttctaagtaaatctactaacataaataattaggccttttaatttttaattatcaaaaactatatttttctttattttatttaagggtaaagattctcacagcacacatgcacaaccatgatatatatcatctaagaacttatttctgtatatggttgggcagtaagcaattctatagatgtatacacctatataacctatattaaaatatggaacatttccaacttcataaaaagttccctagggttccatttcagtcaatatacaccaagatccaaacaaaactgatcaatattccaccaatgtagcttacttatgcctgttgagaactcaatataaataggattatacaatatagactcttgtgatattgtgatataataagtaagttatatttggtctctgctcttgcttcctgacacactgcttcgaaaacccttagagagtgtcttttgtatgccaatgagctgactgttggccagggttcctgagatagcttcaggatgggggctgttcaccagaaagacggaggcatgattagagagttgagactttcaggcctaccccgcaacctccgtgaaggagagagaggctgaagatcggttgagttcatcacctatggccagggatgtaatcaattatgtctacatgataaagtcttcataaatgtccaaaaagacaagagtgtggagagctttcaggttgctgaacatgcagaggctcctggggggtggtgcaccaggagagggtatggaatcttcagctcctttcctatacctcaccctatgtatctcttccatctggctgttcatttgtatcttttctaatacactttgtaaaaaatggataaatgtaagtgtttccctgagttctgtgagccatcctagcaaattcacagacaccaaggaaggagaaaattcactggacctgcgatctgtagacagtcagaagaatgggtgacagaccattacaatagtcccttgatgtcttccaagatgccttgtgcataccaaaatccacagatgataaagcccacaattggccctgcaaaattcccagaaacaaaacgtcagccccttgcatccctctaattctgtattttttgatcctcagttatttatccaagaatatggaacactcagattctgagggcagattgtacatgtgattggtgtctgaagagagggaatcttgtgggactaagcccttaacccatgggatctgactctgacttcataaagttacttcagttctgacatgatagtggtagaattgaaatgaattattggacacttagtgtccactagagagttagttgttagtggggagaaatccatacacattttggtgagcagaagtgaactattctgtgttgagctgtgagttgtgtgtattagagtcaaaaacagtttgatgtttcccatcttttccaatggttccttttctagctcagactctcctctgtgtccaacttcactcacattatataaagtctgtgaggttttttccttctgtatgtatagcaactgtttgttccttttcatagttgagtagtatgaatatgtaatttctggtgtggagctattatgaataaagctactgttgaacctctgtgtataagtctttaaatggacatgtgttttcatttgtcttgggtaaattcttaggtgtgaaatttctgaatcctataagtgatgcgtgtttaagaaactgccaaactgtttatcaaagaccttccaccattttatgaacccctcagcaatgtgtgagagctgcagttagtctgctccaggcagtcatcaactattaccagttgactccactcccacattctactgagtgtgaaatcatatcttattgtagttttaatttgaattttcttgatgattgctgatattgagtgtctttccatgtgtttgttttcatgtttatattagttacaaaaggccattaaataattcagatacaaataaatattttgtcagaaatgttacaaatatttctttttagtatgggggatgactttagaatttcttggtgtcctttgagattagaagactttcattctcttggaggccagttttttttttttttttttaatgtttcaagcttttgtgtgtactatctttgaaaactcataacaatattttcttatatttctgtctctggaatttttataattttaccttttatgcttatatctataattcatttcaaattacttttcacgcatgatgttagtaggggttgtagtgaattgaattgtggcctcaaaaagtcctatccccagtacctgtgaatgtgacattatttggaatagggtctttgtagatataattaaggatcctgtgattagatgatcttagatttagggtgggctctaaatccaatgactggggtcactataagaaaatagagatggtgatttgagacacggacacaggcgaaggtcatgtgaaggctgagacagaaattggaattatgccttttcaagccaaggaatgtcagggttcacaagcagataccagtagctgggaaagaagtatggcatggattctccttcagagcctccaaaagaacgaaatctaccaacaccttgatttcagattttaggcccctggaactgtgagaacataactttttgccattttagaccaccagtttgtggtaatctgttgcagctagcacgcggggcgggggtgggggtggggtgtcaaggtttttttattttcacagatggcataatacagttgttctagaacacatatcgaaaagattgccatttcattgttaattattttgatgcctttgtcaaaaatcaaagtgcaggtcattcctagacttgctgattctgttccattgatctattttttgcaccaatgctatgctgtactttacattttcctgtatgtcaattctctactgtcttgataacagtagctgtataacatcttttgagatcagataagatagatctttcaagtttgttcttccttttcagatatgattttgctattctcagtgttttgtatttctatatgaatttgggaattgaattgtcaatttctacatttttttgtagaaattggactaggattttgatttaaattggttcatgtttataggtcaattggtagaaaatagatattttaaaaacattgaatcttttgaatcatgaatatagtataaatgcccatgtttttgaggttctatttttgtaaaattttcaactgcgttttccagtttttctgtacagttattgcatagcttttgccaaactgatttatgattattttatattttatattatggtaagtggtattttaaaaatttatttttttcaattatgttagtgctagcatataaaaatacagttaatatttatatatttaccatgcatcctatgactcgccaagtttatttcttagttccagcaagaaatttttgtacctatgtcaagattttataatgtggaatatcacataatctcagactaaagagttttagcagttctttttttatctctattaatttatttgcctttttggcttattgcactgaatatgatctgtagtaccatatagtataaaattagtgagaacaaatattttttatctagttttctcatattaagaaaaaaagcactcagtcttcaatcatcatgtcatgtcagctgtaattctttgaaatatgtactttatcaggctgaagatgtttacttttcttcatagtttgctaggaattttcatcataaattggtgttgactttctaactgctttttctgcatctattaagataatcataaaatgtgtatcctttgtccctgagatttaatagattttattggttgattttttaaaaacatattgaaccaaatttgtattcctttaataagcaccccttcagtcaagacgcattttccctttgtattttattgaatttaatttcctaatatcgcattgaaaatgtttgtgttcatatgggatactgaatagtaatcatatttttttcttttattgatatgtcatactagtacatattttgatggtatgtgtggtagtacatgtaggcaatgtgtaataatcagcttttaatatcagggaacttccagcctcacagcatttgttggaaagagtttcctcttctgttttctaaaatagtttgtgtaagattggtataaattctttatttaatgtttaatggattcttcaatgaaagaacgagtctggtgtttttctcataagaagccattccttttcttttttgtacttactaagttactaaacttttttattttatctaacgtttccaatttttgggatatatttcctcatgattttattttatgttcatattgatatttgtaggttttatagaaatatgctcattttatttctgatattgtcaatttgtgttttctctctttttattactcctgtttggaataataagttatcaatattatagatcaatactattggtcttatatcaatattgatataaaattgattattgatcttttcaacaaactaacatttgccttattaattttttctatagtttatttttttgttttgctattgttatttttgtttatttctgtttgtttacttttgctaaaagtacttttcagcttctgtaggtaaatacttaaatcattaattttaaatatctttttctagtattgatactttaaaaatctatattttatatttaaactgtaccacttttggataatgtataattggatctgctttacttctatctagcctatcaatttctgtctattaattgggactgtttagtttatttacactgaatataatgattgatctcattggtttaagtggacgagcttactacttgttttccatttgaccctttggtgtcttcttctcttttgcatcttttttgctttcccttgggttattctttattttagcattctatttcacttccttattgacttcgcagctatatctctttatgtttttaattggctctctatggtaaacgatatgcagccttaacttgtcggaatctgttaccccttcactcttcacatgatctgagaagcctaaggaggtttggcccagcacagggatagcccagtcctaaaccagagtctcctaccgtgaacttaagaatccctgtccattttgctcagctctcttctctcctgggttctgtcctgcagattcaagccacttcagctgcctaaactctcgtgcctgccccatcaggtcagtggaacactccagctatgcttggattccagttctctcagatgtgatcataaaattatgctcaggtagcagtgggttttcagagtgctcaccttgtcaggttcccttctcagtcatcacagtttgtgctgcatgttgaccactgcctgaattcaactgcttcatgtattttgtcaagttacaaacttttatgtggtcaatgggctagtctggtaccagttattaagttatgaccagaagtagaagtcttattagaatgtactgttttgaaaaggaaaaataccgacatgtacagcaagagcaaacttggggttggagaaagattaccgtataattataaagatcaacaattgaaaggaatttgtgtggggaggcaccacaaaaagtaacatgatttataagcagacatgtttttgtgtctcatttttcatacgtatctgtaatgtaagatggagttaaaaatcacagtcttttgagttacacaaaaacggatttgaatcacttttgcctcatataagttagatgaatatttctctctcaaatatcaatttacccatctatgaagttgaaatatttatattacctatcacaaaccttgttttgatggtcattgaaagtaattaaagtaagttatgtaatgaatctgaatgtaatgaagttatggaatgaataaaattatgtaatgaatctcaataaatgtaagttattatctttatcatctgcagtagaattattattattactgccttatcattaaggcattcttaaatactttgttacaattagatggttaataatataaaagttagttttttacaaacttaaagtaaattcttactgaagaactaggtttatatgtgggggtgtgtgtgtgtgttaactcaaaatatgcaatacccacacactaaatatacacagtcctttgagtcaatacataaatttaggtacagcataggtccaactctactctatgttctttaacttgacatttaacttgacatatgctgagtatagctttgacccacaaacgtaacattatttagatgtattttaggataagaatgtaaatgtgagtcatcatttggttatgactttatttttagttaattcttaactaaaattttaacaagtttcagaaagacattgcagtctgagtttgacctacagatcaatccgataaagatcaaatttgagcaggactttttctttccccaatttgtctgtctctagaatggttatctatgtaatacaagagaattcttagctgcactcacccaataaaataaaaattctacattaccagcagataattaatttctgttttaagatttctgggtgaataattcattattatgttcagcaacccaaatagtgacaagttaaaactttactcagtaaggacaataaaggagatagtacccattcttgtctgtcacattggtctagttggaaatagaagagctgacatcagaggcctttatagtctcagatagtaggtattatacaaaattctgatcacttccatataagattgaaatggaaatagttggaaaacagctgttttatcttgtcagatcctttaatgggacttaaggttcacactagcagaacccaagaatatttgcaagaaattgctaagtaatgaaaatttatcctgcagttccaaccagaaatgaaagtatcatgtcagtgcaattcccatcagatggtctttagataaagaatctgggcttttaacttcatttaatgaaaaaaaccttggtaatcagtcttgtagtgtaatggaacttttatctcactgtgtaagtaaattatggatggagttatacacccaggaggtgacctacatagtatactcaaaaggcaaaattaagaatggtattcgaccttgaaccaaatttcacacctgtactgaaaaattaggggtaagcttggtaaagtgctgaatgcaaacatctcccagacaagccaaagtattttattccccaaacattcctcctggatgtggatccttactaaatctcaactttaggagttcttctcttggttgggcacagtggctcaggcctgtaatcccaacactttgggagaccaaggcaggaggatcgcttgagcccaggaattcaagatgagcctgcacaatgtgacgaaaccccatctctactaaaaaaaaaaaaaatacaaaaagttagctgagcatggtggtgcttacctgtggtcccagctacactcagtcccaggctgagttgggaggatcacctgagccataggaggcagaggctgcagtgagccaagatgaccctactactgcactccagcctgggcatcagagcaaaaccctgccaaaaaaaaaaaaaaaaaaaaaaaaagacaatttttctctctttgttttctttgttttttagagaataaatctgaaactgcttgaaatgtgttaatctgcacctttggttgagaccatgaccttcggcattagaaagacaatagttcaaacatcagcttagatattactatatttgtgactctggatgatttacatacaacttttgaacctcaattatcttatatgcaaaatgggactagaacttgcctggcagagttaatttggtaaatcagtaaaataatttaaaagaaatgatattactatgcttaacacattttaaatactcaaaagtagctataattattatggatgttatgtatttcaaatgtgtaaagttttaagcaaggtactaaacctatggcccccttttcctatagttaaagtgggggttatttaaaggaaaagaaatcattatattgaagatacctgcactggtatgtctgtcacagcattattcacaatagcaaagatatagaatcaacttaagtgtccatcaacatgattggataaagaaaatgtgatatatatctatatatataggcaatgtataatatagacatatatctcatatatatataccttcaaatatatacatctacatatgccatcaaatatatacatatatataccatcaaatatatacatatatatatatataccatcaaatatatacatatatatatatagacacacacaccatggacataaaaatgaatgaaatcatatcttctgcagcaacatggatggaactggaggccattatcttaagtaaaataacttagaaacaaagagttaaatactgcatgttcttacttgtaagtgggagctaaatactgtgtacacatggatatagagagtagaataatagacactggagactcaggaaagtgggaggaggggagggagtgaggaatgagacattacctatttgatacaatgtactctattcaggtaacggttacattaacagcccagatttcaccagtaggcaatgtactcatgtaacaaaactgtacttgcatccattaaatctataaaaataaataagtcataaagtgaggatattataactatattataaagttgttgtaaaaattaaacaagttattgcatgccacgtgagggaaacagtgcttgccattttgtaagtgttccataaatgttagcttttatttcaagtgagaatatcagatagtgtttaagaagaacaccagctggctgtggaaccttcctgccaggaatttaatactagctttctcagttacttaacctctctgtgcttcagtttcctcatctgtaaaatttgtgtttcaataatagcatttcccaaacaaactacttgggaggattaagtgggctaatacatataataaactcagaatagcacctggcacatgtaaatgcatgataaatggttttgtgcttttgtatgtgagtatatgctattttttccaaaaaacaaaatagagaaaattataaagactcatataacaagcatccatatgctcagtactaaaaagtaacaagtgctaacatgttgtatcattctaacaatataaaaatatttcaatagcctttttattctgaagtgaaatattgagagttttttcctttttttctgtaacgctgccacactgaattttaaaatgcaaagtactagatattagtaaagaccatgcgtcctcgaaatcagatttcttaagtttgaattagtaaagaccatgtgtccttgaaatcagatttcttaagtttgaattctagttccactacttagtacctatgaaatcctagctgtttcctaaacttcttttatcatgctttctcaccggtaaagtgctggtgatacgttctttgcaggtttgttacaaatgaaaataaaagtaggaaaaattctcagcacagagctttgccatgtagtaagtgctcatttcactggaaaataaattcctgaaatattttcataaagtcataggagtaaaatgggatttgaaaagccagctaatctactccctttttaatgcaatttttacatctttaaatttatgaagatctcactggtatatttaatctccttgaatagtgattttttttggactattggttttaacattttcataggatgtaaagttattttaattagttgcgatcagaattaaaagatactctatttcaatttaagctctacaagggcagggttttgcttatttcgttatgtatatatgtatacgcacacacacacacacacacacacacacacacacacacacacacaatctcaagtgccacatggtagatgctcaaatattttctgagtgttaaatgaataaatgaataagaataggattgattcaaatggttatttttaactacataaatttcaaatatttgtttgaataaatatataaatgttgtatttccttctgacctgaaccccatcatatagtctatatgatttacgcatatagactataatagctaacatttatttagcatttactacatgctaagtactatcctcagcactttgccagtattagctcatttactcctcatcccagtcctgtgaggaggccattattagcctattttaaaaatggaagctgagatacaaagaactaagtaattctctcaggactaaatagccaataaatgtgaaagcatttcacaaattcagctgcaaaccttggcagtaaagcatttgcttctggctagagtccatgtcagcccctgtttgtatttaacagacaaagaagaagatactttaacaatgaatcattcttgtgagaaaaaaaaaaaaatggtggtggtagattcagttctaaaatctcaccagatgacacaatcttctacctcgtgaaatactgcagaacttaaaaagagaaaagaaaagaagacctctttcctcctacagggtaagaggattggaaaatcacttgcacttttctctttatcacttctgttgacttggaatgcaaactttcaaaaagtaacatgtgtggtgtagtgtgatttttaactaaggttggatttcagtttcactaaagagccagaaatagatagaacagaccaactaagccctgctttgttttcctaaaaatctttccttaaatataaaactgtccctggacctgctaccatctttctatgctacaccagagttcatttcaccttactctgggccaccttttaaaatgtctattaacggtcttgttttattgacacatctctgctgtctacctcgctggttcaagaagttctcaagaatggattgttttctcaatcagttttatcctagtgcttagcacagcccagaacttcttgagcattccacaaatattagtttaaccagtgaaagaaggatgacaatggtttaagaaaaagggatactgtctatactcccaacaggcacactgtactgtgggctgacaatcagaggaaaatgtgttcttctttagctataggtttaagctcttaaatgaataacaaatcaagaccttcacccacactaaagaaggcaatttcattattattattaagatgcttaacacattgttgattgttgacacttgattgaggtattctttacttgagatggccattgaagcctctaaggttgaaaactgctaaactgtgaagggaaacacaaaagataaaggtctgcattttctttgatctagtcagggtgtctgattgcaatttactctctttaaaaattttattggattgaaccttaactgagaaaagagcgataggagagagactaatattttagacattttcatattaatttagagaagtaaggcaacaatagggctgcacccacagacctttattcagttttgaatctaaattacttggggataccaatccttcttcattgtgcagctacatgcacccacacaacatatacagaaatacatattcccccctttctctctctttattcccaattgtatgttcctttaatatgctgtacttagatttttattcatatgttgtttcttctttgccagaaaagaatgcagagcctcccaagggtaagaaatactttgtttgcgtatctgtcatatacattctcagcactttcacccacttgggtttcctgtcataagcttttctttagattgagcaactaaagctcagataaatcagaagaattgcctcaaagatgcacagatcatatgttttattgttggaccccatacgagggactatcatagggtttagtgctggaccccatacaagggactatcatagggtttgttatctgtgtgaaatgagagtacatatctgtgtgaatttgatcgggttacatgcatagaatcaagttgtgtttacctatatgcctattaaacccattccagtgtaggtttcaattgagtattgagtagtgaaatctaaagaagatgcatgtgttattttctggtggaataattttattttccctttgtagattggcaaaaaaaaatgatgagaacagcttaaattttgttttggggaaaatcttttaacaaaaagttgttgtcatgaattttgttgctttatgtatctatatatctatatctatatctatatctattacttcttcaaggtcctttagggactcaaccatttttcaataacagatttttagcagtaaagttgcatatattccctatatcatcccttccatgaaaggaagtggatcctaaacaacttgggttgtaggaatgataaatccctaatgtttatgtgactcagcaggtaggggataaaggcttaatttttgaaggtatattaaggtaagtaattagggaaccattatgtgctagaacagtatatctccaaagacaatctacttctacttagctttactgacctgcccagtaaattccacagaagctgatggcgtaatccaaatccagcctattccaagaaacacatttagatataattttagttagagtcattgttgagtttgaaagagatgaacacatttcccttcatcttgaaatgttcccttttggaaaatctaattctccccaagaaaatgattggatacctaaatcatctttgaaaagtaaaatctttccctagatcttatctcatcttttaaagctcatgtgtttgtctctgacaatgctataaatgcattttcaagagaggaatttgtcctactctttaaattacttttatgaatagtcaaagtgattttcctttagtgttcaaacttcctgcagatgattagtccacacttccagaaaccaaaatatataaagacttcttcctaaattagtcatataactttatattgggcaataagtgaatactgtgcaattttgctttgtcagtaatctgacaaatactgaaaaatactgatgtatatcaagattcaacttctgagtgcccagtggctttctaaactgatcagttaaaaagttttgtcagacgcctgtagtcccagccactctggaggctgaggcaggagaagggagtgaacccgggaggcggagcttgcaatgagctgagatggcgccactgcactccagcctgggccacagagggagactccgtctcaaaaataaaaaaattaaaaaaaatttttaaaaaagttttgtcatccaatgacaacaagtttaaaaatattttaagagaagtatgaataagtaaatactgtatcagattgattataaattatagaaaagttaaaataggtcagatttttcattcttcgttttcatagtttgagattcttagattattaaaatagaaaggaactggttttctaaaggaactggattcaaagtcacttctatcttatgaacccattgtatacatgacatctgatgaagaagaccaatatgaaaagcaggggagagtctctggttgaatcagaaagctcctggccaccacaaaacttgtaacttgctccttgtcctggtggctcaagaagtttgtgaggtatagtttgaaaactactgatctagtcaaacagtactttatagagggataaaaaaaaaattctggagatgtggcatgaactgaattatttacgatcacacatagaagtgaaggcaaaatttaaaatggaaatcagcacacctttaaaacagccttctccatggaaacatccctgagaaattttcacccttactgatcattttgtcttcccatcttctcagcaaacacatcatttattggctatgtccacagtaacaatgtaatttgtgaaatgtttcaggtcagtgaagtaatctgggagaattgaaaatgctttgagggtagaactacatagcacagctttttgagtcccatagagtgcttttggtctatataaacaaacaatggataaaaggaagataagaccaacaatacagtattatacagtattgctttggaggcaatatatagcacagaacacttttatacagaacgtgacaagtgtttcaaaggaaaggatttcatgcaaaagtaaacttgataaagtctgcactaaacaaagttaaacagtaatgattgcctcctctgagttttgaatatgctaatgtatattaagaatctgcaataatgggaatttttcgaattttccatagagccttaaaaatatgatagatattgcatgcctcaagttcatggtctgcagaatatatttagtaaaatttaagaaaggaacaagactagaagtcagaagtttgatgttttgaactcaaaccctgtgccacaaaaactttggaaagcaacttctctgatcatcagtctcttcatccataaaatagcattgcctatctgagagttaaatatcaaagaagattaatataaaaggctttgcaaaaagttaagctccactgaaacataaagcatgtttattgtgttgtaagtttacaaatataactttactgattgacttgaatagaggcacaaacagcatcccttcaacaacattttcagaataaaacaatgatatttctagacaatagtgtctcaaataaaaaaccaaagttttattcaaataacttgcaattatgatagatatttttcaattttatttagtagccaggaatttgaatgttaattactttatcgtgaacttatttcttccatgaagaagctaattgaaaaattaccaaattctgtatttttgtaaacataacaaaaagatacattgagtaaatattttaaatctactcaagttacttgaagatttttctttatgagaggttacaaaaattaaacaaattcacatttctaacaaagaacaacatattctctctacaaatatatacattgtataatgtaatactaagtctaaaaagatttgcaaggcatggtggctcacacctgtaatcccagcactttgggagggcaaggtaggaggattgcttgaggccaggagttcaagaccagcctgggaaacacaacgagaccctgtatctgccaaaaaaaaaaaaaaaattgaccagccataatggcaatggcctggggttccagctactcaggaggctgaggtgggaggattgcttgaaccccagagtttgaggctgcagtgagctatgatcacgccactgcactccagcgtggaaaaaacagtaagaccctgtctcaaaaaaaaaaaaaaaaaaaaaaaaaaaaccctaggaagataaatttaagctactggttatttttaaaataattagtcacaatatttttctaaggaaataaagctcttttgaaacaactaatattctgatttactctaatttgccttgcccatgtcatcaaaacacttttgttatagaaggactacaaaaggctctcataactaatagtcttattagaaatgttttaatgcatagaagtagtcatttaaaggaaaatgaagacttttatgccaaaagaatgttgaattgatataaatggaaaaagtagaacaaggtttccctgtatttacatttggataaaatcaaagaagaatataagttccatgagggcatgcattctatctacttagtttactactgaatctcagagcccagaaaaatatttgaaatatgcaaggtgctttacacaaatacttgttcataagatccaggattgacagtgccctggtgcctgacggtggcaaacaaatatcctttctggaaaaagataacattgtccaagttttcaaattatttctacaaaccctatttcaatatttcctacacataataaaatacatccaggcagataaataaattgcaacacaagcgacaggagacacagaagcacaggtactacagataactggaaataaaaaaataacagataaatttgcaaatttgtaatgaactctcaactcagaattatatagtcaattaaaatattgttcaataaccaggttaaataaataaaatgtaatatagcaggtctaaaaaataaccaaataaaatcctataatagataaaataatctaaaccatttaatagatgttatagtggaaaagctagatttactgaaacagtatttggttaaaacaagtaatatgctgagagatatgttagaagaaactatccagaattaagacagtcaaaaggacacaatatagaaatctgagtagaaaacaataagagaggatgagaaggtctaatagaagagtcatgaatggaaagaataagaagaattaggcaaagcaatattcaataaatgttatgatctgaatgtgtccctccaaaattcatgttacaacctaagacccaatgtggtaatattaagaggtggggtcctttggaaagtgattaagtcatggtggctctgctctcgtaaacggtattagtgccctggtcaaagggcttgaggatacagcgtctgtcccttccaccatgtgaggatgggatgctggggtaagtcaccatctatggagtagagagtgagatcttaccagataatgaatctgctggcgcttagttctcggtcttcccagtctccagaactgtgagaaataaatttctattatttataaattacctggtctagggtattttgttacagcagcatggacagactaagacaatgaggttgatccttgcccaaaagaagtagaatgcataaatccacaggatcaataggcctaacaaatatggagcagtataaatggaagttagcacctagtcatattgtagcaaaatgtcagaaaaacaaatagaaacgtaaaattataaatgcactaagaaaaaaaaaagaaaataacaggatgccttcaaaggagccccaattagaatggcaataaacttctttaaaataataataaaaaacagaaaacaggcccgacacgatggctcacacctgtaatcccatcattttgggaggccaaggtgggcaggccacttgaggtcaggagttcaagaccatcctggcctatgcagtgaagccctgtctttaccaaacatatacaacattagccaggtgtgatggcatacctttgtaattccagctactcaggaggctgagagaggagaatcacttgaaccctggaggcactggttacagtgagctgagattgtgccactgcattccagcctgggtgacaaaaaaaccaaagcaacaacaaccaaaaaaacagaaaacactggaataatatcaatgcactgcaaaaaaacagaattagataatattcaatgaaaatattattcagtaatattgtttaataattttattatttaataataataattgtttaataatcaacgtgaaataaagacatctttcaaaatcaaaaattgagagaatttaccagcaaaaccccctgagtcaggttacattttccaattattgttttttaaaagtgtgactggcactgcacctgctcagaaataggatctatgttgtctcccctggaatctgaatgggctctgtgactcctcttataaataagtatggaagaggtaatactttgagacttctacaataaggtcacaaagattattctcttctctctgtctctgtctctctttcttgctttcttgaattttgcctttggaactcatgcatgctgtgaggaactccaacccaggccacatgtgggagagcacacagagaaaataacaggaaaagaaactgaagttccccatcaatagacagcatcaattccagacaagtaagaaaacaagacttcaaagattccagtccacagccttttaactcttccaaccaaggctccaaacctgtggagtaaagattaattatccccctataccctatctacatttccaacacacataaactatgagagacaatataaacaacttagtgttgagacttgtaatgtaatcacagtacctgaaactaattttggtaccaagagtggggtcctatgtaacaaagactttaaaaagccacaatgacaatgaatgggacagatggaagttgaaagggctttgaacaggctgagagtggaagcctgatggagacgatcagtgagagattatttaaaaaaataataaaggaggaaaatttgacacttgaagaaagggaatccttgttaacatactggcaaaaagtttaccgacactacactcacagtaaagtagtaagtagaaaatgtacttagtgaaatggataatttatttaaggagatttctgggtagagtgtagaaatgcttcctggcttctttttgctgcttataataaaatgctagacaagagaaataaacaggaaggcctgttaagtagagaggatccaagacttgcattcaaaaataaaaccgtctctctttccaacatccaagattctcaaaaaagaaagtatttcagagcaaagcaatattctttataaagactgcaagtatatgaaatggtgcctatgagaattgtagagtgaaacataagttcctttatggatcttaaagacatgctatattttttagaatttcatttaaaaaataaatctcaaattcaaagttaataaaacataagggttgacttttactgttagaataatatttttccaatgcccccaaattggattgaccaataattttctattcatgcaatatagcatttagcttcttgcaatatgctggggtcttcattgaccacttaataaccaggaagccaaattaataatctacagcataaaatgaatataatttctcaaatcaagagtactgtatttcattaaatccggccattgatagatatatcttttatataaaactaaaaaaactgacaaataaactatgacacaatactcccttattttataaaatcttattactaaaatttgtatttatactcattacattcaattatttaaggttttttaggtttttttcttataaataatttccgtgtggtatgtaaaaagataaatacttttgaaatggttaaagtacttctaaaacatcttaaaattaacttctaattatcttgattccctttatatctcagagctgttgatgtcattgttttcccacaccatagtttcttttgtgccatccaagacattattggtgcagcatttctaaaagattcctccactgttgtctgtaggattttcttctaagctctgacatctcatccattctgcaaattttactgctttcctgattttaccagatgataacaatagaaggttttcaggaaatatctaaaacacatagttctcaagtgattcttaggcgatttagtattttaaatgtcaaaaggtcacaggtatccagtgatgccacaaataataatgacaaaatttatatgtgtgcaagccactacttcatggatgccttctggccaaaaataattttaagatgttctgattgtgagctatctctagattaagatgttaaattatgacaaaatatgcatgctagaatcaataaaggatgatattttgggtaaaactatatgtcacttaatagcatgtgttgtcctaggcctagagtactttatttttatttttttatttttattttattttattttattacattatattttatttttttttgagacggagtctcgccctgtcgcccaggctggagtgcagtggcgcgatctcggctccctgcgagctccgcctcccgggttcacatcattctcccgcctcagcctcccgagtagctgggaccacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccagtctagagtactttaataagctcacttagattttttgtggatccaagagtgacatccagtaggatataaatgaattagattttccctttcccaaaggcaacctgaaagttatattagagaccctataaagtgaagaattggaccctgcctacctacagtggtttaatttaatcagaatcacaagcccaagctagttggttatttatttctgctgcctaagctctagataatataaatgaaattttatatggtgccagtgctcctctgatcaacatagctttgagtagcaatctgtttggtgtgagaaaattagtaaaattttgataaatatcagggctctgcaagttgaatctgatggtatcaagcaagtctaataataggatggggtattaccattcataggttttcaagactttcataagctcatttgtatttccacagttccaaatttcctggagaataaacacaagagttacaacttgatgacagatccctatgcattccaaatggccacaaacaagtactctattcatggaaattttgctaaccctggatatttacactggttttaaaccaagttcagtgttccaaataacaagtgctccagaattatgagagtcaaacattctgtttaaaaaatttgtttagctagtatttgggcataaaagtactttttttgctaagagatatagaatgtatttgtactgatagctcactatttatgaaatgtatcatttatatctgctatctgctatttaggcccatctatatgtatatgattatttgcaatctgcaaatagttataattaaatgtagccaagcaaaagcatgatacctgcaaatttctctccaaactgagtataattgctgctgatcaactagttatcaaatgtcttttttctgcttgctttatatcagtaattttaatatgaacgtattgatatttaaagcatcatcagagtagtatgtttctttctgttaaactttgctatgtgttttagtgtttggatagaatcagtgagtgaaattttgcaggcgtgtgtttaacatgagaggaggcaagataaagtatactgctttgaccaggtctgcaagtaatgtattaatagtatttacattcctgacctcaaaaatcagttcatgtaaatttctatcttgttcaacatattggcaaaggcaagactgccagaaagacaatttaaaatgccaatgtggtacaaagtaagagggatgtccaggagagtttggagtgagtgaggctttcaaatctgggcccgtggcggaaaatgggggaaaaaagtgcatgttctctggctttgttaccaaagtaggagggtagcattcagatgttgctctgtccaatagcagggtacagtggtaaacgctctgagcttaagatttagaggactcagagagagaggttaagaggctggcccaaggtaactaacataaaagaagcaggatttgcagtttattcttatgttttgttttgttttttactctataaaaacaaccactattataggtaatcttgtgtatcagaaatatatatatatatatatatatatataattaaatctccatagatagctcttctatggtcttgaattcacttgaatgtgcatgacatcatccataaaacttagtggtttaaactaataagcatttgtgattgctttgacatctatgtgtcagctgagtggttctgctgatctgagccaggtttggcccatcttggctgggcttcctcatgcatctgtgctcagctggcaggtgaacagggcagtgggtgtccctttatggacctcacccatgtctggcacttggctggcagtcacctggcacaacagtacacaataggccctgtgtctttcattgtccagcagagtatactgagctcgtttttatgtttatggcaagtattgagagtgagaggcaatgtgcaggcccttggaactggcatctttcacgtccatcacaatcttttagacaaagcaattcatgcaaccaatcccgattcagggggtagaaaaaacatactctcatcatgatgggaagagctataaagtcacattgcaaatggcttgaatacaaaaaggacatatttttaattattctatcaaagcttgaataagaatgctttagaaatctcagataaaatatttcaaaagaggtcacagtttagctgaaagtaagagttaaacaaatgttataaatgcaacaattaaaaaaggtgaatgttttggctcatgtggagataaaggagtagagtactaatagtgtaaataattgaagtttcatgaaagcaattttatgtagaagtacttactttaatttatatgacgtgttaatggttgaaaaagtgagatgaagaaattacacttatttagtgaactgattaattctaaaatattattgtaacatagtttatcttctgcttgcaaaatttctatatttggctactgagcctaaagtattccaatgtagattcatgtgaaaggttctacatatcagacaaacccaattaagaatgtgatagggatatagcatcacagagcagtttattacaaggttttttaaaagaaagtaattgttaatgtaactatttgttttatttttcttctaatatccaagtacataagaaaataacaaaaaagactgattgcatcaatacaaaaataaaaacagatggtcatgaacttttacttacaattattcaataaccttagaaaaatataaagatcattctcctgctttgaaagaatatgaaaggtcatctggttgatctttctgactttagatggaatattcttctcttaacacacagttctatatttagcaacaacatttttagaccagtgtacacaaaacaacaagagattagtcatttcaaaaaatgaggttaaaaaaaccttgattttatactgcaattagtatgtccctgcccccaccttgaacttattctgtacctccattctgcatctccattctttcgagtgcattgtagcctctgattatgttacccagggacaagacacttaacctcactggaatcgttttctactttgatgagcaggagacttatatactgttaaagttggatgctgtattacatgtgattacactaaaaaccagaacactgtaaatgttaagtgtggattttgcagacacattggtctttaaatcctttttctgtactttctagttaaatctcattggtcaatatttgagctttattagacttgatgtctacatatgaggcaagcagataatcacattaactcccttagttcccatgacaagtaactaagaaaatgcattaaatgagtcccttgcacatttccaatgtgtggcaagtgcttccatggtagtcataaaatgaataaaaaaatggttagacacatcagtttttcctaacttatttgatatagatgataagctaacgattattaacaaaagaagataaaagactgcggtaccaagctctgagctgaatagagcatcggtcactggattactccaatcaccttcaggttgcgtaagcttaggaccacaacagatgcacattggactcgatattattcaatcaccacaaacagaaacacccacaatctctttggaagaaaatttttgattaattcatttagtgttttatttaatattataattacttaattgttaatgactttcctgctctacctaaaaagtttccatttaaaggttttctttctcatttattaagaatattctaaaatctcttttttttcttatctctcaattttctccaaacaacaaaattgtccagtatatccatttttccatagctatctttagctattttaactctgaacacatcagttgaactgtggaataatttacatttgttcaacaataaacaaacatatagaaagctgatagatcaatgtttccctaggcttacagtgcaattatttaatctctacatggtataaagtcacccatatttatttttctcctgttcatatatttttatgtccaggacagtaatttccttacaggagagttcctaatgtttttgtttgtttgcttttatcaaagcaaaaataaaacatggagccctaaattgttttcaggagtcaacaggctttgttggggcgagtatgtatgcataccagaggaagtaatgaaatcatttactctattcactttcctcacaagaaacctgccaagaaaacgcgagtaaagacacagatcgatttttaaacctggaaaggacctaagaacttctctaggtcaatctttttattacatcattgaagaaactgaggcatagagtaagccactgtgcaaggacgcaaaactatggaaaaatctggataggaatataggcttttcttcttcctaattcagcatgctgttctctacatcatggtaagaggacggaagggagatctatagaaaactttggtccctatgtggttctgcaaccaagcatctggtgatagacctggggctgctatgggcaaaagccatccgtggaaaaaatgatagacacagagtggatgagagtgagaatacctggagcttgccaggcacctctgtagttgctcaaggactccatctgactatgacaacctacagaatgtaatggatgtaccacttcactcactctttccaaatcgcatgaaagttcatcttttgaccaaatctaacctgtcaccgtagagtgaataggattctgggaaatagagtaaagtttagctattctctcccagtaaaaccaccccagctggtaacctctgatccattctaaatgtaaaattcttcaggcatcactctgctaaatttattattttagaacagcaaagttctaaggtgaatagagtgaaatacaactttttgaaacctttttaaatttctacattgtaatattattgtgagccttgatgaacctcagtttctttcttcaatatctgtcatcaaccaaacctttaaaaaaacatgtaatactccttcctgtcaaaatgttcataaaacagctatttggatctctctttctctctctctctgtctctctctctccttgtgtgtctctctctctttctctcttgttccatctctccctctcttcatctctttccattactctctccatagctagctagctagttagctagttaggatagatagatgatagatagatagatagatagatagatagatagatagatagatagatagatagatagatagataattgagagaaagatagatggagaaatagttttaaacagcttcattacataaaagaatattaaagttctgaaactagatttttttttttttgtaaatttcaaaagaatgtagacttctctttttctttagtcaaatttttggtgctttcctggaagctaaaacagcactggtgctgaaagggtggccattgcgatcatactgtcttccccatacattttctcaagtgtgttgaaccttcccacagatgaaatgaactcttaaagggcaagcactgtttgtagtgctaccaagaggaaaggttccttctataaaacagtaccatttatcagacccactcaacactaagataaaggatagggatatggaagcaattgtcctggtcatctgaggaaataaccaatggatactttaggctaaagcatgtttggcctgaactacccaataatgacctcctagctccatgtggatatgtttgaatgtccacttaagtttatgtctctcttcactttttcctctgtttgtccaaatacaatatcaagatcatccccaggtgatttttttattatactctgcttgggtctttcagggagtacactcctaggtagaaccaagttgcctctgtccgggcaacggaagcctctgcttccaattatttctgccctgcaggcacttcttataaaggagctttctttgccaagttctagttattatttcctgaggcctttttttccctttccaagatacctcttgagagcaaacttctgatagaactgcaactttgtgacactagatagtacaagaatcattattttggctttttcactttctgactttttacacacctataattacatgctttgcagtctttccattcagataaaagcagtattctttaagacttttttttcctttcctttatttctgtggttatgattggaaagagaggcttccaggaacctccttgaaagtaccaacatatttcattcatttttaaagttctctttaatttattttttttctttcaactagttataatctgaatattattataaccataatatggtggcaaaactgtcaccctctttgcacgttcacagctgcacttaaagagacacttatgataccatggatagaatcacacgttgttcttactcgtgtgtctaaacaaagttagaaatattgctgaaaatcgtcaaagggacgtaggttctggatatgccaacattttgcatgattctgaaaatactttatagttgtgtctttcaggcgaatcaatcagaactttagtcgtaatcacaacataatcagcgaatccagtatttccctttgggtcatatagaaggaacatgtatctgatcagtataccaataaaaatcggattagttctgagattctccttatgattgagaatctacttcatctcaaaactgctttacaggtctgacctgctacagttcaggttaatagcacacatgtgtgacttaaaattacttaattgaagctacagatgtgtttaatttagattccatagtaacgtgtgtgtgcatgtgttggcatgcacacatttgtgcaatcaaaaagaccatctaattacaaaataaagtaaaaattgaggattttaattatgcataaatatattacagatagttgtacggcttcaagtcaattgaaaagaccattgggacgttaataattaaagtgtggatttagaagctttattcactgcttatgctacttaaatataattttcttttaactttaaataaagggaaaattgattctgattaaacaacaaaatggaaccattgatgttaactaatgccatctattgcaagccagatttttctagcgtaatctttttttttggaagacaatatgagatggagatcacagggaaaacttgacgaagcttgcaagataatattccaattagaaatacagaaacatcttgtttgaaaaaacattagcacacagaagccttcatattcttcaaacacacttatatacctttactcaattcagaaaaataaaactgtaagcttgagcaatatgtatagacatcacccttgtgttacatttttaaccttgcaaattctatttgcgttggaattcagttttccatttgtaaattggaatcactgagtcagttagcttacttgctatagatatccaaggataccaagctacaatatacatctgaagacttactaaaacacaagcaaccttagtgagcaggatatcagtgggatataatatagtgggttttggaaccacattcaccagcattcagagcctgtctctgttatgatttagctaagtcaccaattctgagtctcagtgcccatgtctataaaataaagataaccatatttaaggttttgtaacaattcagcgaggtcacctaggttacagactttttactgaaactggcatatagaagttaatgttatggttcatactatcatatatttcaaccttctgttaccaatgaggtaatatgtgacttatctcgaaccacgctattctagcatgtttgggaaagaaaacgggttttcttattctcttttcctgcagtgactaaaagaaaaaagtattgtaatttttgagaaacatctctgtgaaaaatatgtgatctagaagatgtctctgggtacatggatcaatgagccatgaaaaaaatgggaaaataaaattgtcaattttttgataattcaatctgtttgggtaggacctttcctgctaatagcttcccagtgggtaattctttatcggctttttgtcttatagttaaaatggcacaagtggtcccagtggctgttggcagaataatctgacattttatgttattggtttcaaattcccaccaaaaacacctccccatgaccagaagatttagtatagtccatagacagccaatttccaaatttttggctcaacgtagaagggttttgtcccattaaaaaatatcccccatctattccttgattgataggattcaactgctccacttattttgccatttgaccagacttaaatctaatagatacggatcataactaacagccagcctgccaacaaatgattcaagaatgctgtatggataatttttttctttagtaaaatcaaaatcaactaagccacctgctgaatgatattgctggaagcattataaacaccatgaccaagaaattcaactgcaacctcttctatgacaatcactaacaatgttcctcatagcttgaagctgaactgaacagaagcagaatgtataaaacaggcatgttttagtcattgatacctagatgggaggatctcactttcttgttctataaatacagcaatgctacttggctgtaggtaaataataaagtaaacaaaattatgttcttcatacccagagccttgagttcaagtgctggctatgctcctcattagccagttgtgggatcttaagtatgggaccacagtatgttgggattgcaaaatgagaaaagtcagaataaattacttttaagtttcttttattctaagttttaaagattgtccttttctacccccagtgcaggaacacagaagtctcaaatttccacttacaacattataataaacttacttattcctttattttctttgtttaatttggttattcaaaaaacttgcattggatatctgttatatgtcaggcacagggcaaaattctgaggatgaaacaacagtccacattattaggaaacaaatcatagcaatgagtcaagctgtgatcctctgtgatatttcttgcttcattcaggtcactgctttcacttatctaaagtggcaattatttggctacgcaattcatgctattgcaggttgcaggttgcccttggttccttatgaaatacaattcttgacagtagttatggcgaggagttggttctttttattatttcaaaaacatttacctttttttttttttttttgagacagagtctctcttttacccaggccggagtgcagtggcgtgatctcagctactgcaacctcaacctccccagttcaagccattctcttacctcagcctcacgagtagctgagactacaggcaaaacccaccacgcctggctaatttttgtgatttttgtagagacaggatttcgccatttggccaggcttgtctggagctcctgacatcaagtaatccacctgcctttgcctcccaaagtgctgagattacaggtgtgaaccactgcgcctgtccaggttttacttttattaaagaagcacaaactgaatcaaaaaagtaaagtttaaggtgaaattaaattaattctctgatgtttcaattatattataggctgataaaaatttcagaatgtggccaggtgcggtgacttacacctgtaatcccagcactttgggagtccaaggtgggcagatcacgaggtcaggagtttgagaccagcctgaccaacatggagaagccccatctctactaaaaatacaaaaattagccaggtatggtggtgcacacctgtaatcccagctactcaagaggatgagggagaatcgcttgaacccaggaggtggaggttgcggtgaaccgagatcgcaccactgcactccagcctggacgacagagggagactccgtctcaaataaataaataaaaaaaaaaataaataaaaataaaattcagaatgttaggtaaaaatgattttgatttaaaaaaggaaatatgttaacaattagttaataaattgtagtttatttggtagaagatatattaagacatgggatccaaaatgtaattagactatgattgaataaggtaatatttaacctccctttaaacttaaaatgacaagattcttcataactttgagttgcttctttaggtttcagagtttaaaattcaaacttccacttttggacccatatgggatctcaagtttgatacatgatacccagagccgattttctttcttctctttctttcttttcttttttctttctttctccttccttccttccttccttccttccttccttccttccttccttccttcctccctccctccctgcctccctccctctctctctttctttctctttctttctttctttcaaataggctggatggacaagagttatgaaaattctggattttttaaaatagtttgtttttgaaataaaaatgtcaaaagacaaaaaatatacagtcaagacctataggtattgtattattgtttgtttgttttttagtattcagttggaaggcaggaattcctgaagatatactaaacttccttctgaaatattcggaagaaaataaaaagatataactgtagaaaacataaactcaaacatgacattatctgaattctgcactattatattaattgcaaaatgttccctatactccatcatttctgtgcattgtcctcaatttatatacaaggaaactgagacttaaggaccagaaataatccaaaagaaatgaacgtcagtgtggcttagtgaagactcatattttttaaccttgagaagaatagaagctagaacaggaagaactcaaagaacagttgtggtcatcacaatcaaactcattgttcccagaaatatatttgacaaaacttgagagtagtatttattctggttttattatatcaaattgcttttttctcaaagactttataacatgatgtgtattggaattacaagtaagaatagttctgaatatatatttgtttattcacccatttttgcattcaacacctatttcttgaatacattcctgtctcaagaatctaaaaatttaagatacagagggaaaccagataacatagttgtttccctcaaagagtttacagggtggtggagaagacaaatgttagacatataagcccagtgaagtgtgatacacactataatcacataatatgtaagcatattacataatagaattaagtgattgtagaaagttcctaaaagaagtggtatttaagctaagttctgaaggacaaatatgcattaattagaaaccaaaaggtaatgattgagtgtgattgatgacattgaactcaatgaaatattaatgtgttcaagtgccaacagctacatttgctacagtataaagatatgattaacacttgacctactttatttactgaactcttgaacttcttaaagtcaatccaaagtggtcctttaacataattgttttcaaaccttacagggaattgttgccatttccagatgtcagtgattttcagaaagtgcttcatgttgaaatgaaaatctactcaattacatactaaatcacatttcacgagaaaacacattacataactaaatgaaaataattatgtacccttcaatgagactatgaattttcttaacaatattaagtttttaaaaaacattttgatgatacaaaaattacattcttaaatataagtaagtaaaggtagtcagaataccatggaaaatagtcttctctatttaaaattcttgtaatatgaattgaacacattagattttataatggactctagtaattaaaaaattgatctaactataaacatatcgatttcctaataaaaatataaacctaaagccccattatatcatataaatatgaaataacttctagtaatatggtagactgagttggtgtagaatgacttctcccctgacccacaactacccaataacagtagatagaaattctggataacatgtaacacaagcagattaatagtgtcatcatccatctgcaaagaggagggaatggagaaggtagggggaaagaaaccttcaagatgtcagctacaaaaatattttttccaagtggcaaaatgttaccaatgttctagcttctcacatagttgggggtaaggttgagggtggacgtggtggggaggaaaccattaaaaatgagcttatagctaaaatcacaaccaaagttgtgatctactctgaggcataattaacaggatcaagaagtaggagaatcaacatatagaaaaatacaaacatgatacttttttatatgtgtcagaagttactaaaaatcaagaaagttttatgactagtaattatttatttttaattttatttttattatactttaagttcagggatacatgtgcagaatgtgcaggtttgttacataggaatacatgtgccacggtggttggctgcacccaccaacccgtcatctaggttttaagcctcgcatgcattaggcgtttgtcccagtgctgttccaccccgtgccccacatctcccaacaggcccctttgtgtgatgttccccttcctgtgtccatgtgttctcattgttcaactcccacttacgtgtcagaacatgcggtgtttagttttctgttcctgtgttagttggctgagaatgatggtttccagcttcatccatgtccctgcaaaggacatgaactcattcttttttatggctgcaaagtattccatggtgtttatgtcccacattttctttatccgttctgtcattgatgggcatttggtttggttccaggtctttgctattgtaaatagtgttgcagtaaacatacatgtgcatgtgtctttatagtagaacgattaataatcctttgggtatacacccagtaatgggattgctgggtcaaacggtatttctggttctaggtccttgaggaatcatcacactgtcttccacaatggttgaactaatttacactcccaccaagagtgtaaaaacgttcctatttctccacatcctctccagcatgtgtttcctgactttttaatgaccaccgttctaacaggtgtgagatggtatctcattgtggttttgatttgcatttctctaatgaccagtgatgacgaactttttttcatatgtttgttggccgcataaatgtcttcttttgagaagtgtctgttcaaatccttggcccactttttgatggggttgtttgtttctttcttgtaaatgtgtttgagttccttgtagattctggatattagccctttgtcagatggatagattgcaaaatatttctcccattctgtaggttgcctgttcactctgatgacagcttcttttgctgtgcagaagctttttagtttgattagatcccatttgtcaatcttggcttttgttgccattgcttttggtgttttagttatgaagtctttgtccatgcctatgtcctgaatgatatcacctaggttttcttctagggttttcatggttttaggtcttacatttaagccttcaatccatcttgagttaatttttgtataagaggtaaggaagaggtccggtttcagttttctgtatatggctagccagattttacaacaccattgattaaatagggaatcctttccccattgcttgtttttgtcaggtttgtcaaagatcagatggttgtagatgtgtggtgttatttctgaggcctctgttctgttccattggtctatatatctgttttggtaccagtgccttgctgttttggttactgtagccttgtaggatagtttgaagtcaggtaacatgatgcctccagctttgttctttttgcttaggattgtcttggctatgtgggctcttttttgattccatgtgaaatttaaagtagtttttttttattctgtgaagaaagttaatagtagcttgatggggatagcattgaatctatacattactttgggcagtatggacattttcacaatagcaattctttctatccatgagcataagatgtttttccatttgtttgtatcctctcttatttccttgagcagtggtttatagttctccttgaagagatccttcacatctcttctaagttgtattcctaggtatttgtagcaattatgaatgggagttaattcatgatttggtctctgtttgtgtattattggtgtataggaatgcttgtgatgtttgcacattgattttgtctcctgagactttgctgaagttgcttatcagcttcaggagttttgggattgaggtgatgggtttttctaaatatatagtcatgtcatctgcaaacagagacaatttgacttcctctcttccaatttgaatgccctttatttctttctcttgcctggttgccctggcaagcacttccaatgctatgttgaataggagtggtgagagagggcattcttttcttgtgctggttttcaaagggaatgcttccagcttttgcccaatcagtatgaaattggctctttgtcataagtagctcttattattttgatataagttccatcaatacctagtttattgagtttttagttgttgagtttgatcaaaggccttttctgcatgtattgagataatcatgtagtttttattattggttctgtctatgtgatgggatatgtttattaatttgcatatgttgaaccaccctgcatcccagggatgaaggcagcttgatcgtggtggataagctttttgatgtgctgctggattctgtttgccagtattttattaagaattttcgcatggatattcatcagggatattggcctgaaattcttttttttgttacacctctgtcaggttctggtatcagcatgatgctggcctcataaaatgaggtagggaggaatccctttctttctactgttatagtttcagaaggaatggtaccagcacctccttgtacctgtggtaaaattcggctgtgaatccatctggtcctgggcttttttttggttggtaggttattaattactgcctcaatttcagaacttgttattggtatattcagggattcagcttcttccttgtttagtcttgagagggcgtatgtgtccaggaatttatccatttcttctagattttctagtttatttgcatagaggtgtttctattattctgtgatggtagtttgtatttctgtaggatcagtggtgatatcccctttatcatttttttattgtctatttgattcttctcttttttcttctttattagtctggctagcagtctattttgttaatcttttcaaaaaaccagctcctggattcatttattttttgaaggattttttgtgtctctatctccttcagctctgctctgatcttagttatttcttgtctactgctagcttttgaatttgtttgctcttgcttctctagttcttttaattgtgatgttagggtgtcgattttagatccttcccactttctgatgtgggcatttagtactctaaatttccctctaaacactgctttaactgtgccccagagattctggtaccttgtgtcttagttctcatcgatttcaaagaacttatttattctaaattaattttgttgtttacccggtagtcattcaggagcaggttgttcagttttcatgtagttgtgaggttttgagcgagtagatgcagtttcttcatagtgtcattggtctttatattttggtatgtctttgcagtggctgacaccagtttttcctttccatatttagtgctcccttcaggagctcttggaaggcaggcctggtggtgacaaaatcccgcagcatctgcttgtctgtaaaagattttatttctccttcacttaaaagcttagtttggctggatatgaaattcttggttgaaaattattttctttaagaatgttgaatattggcctcctctctcttgtggcttgtggggtttctgcagagatttgctgttagtctgatgggcttctttttataggtaacctgacctttttctctggctctccttaacattttttccttcatttcaaccttggtgaatctgacaattatgtgtcttgctgttgctcttctcaaggagtatcttagtggtgttctctgtatttcctgaatttgaatgttggcctatcttgctaggttggggaagttctcctcaataatatcctgaagtgtgttttccaacttggttccattctctccgtcactttcaggtgcaccagtgaatcgtaggtttggtcttttcacatagtcccacatttcttgaaggttttgttcattccttttcattcttttttctctaatcttgtcttcacgctttatttcattaagttggtcttcaatttctgatatcctttcttctgcttgatcagtttggctattgatcgtatgtatgcctcatgaaattcttgtgctgtgattttcagctccatcaggttatttgtatttttctctgaactggtttttctagttagcagttcctgtaatcttttttcaaggttcttagcttccttgcattgggttagaacatgctactttggaggagtttgttattacccaccttttgaagcctacttctgtcaattcgtccaactcattctccatccagttttgtgcccttgctggcgaggagttgtgatcctttggaggaaaaaaagacactctggcttttggaactttctgcatatttgtgctggtttttcctcattttcatggatttatctagctttgttctttgatgatgatgacctttgggtggggtttttgcatggatgtcctttttgttgatgttgatgttattgctttatgtatgttagttttccttccaacaggcccctcttctgcaggtcagctggagtttgctggaggtccaccccagaccctatttgcctgggtatcagcagcggaggctgcaaaatagcaaagattactgcctgcttcttctggaagcttcaccccagaggggcaccagcctgttggcagccagagctctcctgtatgatgtttctgttgaccccttctgggagttttctcccagtcaggaggcatgggggtcagggacccatttgaggagccagtctgtcccttagcagagctcgagtgctctgctgggagatttgctgctctcttcagagctggcaggcaggaatgcttaagtctgctaaagctgtgcccatagccgccccttcctccaggtgctctgtcccaggaagatgggggttttatctataagcccctgactggggatactgcctttctttcagagatgccctgctcagagaggaggaatctagggaggctgtcaagttccagtggctttgcagcactgtgctgggttccacccagtctgaacttcctggttgctttgtttacactgtgagggaaaaactgcctactcaagcctcagtaatggcagatacccctctccccaccaagcttgagcatcccaggtggacttcagactgctgtgctggcagcgagaatatcaagccagtggatcttagcttgtggggctccatgagtgtgggaccccctgcctgaccaagaccgcttggctccctagcttcagccccctttccaggggagtgaacggttggttttgtctcgctggggttccaggagccactcgggtatgaaaaaaacttttgcagctagcttagtgttgcacaaacagtgcccagttttgtgcttgaaacccaggactctggtagtgtaggcaccctagggaatcttctggtctgtgggttgcaaaaaccgtgggaaaagcatagtatctgggccagattgcaccattccttatggcacaatccctcacagcttcccttggataggagagggagttccttggccccttgcactttctggatgaggtgacacccccaccctgcttttactcaccatccatgggctacacccactgtctaaccagtcccagtgagatgaaccaggtacctcagttggaaatgcagtaatcacctgccttctgcattggtctcactgggagctgcagactgaagttgttcctatttgaccatcttgccagattctcccccatgactagcaattgtagtatcataaaatattagcttgaaatgagcaagttaatacacttggtatgctgcccttactttaagaaaatgataaagaagtaaattgacaaggtgattttgtttttcagttttgatcttacccagtgccacctctcaaaatatgtatacatgtacttattttattgttttgattgattgtgaagaatcagtttttaaccaaaataatatgattttattaaatgacactttctcacaaaagccatttgaagcaatgcagaatgggatttttctctgaacatgtcaagttctgggagaacatttttagtgtaataggagaaaactatattttatctattcaattctgtcatgcaaattggaaaagaacttctgaaggaattacataggacttcaaaatataatactttcagcaagttaattgcatgaattaataacaacattttcagacaatcaaatcagcccactccactatgatataagcacgaaaagcatggctccagttttgtcatttgtgtgaccaacatataacactgattaaagcttgtcttggacaaatgaatttcagttattcaaatgaacagatataacagcaatgtatattaatttgaaaatgtaatttcacaagaaaatataacgaatatttttcaaaaaactacaagtgagagcttttctatgagaaacccagttagctttattattagatagtagctgttggtaatcacactgtttacacagctgaggaaggccatggattcagtgctttgctattaataacattaatagttgcactaagccctcgtcaaatgtcagacctttctcaggcttccctgtgatgcaaaagtgaagatgtgataataaaaatgttaatgctggtgatcattgtgaataagtccatatatcttcagaatgatgattttgcgcatatatgctttggtttgaatttcctctgaagcagatcctgagacaagaagttaagagcaaataatttctctgacaggtgcaaatgacattggtaaaattataggaaagtgttacagggaagagaagcagcaaaaagtgtgataacaagccaggaaccgtatgaatatctgtagctctgttctacaggaagactcttaaccatgatgaaaagcacagacctcagaattacttcacaagcaggccaaggaagccagataattatacatacatttcctagaaccattgattgagaccttctctcagaggttattaataccctggcacttccatcctacaataaaacatggataaacagctttctatggctctgtaaaatgccttaggctcaaatatgtatttactggcaattggaacttggtggaaacacaccaaaatagtgagttctgaggaacatgggtggggcactgagaacatctgctgcaactgacaaatgatttagctaattaaacaatgcattttaatgagttatctatgattaattccaaataaaagtagcatcgtatgaaatcagctcacaattgtttacacattcttttgctgattagcaacatcttaatgatatagtgttgaaaagaatgcttttatatatattgaaattctgcatattagaattgataatagtaagccatcctgcactttttaatttatatacgactactcttgggctccaaggaaccaaaactccaactgaaggagcttaaaccataagaagattaactattttgtataagaagtcctaacacgtgatggataccgaaatggttggctcagcaactataacaatatgagctaagattcatgagattcattgcctctttagcaggtggactttggcccttaggacagacatacccatgattacaaggtaggttttggagacccaaaacttacgactgaagcaatgcacaatagaagaaaggtttatttctatctaggtatctctttaggaatgaagaagttttgttcaacatcaccaagcacaacatttgtttatattcattttacataatttacttttaatactgatataactaatatatgacacaatttgccattttgaagtgtacaattaaaaaattgttggtatattcacaagattgtgcaaccacctaattccagaacattttcatcatcccacaaaaaaacacaatacccattagcatttacttctaatctactcacccgtcctctgtaactactatctacattatgagtctatgggtttgtttattttgggaatttcatagaaatgaagtcatataatacgtggccttttgtttctgtcttctgtcacttagcgtaatgttttcaaggttcattcatgttgtagcatgcatcggtgtttcattcctttttacgacaaagtaatattttattgtagtagtaatagcagtagggagaagatgagaaggatgaattataatagtaatagtagtaagtagtagcaacagcagtagtaatagcattcaagaccacagttagtttattcattcatctgtttatgaacatttgggttgtttccatatttatctattataaattatgctactgaacatttttgtaaagtttgtatgtgaacatacgtttttagttctcttgcatatgcatatgcagaattcaaattctttattatatggtaactctgtgcttaagttttgaggaactgccaagctgttttccactgtggctgcaccatggtacattctcaccagcaataaatgagaattattccattttctccatatccttggcagaatttgttattgtctgtttttctttgaatatagctattccatatggatatgaaatggtgtgacattgtggttttgatttgcatttccctaattactagtgatgttgagcaacttttcctatatttattgaacatgtacatatgaattttagtgaaatttctattaattgcttccccatattttaattgggttatctttttattgttgatttgcaagtgctctttatatattctagatacaaaacatttatcagatatatgatttgcaattattttctcccattcaagcattctattttaactttcctaacagtattatttgaaacacaaaagctttagatattggtaaaatcctattaatgtacatttttcttttgttgttcatgctataggtgtcaaatctaagaaaccactgccaaactcagggtcatgaagatttaaccctgtggttttttttttccctaagagttcaatacctccaatgcctccattgtggtccattttgtgttcatttttgtgtatggtacaaggtaggggtttaatatcactcttggatgtaaatatccagtattccagcacaattctttgcaaggctatttttttccacaatgaatgttctagccagggatgtccatttggtttctgtgggccactttggaagaagtattgtcttggaccacacataaaatacactaatgcgagtccaggcgcggtggctcacgcctgttatcccagcactttgggaggccgaggcgggcggatcacgagctcaggagatcgagaccatcctggctaacacggtgaagccccgtctctactaaaaatacaaaaaattagccgggcgtggtggcggcgcctgtagtcccagctactcgggaggctgaggcgggagaatggcgggaacccggggggcggagcttgcggtgagcagagatggcgccaccgccctccagcctgggcgacagagccagactccgtctcaaaaaaatcaatcaataaataacaaatacactaatgctaacaatagctgatgagctagagaaaaaaaaatgcaaaaaacccacctcaccatgttttaagaaattatacgaatttgtgttgtgcgtattcaaagccgccctgggccacatgaagccagtgggccgtgggttggaccagcttggtctagacacccaagttgaaaatctattggccaaagaggtgtaagtttatttttggactctcgattctattccattgatccgtatgtctaccattttgccagtgctgaactttcttgactattacaggtttgtagtccattttacattcagaaggtgtaagccctccatttttttttctttcaaaattgttttggctatttggggaacttgcattatcttatgaattttacagccatcttgataatttctgcaaaaaaaaaaaaggcaggtaaaattttaacaggtattgttttgaatctgcagatctatttggatctattggagagtattgccttcttaacacgttaaatcttccattagataactacaagaggcttttccacttatttaagacttccttaactttggtcaacaatgttttgtactttcattgtaagacttggacttcttttgctaagttgatttctaactttttttatgctaccgtaaatataattattttaaatttcattttcagattgttcattgctatgatttaatgcaacagaattatgcatagtgatcttgtatccataaccttgctgaactctcatttattaactctaatagtttctttttggaggattgctttatcttaccatctgcaaatataagtaattttaacgttttctttccaatttggttgcctttcctctattttccttgcctaatagtcctgtctagaacctccagcacaatgatgtatagaagcagtgagagtggacttctttgtgttatttttgctttggggggttaattatctggttttttttacagtttaggatgatataagattgtggttttctataaataacttatcagattgaggaaatcaccttccattataagtttgttgagtgtttttaccatggaattattttttttttctgcaatcatctgctcatttggcttactggctaatctattacctcagcatagtgtattacattgattggtttttgtatgttgaatgaaccttgcattccaggataaattttgctctgtcattgtgcaaaatcatttacatatgctgctgctggattcagttgctgttattctgctgaggatttttgtgtccatatttgtaagagatattggaccgtagtgctcttgtaatgtttttgtctggtttaggtgtcagagtaattacggcctcagaaaatgagttataaattgtttctcctcttctaaactttcaaaagggtagtgaaggactggtcttaattctataaaagattgatagaattatccagtgaatatcccttagtcttgagctattctttgagaaaagtttcgattactaaaccaatttcttacttgtaggtttataaatattttctatttttctgcagtcggttttattagtttatgtctttccaggaatttctttttaatatcacttgttggcatacaagtttttatagtatttccttataatcactttttatataaggtcattattaatgttccctctttgattctgattttagtaatttgaattttctctctgttttcatggtctgtcatggtaaagtttatcagatttgctaatcttttcaaaaaatcaacttttgattttgttgattatctctattattttttctactgttcattttattcacctctggccttatctttattatttccttctatccaccagctttgggtttggttttctcttctttttctagttcctcaaggggtaaagttaagttatcgttttgtaatctttattctttatttttgaaggtgtttacaccttgtactctctgcctgccttgcttctcctacattacagcatgttatgttttcattttcattaatatccaagtattttctaattttccttatgattttttctttgacttattagttgtttaagaatgtgttgtttaatttacatgtagttttaaaacttccaactttccatctgttactgatttctatctttattgtagttggaaaagatactttgtaagctatcagtttttaaaaatttattgaggcttgtttgtgacctaacaaatctgttctggaaaatgttctacatgcacttcaaaagaatgtgtatcctgaagtttttaggtgaagtgtggtctatatgtctgtaaagtgtggttggtttatagtgtcattcaaatctatttttatattgaacttccatttagatatcctatgcattattaaacattgattattacgtcttcaattactactatagaactatttctacctttcattctgacaatgtttgcttcatagattttgatgcacttttgcttgatgcacatatttgtttttttttaattttattattattatactttaagttttagggtacatgcacacaatgtgcaggtttgttacatatgtatacatgtgccatgttggtgtgctgcacccattaactcgtcatttagcattaggtatttctcccaatgctatccctcccccctcccccgaccccacaacagtgcccggagtgtgatgttccccctcctgtgtccatgtgttctcatttttcaattcccatctatgagtggcacatatttgttaatatttttatttcttcttggtgatttgacccttttattaacagataatatccttccttgtcttttgtaacaattttgacttagagtctattttgtctgatattagcatagccacaatagctcttttttagtatatatatgcacacacacacacacacacatacatataaaatctttttctgtacttttacatacaacctagttatcactttggatctaaagcgagtctgttgtagacaaaatatatttggattttttcccattctgcaaatcattatctttagattgaggttttggtctatttacatttaaaaatgttactgatagagaggaagttatttttgatgttttgttatttgtttctttatgtcttaaataattttgtttttgttcttatcagtcttcatttcttttattattgcattctttgtgcttagtttatttttatatcctcctaatttccttttatgtatattattgtattggtcagggttctctagaagtacaaaactaagagtacatatattaggtatatatatgtgtatatatactatatataattatatatgtatctaatataatatatattttatatagagtgtatatatataattatatataatgtcctttcatctcaacatgaagattctcttttagcattggttatagggtaaattttgtggtaatgtacttcttcatgttattaaggtgaaatgtcacaatctctcccatatatatatatatatatttcccatatatatatatatatatatttcccatatatatatatatatatttcccatatatatatatatttcccatatatatatatatatttcccatatatatatatatatttcccatatatatatatatatatatatgagtttatatatgtatatgagtttattaagtattaactcacatgatcacaaggtcccacaataggctatctgcaagctgaagagcaaggagagccagccagcccaagtcccaaaactgaagaacttggagtctgatgttcaggggcaggaagcatccagcacagtctaaagatgtaggctgggaggctaggtcagtctagtcttttctgcctgctttatattctagccatgctggcagctgatgagatggtgaccacccagattaagggtaggtctgactttctcaacccactgactcaaatgttaatctcctttggcagcaccctcacagacacacccaggataaatactttgcacccttcaatccaatcaagttgacagtattaaccatcacaattattaacatatttttgtgtttatcattgagagtatacttaacattctaaatttataacaatctagtttaagttgatactaatataactttaatagcataaaaactatgcttttatagtttcattctctcttctttatgttgttgttgccatgttgtcacaaattacttatttatacattgtgtacccgaaaatacagctgtatatttttaaaagtttattttattttatagcttgtaagataagctttattagcagttgcaaactgataataccataatactgactttttaaattgcctatgtatttagtacaatcagagatctttaattatttatatggcttttagttagtctaatatcttttcatttcaacgtgaagattcccttttagcattggttttaaggtaaattttgtggtaattactttttcatgttattaaggtgagatatcacaatctctctcttatctttgaaggatgattttgtgggtatagaatttttggttgacagttgttgtttcctagcacttttaatgtaacatcccactgttttcttgcttatatggattctgataaataattagctgttaatcttattgaagaatccttgtatgcaatgaatgtatttttcttagtgcttttaatattttctctttttctttggatttcaaaatttcataatatgtcttcatatgagtctctgagtttatcctatatggaggtattgaggattttggatttatagaatcatgtctttcattaaatttaggaagttgttagctatttcttcaaatatagtttctgaccctttctttctatattccaccttccacctccacccacacctgggaaattctataataaatatattgattcacttgatggttttcacgggcccctccattctctgactctttcctttgtctgcctgaatctatggttgaatgcctctagtaaatttctcattttacttattgcacttttcagctccaaaatttctgctttgtttctttttataatttctcttcattgatattctcattttgttatacacaatttttctgatgtcctttaattctttatctatattttctaatattgtctatgttttcctttccttggccttgtgatttttctgttaaaacttggacattggaatattatgatgtggtggtcctggaaataaaatctccccctttatcaggggtttgcatttttcaatattattaaggctgttatcctccatttatttagtgacttctcgaaactttatgcaaagacggtttcttgttgagtgtgatccctacagtctgtggtttcttgtttgtatttacttagtgttttaaaagagattcatttaaattccagaagccaagaacaaatatacagaagaataaaaaaaaaaccctcctccagtctttgcatcttgggtctatgtaggacactttctcaatatttagccaggcttgcactgaagttttagcttaagatgaaaacttatgaccttctcagatttttctctgagcatgcatcttatcctaaacaaggtttctaatatagattttttaaattcccttcacacacaagtctttttggatgtcctaattttttgaagatactctcccagcttttgatcctgggtcttacacagtctattatatgttttgactgtaatcatttggcccagaaatcttggttggttagtttgctttgcagtgtttttgagcaatgcccgtcacttttccagcctatgtttagaggtaggtaaaacaaataatagtgtccttaatcaacctccccgctatcattcaggcaggttagaatagaaatacacaataatctgtacataaggtctttgctctttccagagcaagagatcaggattccaaactgggaacccaaggtttcctcttcgatttgtgctgtgccagagagtggtggcaaaaatacaagtaaaaatgtcataaagctttcctatcattttggagttacatttcttgattcattgtttgcctaactgctgtaaacctttgactctctcccagagttttgacaaacttggttctgacactttctgcttggtttccaatgttttagctggggtacagtagcttgaagccatcattttgctgatgccactgctttggctatgagtgcattgtcttggttcagagaaatcagaatgtatgtctcagagcttggaataaggccatccactccaaaaggacaatgttttaaagagaaatgtagctggaactccctgtgtcaccattacttagttttatgttcaggaaactttgtctagaaaaaaaaaaattagaccacctaggttaagatgtctcaattgtattttccaaaaaactttccctaagaaagctaaaactacatataaatactttttttttttcttcagggaattcttgaatataagggtatcttagataactatttgctcaccttaacaacctgcatgcttatcaaacaataaattacttatcaaggattacttaaagacctttgccttactatgtccatcaagcttaagttgttatcttaaatgttgtcctacctcaataatttattttccctgaaagaccttccttaacacgtgtaaattcagaccccaagttctgtaaatacccagcttattgcttctccttctgaaaaactggcaaaactctgtcaggctggtgtctcctttattgcatgttttttaaaaaatgttaattttgatttatgaacagattggtgatattttgaagaattctatattaagtgagcaacagtgtacattacaatgtctaatagttacagtagaagttattgaaacttcgaaacattaaaaagtgtgtttgagttctgtacctgcctgtagattttaacatctgcttaacttggagtattataataatctaatcctgaggacttcataatttctaatgtaatattacagtttacatatattgatggttttaaaataatttacaaaagttatgtttttttgataataattctgttccacaaaaaaatcgtgcgtatcatttttcccaacctttgaaaaccttgttgctagattatattatgaaaaactagcaaataagtaattgcgaccacttagcaagtgttaccatctgagttgccacaagtatcaagtaaacttcttcgagagtataatatagattgtaaagcagcacgtttgtatccacagatagaattatctgcccaccaaagatagtgaagtgattagtgtcacctcttgcatcgtgaatagttggatggatagagttggttgagattgctgaggtgcttattattaacggcttaactcttaagtattttctctctttaaaatttcccattaaactaccgcacccactggttaatttcagtattagttagctttaagtttcaagttaatagaggaaaaaattttatgcgctttctcctcctatactggaagaggaacatgaaaccgaaacgcaaattctgggtttaatgaatctaagataaatcagtatcttcaaatggcaatataaaaagatggagagctgaagacataataatagactaagcagaaaaccaacaattgtgaaattttcttccttggtgaagaaaatattaacaaagtatacactgacttactccgggaaggttaacgttttgaggcacaggttgataaaaatactgtaatttaagttggtgttggatatgatgaaaacagacactgtttaaaagtctgattatagaacaagaagaactcaagactgcaagttccattattcatgggcaggtggataaatcttccacatttcaagagatagaagatttaatctttgaaataattcaattagctactcccaacttcaggatccaaagaagtcagacactgctttctgaattatgagacttgagttctcattttcttcctaacttttagaaaaatgacagagagacttttccttcaaggaagaatataggtgtatccttctctggctaaacaggacaactccaggtaagagacacatagataattgacatttgggagcaacaaataaagttcaaacaaattgccaaagctggccagaatttgaggaaacactccaaggtgggaaatgaccaaataaacacactttttaaaaaagaaaagctttacaaaaaatctcaggatgaacaaggctttacaaagagtagaacacttcaaaactgtataatctgtaccccttgggaaaacccaaaataagagcagaggaagctatacaaaagctataaaaattgcaattagagatcaagataagaattttagaaactcgacaaatgagtagataaaattagaaacatctgtgaaattttgcaggatataaatcaggaattcttttgaaaattagggggataaaaatcaagaaaatagtagagaacatataagaaaattgagtgagttaggcagaacaatatccctctaggagatgtctcagaaagagacaacagaggaaatactggggaagaaattaagaaggaaataatacaagagaaaacaatctcagaactataagaaataagtctccacattagaagggctcaccaagtgtccaagaaaatgaatgtaaaaggattcactctgaggcatgtagtcatacattttcttcaaaatactgcttataaaacacatatcctgaaatcctccagatactgataataaaaaagtttcatacaaagaataggaaatcagcatgacatgaggctctttatctgccacaccaaatgaaagttagaagacaatggataaaatgccttcagaattcagacagaaatgattttcctctttaaaatgtatttactcaaataatatgactgaatctggatttcagtatgaaggtagagtaacaatgttttcagatattcactgtctcaaacattttccttccatgcaccctttaaataaaaattgaatataggatacaccccaaaaataatgagaaaagaaagaaaggggaaggataggattcaaagaacagaggatctgttgcaagaaagagatcaagagaattcccaagatgaggtcaaaggaaatattgtgaaaagagcctgacaacaggtttaaataaaagcaactggtatattttggagcagtatgaaagtaaccccagaaaggatatctacagaggaaaaaataaaattgacagattttctgacaggtctgtctatatgaacattttattgggaggacttttcggattttttggatagtataaaaatttggcaaaagatccaaagactattaaacaataaaaatgaataatgtttaactataaggaaaccaacaggggaagtgaaaaatatgaaagtataattgtagtaaactatgactcaatagtgaacaatatctattatgatgtcataataattaaaacactgattatggcattaagcaaagattgtgatataactacattttgaaatataaaggtcgggaaagtagacagtaagaaagcttaaatcctcacttgccaaagtagaaaatttaatgaataatgtcaatgtacatctatccaccaacataagcatgttatttggaactatagaagcaagatccaaaagtttctccttccatgattggcgtgatgggagcaggaaccctggtgtttattctatgcacttagcactattgaatgctcaaaatgttttccttgttttcctttgataaaatattaattaattaaaaattgtttggcaccagtacatgtgcttggccattgtgagaagtgctaagaaaaaactttgttctgaattaagaaattgggttaaaagcaagatgcccaaagagtttggctttaaatcttgagttctattccacatatctgtatctgcttgaacatttatttactctctttacttcatatgcaaatatcagataattttactacttaccttgtggacttgttgattcttctcacttctttgttaaggtagcaagataatgatgtaaaatgctgggcacaggaatagcaactgtttaatgaatgaatgactgatgatgatgaagactatagggaaaatggtgatgagacaatcataaatccaacaaaacattcattatttcccaagcatcctcaaaaattcccaaactatacagtaacctactttattctctattcttttataaaactgtatctgatagtatcatctttattgtcatcaaaatggctgataaagtgagaagcattttcataaagacatacaaatttggattatcctaatagtaattaataccaaagttatttggatgtgtattttttcatcatttttcttaattttgacaccattttttgttgacatttttaatccaagtcaatatttttcattcactttgactattcaacgtttttaatatgcatctctatttaaacttgaagaagtctccacacatgtaagatatacacaagtgggaaggtggggaaaagaaagatgcccccagtgggtggattgtttgataaggagtgggttagaagaaggcagataaattatctattactatgattttttaataaaacattaaagaagggtgtaaagattgaaagctaattgttttttgcctagtgagattctgtccttgccattttgactaatgtttcctcaaacattagtttcagaaatcataccatgatttgaggctattaattcccaggaaaagagcatatgacattttgctgctgaatcttgtttttaattactaattacttaaggagatatgagaagcatatagtggcttttaatttcttttccagtttacaatttaaaaaattagtttaaattatttacagagaagatagtgtcacattagtacactaaattgaaatagaattgtattccactgccttggcttcaaatgacttagtgtgcttgaaatgattacctgtatatggatggctaaatagagaaatattaggtgtttagtatgttgtgaacttcttcctggcctatttattgcctaagtggcacttaagaaaattagacaaaattttgcactaagcctgatgcataatcaatctattcaataattcccactatgccttgaccttcataaggtcactccactgttgacaagtcttgtctgtaacttaaaattacagacagctgggtaagcccatcgagtgtcatggacacatctatttgggcacttcttcaatactttgactttgaaaaactttcaattcaccaactggtatcagtggtctaaagagggtcacttcttgattatttgacagctcctggaaatctctgtgttttttttttgcttctctctaagaataattatagatataaaggcttggaattcattttaaacctgtgatagtgtgactacagttcaacataaagattgataatgtagtgtctgttatgactcatatcttagccagtttttgttccccaatgtcagttttcatgttatacacatttccttttagttgagtatgaaaagtagagctagcaacatatatttggagtttttgagtttgtaggcatcattacaattgtaataattttatactcactgagagggccacagttatgttttaggtatattgtaattgcctatgattcctagctttggttggcactgctatttggacattagttgttgatcatcaacctattcacaaattgttattcaacataatggaatattctgaacaagaaattttgcaatgattgtgaaaagttcatacattttggctgtgttgaccatgggcttcagacttgtttccaagaagcatcaaaataattaaaactaaatttcaggcacaataaatagccatgtcaacttccatatctacatgataaagtgagaacggtttgggagtatacagctgggtgcataaacttacaagggagtttctttgaagaaaacaatatttttctcttacaagaattaattcaaatgctgctggtttgtggtgctaaaaaaatgtttctagctacagtgttttaaattcccctgaagaaaacaaaatgttttatgaatattaggattcagttttagactttcttacatttggaaacagggctacttgttggaggggttctcattttacttcacagtgagtgagtggctccagctgacttcttgggtgctttgttgaattggtggaataggtaatagtggtgaatgactaaacatagcagacataaccattagtaactcatagtgacttggaagacacctcaagggaaacagcgttcagccctttcatcttttgtagctaggccttcggtctttcagttgcaagaaacttaaattcaactcaaactaactcaaagaaaagagaaattaattgacccatatagtcaaggagggatttaggagtatttaccgaatagaatttttaaaaaacaaacagcagatgaattaaatatttagaacccacagtttaaccgtgctgggattttctttgaccttctcttgcttctgtttcttgctgtgtgttggctcaatttccttctagtgatcataagctttaaaacaaccacattttagcaacttcagtgggaaagcacatgatatttgtaaatacttatggattaatatcaagcagagagttggatttatccatcctttgagccaaccactattgtctgggaaataggttataatatttgctaactcctattgctcatcgctatgaccagagggctagtgcaaactacaggtggaagaatataaaagacattcttttgtaaaaacaggaaaaaaataacactgcctagcacgtccactgcaccacttcttgtgcaaacacctgtataacatccttacaggtactcctcagcattaactgggtaaaatgtaggatatgatgaaaagtttattagacctggcatctatctcatctctgtttctagccagttttgtggtgatgaaaaagacattttgcagctctgaactttatttcttcatccataaatttgttgctctatcattttcaatctctgtgaataggaattactgactgacaatctcattctgttgttgtagaactcagatcaagctccattgagctaaatgttgtctttcttgcattataatacagaaattaagagtgaactcttatatcagataacccttagtttgaatcctagtatgtggtactcagcaattcactcaaactctctatgtctcagtttcttcattgaaaggatttaattagaagatgtatataaagtgttggcaaaatgcctagcacatataaacactggataaatattagtcattgctcttattagtattattgttttcattattatttttaacttacaacaactggagtttggcttgtcaagagtcgtgcagaattaaagagtctgtctttcatggggacaaatctttctttccctcctgcttcaccatagtttacaattctttagagaagaggcgctttggatacttccccacataatacagacgatatctttcatttctaattgcccaggatcaaagactagttccacattaactaaacggccttaccattttaatgtgttttgaatcatttacaatccagagatatggaaacatagcaaaattttagagtaatggtaaaaagcacctgggaacatggtgtaggatggtgtaggagcaggtaattgagcacagacagttcatttaaatgcctagatcatgtaaaattatttacttggaactggcccaagtaatttgcaataaatgaccttattttttgcatgttgaaaactgctttttttttttgcttgagacaaaatctccctctgtcgcccagggtggggtggagtggcacgatttcggctcactgcaacctccacctcctgagttcaaaggattctcctgcctcagcctcctgagtagctggaattacagacacctgccgccattcccacctttttttttttttgtttttttgtttttttgtttttttttttggtatttttactagagatgagatttcaccatgttggccaggctggtctcaaactcctgacctcaagtgatccacctgccttggcttcccaaagtgctgggactacagacgcgaggcaccacgcccagctaaaaactgcttttgatcattaattttttgacatgtgctattatctggaagaaagtaataacaggtgaaaaaataattgttactttaaatgatgtcttagggacagccaagacataccattagctagggcaaaaatttattcaaactacttcagaattatgtagacagtttttttgtttgtttgtttgtttgttttttaatgggatgggcatttttgatcaaatgtgcaaaatagcttagcgtcattttttatgatttttaattttctgtcttaaacttatatacttttttgaacagtggtattttaaattaatattaatgtggaaaattcagagcattcttgtttcatcatcttgacaaccaggttagactggtaaggtgggaattataatgattatcttcattttactaaaacaattttcccaaggttacacagctagtctatggccaacacagacttgcagacatacgtattataaccaaaagaaagtgttcttattaatggaaaatagggtaaggtatttgttctgtttttctaatgttgctttagattctttagacaaatcatctgtgctaaggttgcttataaaagcatctgaagatcaatggaattaagttgagacaattctgaaatgaaaattcaagtgatgaaattccccagagttcaattatttgagttaaaagtgtttgtaataacagatcttggtacatagttggcacatttctccgttgtgtttttcctctttctatcacctttcagtttctattacaacactcttagggagtttactaataaattaattattggaaagcatatattgcctgaaggtttatgtaccagtagccattagccacaatatgcctagaatagatatgtcatttcccggttgaaatatcgatccaggagaacaaatgaacaaattatcaatttggacatgccaagaaaaaaaaattgaatatgtagccatgtttatttgagacattttactccataaagcatgtttaataaaaagaatgagttcatgcaagaattgcaaacagccagtcagagccatgtgatggtactggaagttgttttacaaatgtatgttccagttcaggagcatcctctcttagtaaaaacttccttttaatagcagcatcttaggcacttgatccacagaaggaagtaattaaatttaatacatgcaacactcattttgaggacaccctcgatttaaagtagcggggggcataattaagtctaatagaaatcatggcttgagaatgaagatacactatcaagcaaacacagaccaagtctacacagaaccaattacctggttaattagggctacaagctgtgtttatttcatgttattcaaccaaagcaaagcttgagggttgatattgtttgtttatttatttagttggaattacatttataattggaattaaatgaatataaaccacaatattagatgagcttaatgctcatatatagccacccaaaaagaaaaacaaagaagtggaatcattaactaagtgtttttaactgaaagagtagatttggaagcatatatatacatagcctaaaccatcagaaaaaaaaaactatattcccctttccactctttatcataagtataacttcaattaaaggaaataactttgatttatagttagaccacaacatagtatctgttgtcctgtctgttatagatcaagtcagcttggtgtaatggaaacaactctggcttaggagttaagagttcgtggtttttatcatttcaattcatttatacttctgtttgtcagacatacgttgaccctacagtgtggtagtcagcagagggaaagatggggaaaataactaaaccaacaagatctaattcttaccattgaggagcttgtagaatactgttagaagtaaacatttgagaataattatggtaagatgtatttaatagtagaatggatgtttgtagaaagagttgtaagacataaaggaggaagaactgaaaaataaaacaggaatcagttactctgtattttcccggaccttaaagggtgataaccaaaggcccagggaagggcaatggaggtagagtcagcagcacatgcaaggacatgaacagaggcccaagacattcctttgagattccagattatatgggggatctgtagtaaaatgggcgtgggactaggaagctctgattgttcagagcagatgaaacctgaggtgaaaaaggaaaagggaggccagatgctgggtacatttatgggatatatgtaaggtttgactttaccttttggaaaacaatctttgaagccaagaagttctttatgttttgcctatattgttacctgaaccctgagaccttatacttccttttatccaaacagtgtctggtatactgtgtgttgaatgaatatgagtgaagaaataattggtaacaattagtattcaattttatatcataatttttaatttatgattttaaggatcatgcccttagtaaattagacacacagtggtcttcctggaatgcgtttatgcctagatacaacaccagaagcacaatgtaaattgacgataataaagaactgacacatgtgtcaagaaacagcaacgtaagcagttgtgcctcagagaaaggcatagagagttttagcaaaaagctgtgcattgggtaaaaatcatggaaaaaaagccaaagaaaagttaactcaggctctccaataatctgattgtgaggtttcactcacatcattcctctaagttttattaattaattatataagttttttgagcacttactgtgctcaaggacattagggcatgaagcaacaatggacactgttctcgtcctaatttggcttgcatttaatgggctaaagtcagcaaggactctttgagagcaagcaacagacaccaccgtgagttctcaccagccaaaacggacttaattagaagcacccagagtagcttacagatggaaagaaagatggaaatccaggccttggaaagaccagagatcaacaaaatagaaaattacgtagtaggaattaatagaatatggaatatatatacaatggaccatggggtgcagtgggggagcaattttgcaaaggagaatggaattatcactaacagaaaagatagggtatattgaataggcaaaatagaacgtttgtacaaaaaaaatctttttctttagataatttctgaggcgttttctggttgtaaaagttctggaagttggcaaaggatcatggtttggtgtttcctacttttttaaatcatatttttctttctttagaatgcaaccctgccttttgtgaatagaatttcataagtgaaggaagctggctttcatctcaaagtgaaactaaaaaaaaaaaaatagtaaaaagttttcctttcaaaagaagaggctgtgattgtctttaaagtagttctataaataagcattctgcagtctgtgacacactttagagaaagagcaaagttcagttctatagctcatttaaaaatatccttcttgagttgagatggtcccacagagatttattttcatggatttataagctctgagaaactgcagtttaaacataggctggctgaaaaatgcttaattactcagtttggtcactgaagcaacaacattagccctctagtcaaagaaaatgacagtgttatcaaaactaacctgcaaagctttattaaaactatctttggcgataatctcttttaagaatgcattgtttttaattagaccttggctttgaaagcaagaagggtcaatgaaaaaaaatttaatcatgtccaagctactgtgctacatctttacaaaattcaattatttctatccagtgtggcacaagaaacatttggcaactgattaaaacaattcttaaagcaaattacagcactgtcagaaaacaagaaatcagaatgtcaaaatacaaggacatttctatgcaaaatgtgttgcaagtgtctttgacagagtatttctgtctgcttgttttattactttcattaatttggtccacatcaagtaaaaagaaaaaaaaatacttccatgtgttagctatttgaaataaaaattctcaaatgaataatattcccaaagataaccaaagtagccatgtggggaaattttatgctttaattttatccaagcttactcagcactgtaaaaatctatgttgaggtttctagctgtagggatcccaaaataactgcttttttttttttttttggcagtaaatccacatctatgcaatttcagctactactaatatgtagatgccattagacgtagatgttatgtattatttcagggcagaataaaacataacaatatgtaatttataatatatttgatgtgcattttaaaaagtgaagttttttaaagtttagaatgaataacaagtttgtttttcttaattatgctttaagttctgggatacgtgtgcagaacatgtaggtttgttatataggtatacacgtgccatggtggtttgctgcacccatcaatccgtcatctacattaggtatttctcctaatgctatccctccccctgacaggccccagtgtgtgatgttcccctccccgtgtccatgtgttctcattgttcaactcccacttatgagtgagaacatgtggtgtttggttttctgttcctgtgttagtttgctgagaatgatggtttccagcttcatctatgtccctgtaaaggacatgaactcatcattttttatgtctgcatagtattccatggtgtatgtgtgccacattttctttatccagtctatcattgatgggcatttgggttggttccaagtctttgctattgtgaatagtgctgcaataaacatatgtgtgcatgtgtctttctagcagaatattttataatcctttgggtgtatacccagtaaagagattgctgggtcaaatggtatttctagttctaggtccttgaagacttgccacactgtcttccacaatggttgagctaatttacactcccaccacatcctctccaggatctgttttttcctgactttttagtagtcgccattctaactggtatttcattgtgattttgatttgcatttctccaatgaccagtgatgatgagctttttttcatatgtttgttggccacataaatgtattcttttgagaagtgtctgtttatatccttggcttgctttttgatgggattgtttgtttttttcttgtaagtttcttgtagatctggatattagccctttgtcagatggatggataggttgcaaaaattttctcccattctgtaggttgcctgttcactctgatgatagtttcttttgctgtgcagatgctctttagtttaattagatcccatttgccagttttggtttttgttgtcactgcctttggtgttttagtcatgaagtctttgcccatgcctatgtcctgaatggtattgcctaggttgtcctctagggtttttatggttttaggtctcatgtttaagtctttaatccatcttgagttaatttttgtgtaaggtgtaaggaagtggtccggtttcagttttctgcatatggctagccagttttcccaacaccatttattaaattgggaatcctttccctattgcttgtttttgtcagatttatcaaagattagatggttgtcaatgtgtggcattatttctgagacctctgttctgttccatttgtctatatatctgttttgctaacagtaccatgctgttttggttactgtagcattgtagcatcctttgaagtcaggtagcgtgatgcctccagcttcgttctttatgcgtaggattgtcttggctatgcgggctcttttttggctgcctgtgaaatttaaagtagttttttctaattctgtgaagaaagtcaatggtagcttgatggggatagcattgaatctataaattactttgagtagtatggacattttcacgatattgatttttcttatgaggatggaatgtttttccatttgtttgtgtcctatttcctcaagcagtggtttgtagttctccttgaagaggtccttcacatcacttgtgagttgtattcctagcattttattctctctgtagcaattgtgaatgggagttcactcatgatttgtccctctgtttgtctattattgtataagaatcacaagtataagaatgcttgtgatttttgcacattgatttttgtctcctgagactttgctgaagttgcttatcagcttcaggagattttgatctgagacaatggggttttctaaatatgcaaatatgtcatctgcaaacagagacaatttgacttcctcttttcctatttggataccctttgtttctttctcttgcctgattgccctggccagaacttccaatactgtgttgaataggagtgatgaaagaaggcatccttgtcttgtgccagttttcaaagggaatgcttccagcttttgcccattcagcataatattggctgtgggtttgtcataaataactcacattattttgagatacattccatcaacacttcatttattgagagtttttagcatgaagaggtgttgaattttatcgaaggccttttctgcatctgttgagataatcagatgatttttgtcatttttttttttacgtgatggattacatttgttgatttgtgtatgagaaccagccttacatcccagagatgaagcagacttgatcatggtggataagctttttgatgtgttgctggattcggttgccagtattttactgaggatttttgcatcgatgttcatcaaggatattcgtctgaaattttactttttgttgtgtctctgccaggttttggtatcagaaagatgctggcttcataaaatgagttagggaggagtccctctttttctgttgtttgaaatagtttcagaacgaatggtaccagctcctcctggtagaatttggctgttgatctgtctggtcctgggctttttttgattggtaggctattgattactgcctcaatttcagaatttgttattggtctattcagggatttgacttcgtcctggtttagtcttgggagggtgtatgtgtgcaggaagttatccatttcttctagattttctagtttatttgcatggaggtgtttatagtattctctgatggtagtttgtatttctgtgggatcggtggtgatatcccctttatcattttttattgtgtctattttattctgctctcttctcttctttgttagtctggctagtggtctattttgttaatgttttcaaaaaacagctcctggattcattgatttttgaagggtttttcatgtctctatctccttcagttctgctctgatcttagttatttcttgtcttctgtcagttttcgaatttgtttgctcttccttctctagttcttttaattgtgatgttagggtgtcaattttagatctttccctctttttcctgtgggcatttaatgctataaatttccctctaaacactgttttagctgtgtcctagagattctggtatattgtgtctttgttcccattggtttcagtgaacttctttatttctgacttaattttgttatttaccctgtagtcattcaggagcaggtagttcggatttgagtgagtttctgaatcctgagttctaatttgattgcactgtctgagaaactgtttgttatgatttccattcttttgcatttgctgaggaagtttttacttccaattatgtagtcaattttagaataagtgcaatgtgtgttgagaagaatgtatataatgctgatttggggtggagagttctgtagatatctattagatctgcttggctgagagctgagttcaagtcctaaatattcttgttaattttctgtctcattgatctgtctaatattaaaagtggggtgttaaagtctcccactattattgtgtgggagtcaaagtttctttgtaggtctctaagaacttgctttatgaatctgggtgctcctgtattgggtgcatatatatttaggacagttagctcttcttgctgcattgatccctttaccattatgtaatgcccttgtctcttttgatctttgttggttaaagtctgttttatcagagactacaattgcaaccccagctctttttcgctttccatttgcttggtaaatattcctccatccctttattttgagcgtatgtgtgtctttgcacatgagatgggtctcctgaatacagcacagagatgtgtcttgactctttatcaagtttacccgtctgtgtcttataataggggcatttagcccctttatatttaaggttagtattgttatgtgtgaatttgaccctgtcattttgatgctagctggttattttgccctttagttgatgcagtttcttcatggtgttgacggtctttacaatttgatatgtttttgcagtggctggtaccaattttcctttccatatttagcacttccttcaggagctcttgtaaggcaggcctggtggtgacaaaatacctcagcatttgcttgtctgtaaaagattttatttcttctttgcttatgaagcttagtttggatggatatgaaattctgggttggaaattcttttctttaagaatattgagtattggcacccactttcttctggcttgtagggtttctccagagagatcaactgttagtctgatggccttccctttatgggtaacccagcctttctctctgactacccttaacattttttccttcatttcaaccttggtgaatctgacgattatgtgtcttggggttgctcttctcgaggagtatctttgtggtgttctctgtatttcctgaatttgaatgttggcttgtcttgccaggttggggaagttctcctggacaatattttgaagagtgttttccaacttggttccattctcctgatcattttcaggtacaccaatcaaatgtaggtttgctctttttacatagtcccatatttcttggaggctttgttcattccttttcatcctttattctctaatattgtcttcacactgtatttaattaagttgattttcaatctctgatatccattcttctgcttgatcgattcagctattgatatttgtctatgcttcacaaagttctcgtgctgtgtttttcagctccatcaggtcatttatgttcttctctaaactggttattctagttagcaattcatctaaccctttttcaaggttcttagctttcttgcattgcattagaacatgctcctttatcttggaggagtttattacccaccttctgaagcctacttctgtcaattcatcaaactcattctccatacagtttttttccgtagctggcgagaagttgtgatcttttggaggagaagaggtgttctggtttttggaattttcagcctttttgcactagttttttctcatcttcatggatttatctacctttggtctttgatgttggtgacctttggatggggtttttgtgtggatgtcctttttgttgatgttgatgctattcctttctgtttgttagttttctttctaacattcaggcccctctgctgcagatctgctggtggtcctcttcttcagacttctgtgctggcagtgagaatttcaagccagtggatcttacctttctgggctccatgggggtgggatctgctgagctagacaacttggctccctggttcagccccctttccaggggagtgaacagttctgtctcgctggcattccaggtgccactggggtatgaaaaaaaggaaaactcctgcagctagctcggtgtctgcccaaatggcagcccagttttgtgcttgaaacccagggtcctgttgatgtaggcacccaagggaatttcttggtctgtgggttgtgaagaccatggggaaagcatagtatctgggccagaatgcacctttcttcacagcacagtccctcatggcttcccttggctaggggagggagttctccaacccttgtgtttcccaggtgaggtggcgccccaccctactttggctcacccgtgggctacacccactgtttaaccagtcccaatgagatgagtacctcagttggaaatgcagaaatcacccaccttctgcattggtctcactgggagctgcagaccggagctgttcctactcggccaccttgccagccaccctgaaaagtgaacttttaagttacataggtctgagccatgtgttctaaaatatattgttgttttgacttcaatttaagtgagatttgtgctttttaatagaaggttgcacatttttcttctcttttaaagcttaacagaaattcaaaggcacacattatagaaaagtgaagctctaggttgataataaaataagataaaccacaaaaaaatctgccttttattaacatagttcttgtcccatgtcaaaattcaagcactagagttttgtattcagccttattgagtcagttagctaactctatgctttgcttctatgtggctgcttgttttagtgaggcagagccttgactatagtagttatccaacacatttgttgaagtatattgagataaagagctataagaacatttgagcctatttgaattgcttggcaaagaactatatattcaatgttcacaaattttatggaattgggtcttcttaaatagagaaagaatttgaatcatggaggagtttctaattatgcctactatattggcaactataatgttgtataagtcagatctcttttaagtaataaaacctcagctgaaactggttcaagagatagacaatagatagatagacagatggacagatagagttttttagctcaggaaataatgtttcataagtagtttggatttgatttaggaattcaaataatgtaatctggatttattctctttcagacacatatgtgcatgggcacacccacacagacttacacacacttctgctttcttggttgttgacttcattctccagtagctcactccctctacgtagttgactccaaatttctaggcttacactctcatatcttagcaagtggtcctggtagaaaagtgatcatccctaattgaatagacataaaaatgtcccagacttgagaatcattccttaaagtcagctgctctctctgtgggcacagagatgaactggactggctctcatcataggtctgtgtttgtgtctggggtataggctccagggacatagatcagtcccgtgtctgggatataagttccagggatataggttggtccctcctgaaagtgaatgaaaatagagacagatggctcaccacatgaaatatcattgtgttaattccagatgaactgttaaaaactattaaaataagtaaatacagtcaatgttcacaactggtatgaaacatagtagtgaaaaaacataagggaaaattatatactgtaacatcacacttggcttatggtcttcattaatatctcttaacttcaacatgaacctcacacaatgatttagtgtcctcaactccaatgatctccattcattagaaaacagaagtcagtgtttgtggcttaaactacggtaggtactgaagacaagtcttggcatacatatgggatggaggtagcttagtgctgtaggtttgaaaccatgtggagctaaacagtctcaaaattccacacccacattgccaactctatctgcatataccttagtatgacaaattcaattattccaacagtaaactaattcagtatgtctcaagctgaactgattctttcctgccaaatcagttatcttctaactttctattaaactcctcatgattcttcattggaagcttccccataatgggttctacaacatattttgttttttaaaaattaatttaaattttgagtatataattaattcacttttaacagtaaaaggtttttctctcttctttatctgttagctccctgtatgatagtgtacacaaacactactataaatttcttataggttatctttttaaagatacatatgtatacacaaaaatgcatacttaggttagtctaaaataagttatgttccaggatctaccttatttttaaaaatacatattttttcaagagacagagactcactgtgttgcccaaatgaaatgcagtggctattcacaggcttgatcccactactgatcagcctgggtgtttggatctgctccacttctgacctaggctaattcacacccctaggcaagctggtggtcccccactccaagaggtcactatattgataccaaacttattgtggataacctaattagtatagcaaactgcagcccagagctctagggctcaaaaaatcctcccgccccagactcccaagtagcagggactctaagcacctgccacagtgcctggctgggctctactttttatccctttacaatatatcttatagcttgtttttatatcaatttaaaataaacaatctcattttaaaatggatgcctaatatgacctgatatccttgcatataatatatgtaccagtccttttttgatgagcataaatttccaactttttgctgttccaagcaatgctgcaataagtaacactgtacatatattacatatatattttattattgagttttaaaatctctttgtatataatggaaattaagctcttgtctataaattctaaagtttttttattcaagtatgtaatagccatgctcacagagaggaagaatcaacattgttaaaatggccatactgcccaaagcaatttatagattcaatgctattcctattaaattactgttgatattcttcatagaactagaaaacactattttaaaattcatgtggaacaacaacaacaaaatatccaaaaaaccaaggcaaccctaaacaaaaaacaaagctggaggcatcacagtacccgacttcaaactacagtaaccaaacagcatggtactggtacaaaaacaaacacatagaccaatggaacagaagagataacacagaaataaggccacacacctacagctatctgatcttcgacaaagctgtcaaaaacaagcaatggaagaaggattctcatttcaataaatggtgctgggataactgcctagccacatgcggaagatcgaaactgaccctttccttataccacatacaaaaattaactcaagatggattaaatacttaaatataaaacccaaaagtataaaaaccctggaatacaaccaaggcaataccattctggacataggaatgggcgaagatttcatgataaaaacaccaaaagcaattgcaacgaaagcaaaaattgacaaataggatctacttaaactaaggaacttctgcacagcaaaggaaactcttgacagagtgaacagataacttatatattgggagaaaatatttgcaaactgtgcatctgactaaagtttaatatccagcatcgataagaaacttaatgaaatttaccagaaaaaaataagcaaccccattgaaaagtgagcaaatgaaatgaagatgcttttcaaaacaagacatgtgtgtggccaaaaatcaaatgcaaaaaagctcaacatcactgatcattagagaaatgcaaatcgaaaccacagtaagataccatttcacaccagtaggaatggctattaataaaaagtcaaaaaagtaacagatgctggtaaggttgcagagaaaaaggaatgcttatacactgttggtgggattgtaaattagttcaaccattgtggaagacagtgtgatgattcctcaaaaacctaaaaacagaaataccattcaacctagcaatccccttactggatacatacccaaaagaatctaactcattctattgtaaagacacatgcacacttatgttcattgcagcactattcacaatagcaaagacatggaatcaacttaaatgcccatcaaggtacactggataaagaaaatgtggtatatatacaccatggaatactatgtagccataaaaaaaggacatcatgtcctttgcagaaatatggatggagctggaggcattacccttagcaaattaatacagaaaaagaaccaaatactgcatgttctcacttataagtgggagctaaatgatgagaacacgtggacacatggagtggaacaacacacactggcacctattggacattggagggtgggagaagggagagcatcaggaaaaataactaatgggcactaggcttaatacttgcatgatgaaataatctgtacaacaaacccccttgacacaagtttacctatataacaaacctaaacatgtacccctgaacttaaaataaaaattaaattaaaaaaataaaaactaaagtgtgtgggttctaaattcagaaaaatcatatttccgagttttggacctacatattgaagctgtgtgaaccaagactaacttccatgtaatgtgcaacttatgaaagtatctataggactctatttcctcatctatgtaatggggttagtaagactcagttgctatgagaaataaatgaggtgatgccttcaagccactgattattttcattgacataatatttgaatttgcatcattgggtagactgaacctcttttataacattggatatatactctgctttataagataacctcaccatgtaagataattgccatgcataatgttcaaaggatcaatatagaccactcacatggcttgaggatgaagacatgtcagcgtttgaaccaatttgttaagcaacaactactagaaaacagatgcctcaaaaaaatcccaattgaatattaagaattttgtcagtcttcaagaaaaaaaaaaggtactgtataccttcacagtcaaaatactggagatttaaggtgactggaatactgccaattcttttgtttgaaattgatttgccctttgaagtgttttggcagaattttggcctcattctcccttttcccaacaaatgcacctatccggctaccataaagaagttacagaaatgttttgctttatataatcaagggaactagctaaacttgaagaatctgcctgaaaacccataatccagggtgactatctctatgttttatcaaattggtttaaaaagtgcaggatctttacttctggtaacttcaggtgatgctctgtgcacatgctcactgccttatcttgagagaacaagaaccagggaataatgtttcctgatttcctgcttgaaatcccttaggtgaacattatctcccatctccctatttacttgtaaacaaagcataacaaaataaaatccagaagattgagagtgttggttctttcagaaacttcccttttggtgaaaatcattagtcagtgaaaaatagctcttcacctaggagacaaataaattagaaaaggccaatatgtttgtgagaatttcagggaaagtataaatggaagaaccagattcacaaggaaaaaatatttcttcaattcagagaggacactagaacaaaacaaaacaacttgatttaatacaatcagagggagaaaaacatttaaaatgtgttgtgtgtaggtatgtaatgccctaacggagacagatatttattacgtatcatttattcaaaattttagtgtgcctgtgtgttgttgtgtatttgttgtacaagtttctgagtaatacttccaccagtttcagttcagcaacctttggaatttgttgagaaaagccaggaactgtactgtagggtcagaatggctgacttctctccatgctttcactcgggtaacgaggcaagctgtcataactatggtttctggtgtacaggggaggttttgactccaatgtcataaatctcagcagtagaaataatcaaataggtaagttctttttgtagggcatgtcagtacatgtcctctgcccaatttctaaagtataatgtatctcttgggttttcaaagtcaggcacaaaatcctcagtttagaatgtacacagtgaccctcaccattactgaatgaattgcttcatgctgtactgtccagaaatatcagagagtaggtctctgtgtttaacaaacacagcactgactctgtttggttcttgcatttgactaggttagcagttgtcaactcggggtgaatttgcccccgcctccccaggggacatctggcaatgtctgatcatgtgtttaattatcacacctgtaacccagtgggtagaggccagggaccctcctccaccacccaaatgtcaatggtgccaaagttgagaaaccttgggttagtttttgggttgagcacaaattcagataaaaacataactcagctccttaaataaaaatttgataaaggaaatgtaacaatgaatatactgaaatttcattttgaagtccctgagattttgtcatataaaaacatgtgggcacagtttcttacccctttaattctaattctcttctgataagtggattttgccaagtgaaagaagactgaaacttatcttctctaggagaaaaaaataacttggttgtttgcattgcagtagctcaattatgaataatctataattttccaacccttgagaaatggcttttagctatttttcttttttttctctaagaaaatgtaagattaaaatggtttttacctatgcaggtataccttgccttaagcaagttctatatatacgaaaacacaaatttataaagaatattaatctgagccaagtgtttgctttagaaaaagaatttgttgctttaaaaaagacagtgtgggaagtttcctgcaaatttttaaatcatggcacatttacagatagtttgacccattttctgctttgggaaacacataaatattaattgaaaaattaaaaatataaaattagcgaatcaattagccatcttaaaaatatctgctaattttctaacagaaatcgcttcatttggctgagtaaatacaatagttgaagtgtaggctttacataagtattgtatctattaaacaggttccaataatgttcttttcttttctctacactgctatcattcttctgtgaagaatggtaccttaatcttatattgaggtaatcattcttatgtgaaaaactgccaaaattaagactttttgtttttcttatcagtctaagttttcaggggtgttaacacaactgaacaggcttacatctaatgcagtattgcatcatggatatgtcaaatacatattgaaaatcacaagaaaaaatagaataacagcattaaatataatccaacccaaatccctagcaactattttcaaaatttctgcaaaatgcacactttattcacttattcattcatcccttctagcaacaattatatatctagtacctgtgggattttagtacccaggagaggcactctagcacctgcatctttggttatggctattcagtttttaaaccacataggcaaggtccttccctaagtttacagtatagaggtaaagaggatgagtgaaactcagtctgctcagtggacagctgatgaagggcagggccatgaaactgtacagaagcagcaaaactagctttgtccagagagtcagggacaacctcttagagaaataacttaggaagaaaatcttttaggagatccaagaaaaagagatgacaaatgagaagataacctccttaagtgcccatggaaatttgaagttcacttcaaaccattcattacattgttatttaataaactcagatatagtggtgggagcatttatttgtaatagaatccaaaagctagactagaatatatagaagattttttttaataatcagtacctaaaagtgtatcagtgatataatctccagagtagattcaccctttttttttttttttttttttttttttttttttttttttttttttactgacaggagtctatctttgaccagggtatagattcaaagagtaaatccataatcgatgagctgcgtacccgtggagaattcatgagtctactctgagtctcagttttgtcattcttaaaataggcataatatctacctttagaattttgtcctgagaattcaaggtaactccataatttctagctcatggcaggtacacatcaagtggtagtttaatttttctcctaactaaaagaaattggtcatcaaatataaaaacatagttcccagacaaaaattactttttaaagataaatgataaatctacatatatataatacatatattatctgtgaaaagcattataaaataatttcttaatttcgtataagagaaataatttaaaaagaacatttgataagatggactggcaaacctgaaagagatttttattattggaatataaaaaaattatataaaattgttaaacatgacaaaaatggaagatgagtaataagcaaagactaaagtaatatgtacacaaaactgtatgatatggaagataatcaattcatatttaaactattacattttatagtaggctgaattatgagccccaaaaatatctctgtcctgattttcagaacctgtcaatatgtcaacttgtgcaataaaagggactttgcagatgtaattaagtaaaagatcttaagatgaggagattatcctaaactatctgggtgaacccaatgtaaccaagcgttaggatttttataagaaggtggtgggaagatgagacttagtaataggaggtgtcactttagaagcaagaggttagtgtgacgcaagaaagggcctgagagccagggaatggaggaagctggaaaaggcaagaacgtgaactctccctctgagcctccagtgcaatgtagcttggccaacacctagattttggacttctgactgccagatcggtagggtaataaatttttattagtttacccactacgtttgtggtaatttgttacagcagcaattaaaaaaaaactaatacaagtctaaacatgcccaggtgttcagaaaatcatgtgaaggaagacggctgacaatggctgacacaataaatgaattgaacagagaatgtcagaaaccaaaatgtattatagatgtatattttctgttgcaaaagtaagcaaaaacatatttatttatttatttatttatttatttttgagacggagtctcgctctgtcgcccaggctggagtgcggtggtgcgatctcggctcactgcaagctctgcctcctgggttcacgccattctcctgtctcagcctcccgagtagctggaactacaggtgcccgccaccgcacctggctaactttttgtatttttttagtagagacggggtttcactgtgttaaccaggatggtctcgatctcctgaccttgtgatccacccgcctcggcctcccaaagtgctgggattacaggcctgagccaccacgcccagccacaaaaactttttatatatttagaattacacagtttcgaaccatattaaatccattttatagcagtatgaaatgagacgaggataatgtgtattgaaataccctgcgacatttgtagaataatatggaagtagcctagagatacctcgttcctcagtgagatgcattgccatttttgtttattaacaaaatcctcctggtcaccatttcagctcacccagaagttaaactccttattctgtatgtttgttcatttgtaattaatgataagtgttttttagtgttagcgtcttcgtagttagcacgaaggagctttacagaagcctcaacttgtttctcgaattttagtaaagttgatttcaccatagagcaactcctctttgtgtatttacatatctctattactgtaattttaatttactgagcaagagtcaacatctatatcattatgtgtgattagacaaagaagatctattaacgttttcctaaacttatactgctttccccccatggttgaccctaccatatgaaaaagagactcgtggttgaaatggtacgttggatgaaaacaatgaatgacaataaagttggagagaggggagaaacagctgctggaaaatctctcttatccaatgtccagaatgctgattgttttggggaggaagtaaatttgtattggcttaggggaaatcagtttgtggacaatactggtttggggaaactttgttacatttctaatttcctgacctgggtcgttacaatcaaacaaaattttattcttttcacttgcactccagatggaagaaaatgtaaacagctgtccaagcggtgatggagccttttcttccacattcttgcatgtcattatgttagagatttactttttcagcaaattgaaacctctaaaccaagcaatcaaatttttccccctctccctctctttgtattccaactgtcatcaattgcttactttcagaaatagttttctaaagatgaagctctgttgaatatgcatggtcattatcatatttactctcatcagtaccatatagcattatgttgtttacaataattagctgctggaggcaatcctgtaaacacagccatgtgacagcccaaatggagagaatcaagtcattgttaagaaagagaataggtatgcgccggttggactcctatgctgtggttattggtggtgattgcaatgtatgggtccagtccaaaaagaaatctcttactcaatacttctctagttgctgggcacatatgaaagaaatgaagacatgagggaattcagatggttaaataaagctaacaagacagatttttctttttaaaattttgtttaagtctgtgggctaaccatattcacttaggaagcaatacatacagtaaaaatgcaaaattaatatatttaacttaaacaaatttagatttatgcatagggtatgcccctatttagggtacacccctattactcatattaagcagacagttgatgcaatcacacagaaaacaatcaatgcaagctatcaaaatctatgaaagtatgtataaagtttatttcagggtttcctgaccattagaaagaattaaaattcactgtttaagcgagcctcaagtagatagtgataaaattatcactattctcagggaagaaattgaagaaaattgagggcaataaagaaatattactaatatagaattagaggagcagatatatatgtgtgtgtgtatatatatatatatatatatatatatacacacacacacacacacaaagctttatgtgttacttaatgggagttttataagcttttcaaggattattttaattttatggaattgctgctttccttgaactgcctcgaaaaatgttactccacaatctattaactaattcaacacacatttattgagtacctcctagattgaaggcactactccatggagaaaacatgaataatcagacacttttgcttttaggagctgacagtctcaatggtactgatacatcaaagtaaaatgtgatgcaatttcatagcagaatcaacagtgtgctaaccaagcatgaagaagtatggaaagtgatgtgagaggaaaaactctttataatttgttcattaaaatatattgcagttttagagttccattgtgtttaccaaattatcaagagaatacagaaaattccaataaatagagaagaagtgggtaaaatgtaggtctttactagcttattttaagatagagtaaatgtatattagtgcatatacttttgtgttttgctttttcttttagtgagagagggcataattttcaaagctgtgttgtggctagatagggaatacacaatttagatagtgaaacaatcaagcccattctaagtgccaaaagtttaatcccttaatgagaatctaaaaaagttttttttttaagtgtctctgagaaatactaatggtaactttaaaaatgtatatatttatatgcttacttttattagcgattcttagtaagctcccccataccaataatctcatattactgagcaatcactccatgtagttagagcaaaagtcttctgctgttgtacggaaaaattgatctttaggctgtgtagtggatgttgttgttgattggcacagatcttttctgggtctgcacttgtccatcaactgctgtgagtattatctcaatggttgtcttttctcggccaagccagagcccctacggctaggaaggtatgctgctctctacctaccctcttccaaagcccagagccaagactgactgtttttcttgccataaaatggaatcaactttctggcactatccatactctggagcttcccactggacaggctgaagttaggttatagctacttagctttttccccctggcttatcctgctttttttactccccttatccagagagcacgtgtccagtacattactggaaaaaagaattctcatctcagactctcttctagggagcctgaactaagttaatatccctacattcccagtacctaacccagtgcctgacatatgtcaaattcagttagtgataattgaatgaatgctgaatgacgtttgcattcatggtattagccatttggcaatactcaggactctcagtttattgcaggatgtatgtcttgatagacctctctacactacaacattcaaaagggaaatcattttagtgaccacttacagattcatgaagtacaacattgaaaatccactgacatttttgttctttgctttttttttctggttcctctctacttaaggaagtcaattttagaggtgatccacttatctgatactagattcagccaagttgcagaagcaacaaccaacacaactaagaacaaataaaatgaaaataaaaataaaaaaatctggagtttaaaaaccaagcgtgttgtagtcaataaagtgttaaaattttttaaaagttttcaaaaatacatgctgtaaataaactgaggatagactagctgcacagcctcaataaaaatattgaagacattatgaaatggtacacttgcatgatgatttataatttacacatgggtattaatttgaaactaccccaaaaaatacagcctacttacatagcttcagaatttaacccttctcccatttttcccccaaaagtgtccaattatctcctgtcagacctgacagtgagttatcttgttaaagagcttgcaattccattatagacaagctccaaatattgatttgtgccttttatttccttggtctttgacatcattgtaggactaaaaatgttcaaatctgttgctgcatgacagaaagaaaatggtcaagagatctcagatacatcaaaaaatagtttactgaatttatacttcacaagacactgtttttgtagtgtaggcctacgtgggtccaaaggagaaccaagtacaaaagtgtgagcagggaacagctttggaacacactcagtaaaggtacctggaaggggcttgtcagggaagcctccatggagtggcctcagagaggcacactgacatcatggcagccaacagagaaggaaatattgtcttaaacagaattcacaatgcctattttgtaggcatgcaaattattaaatatttaatgtgagctcttggggtaaagcaaacaaatatataaacaaaaactctttgtctctttaccctttgaaatctatgtcaccataaatagctagaaaaatgctcattgaacaaataaatgaatgagtgaatgaatgaacgataaattcagaataattactttgtatttatttggcactagatgagggaataaaatatgttccttgaactccagttttcataatcagtttgttcacctgtaattgatgattttcacttgattttaggaatttttggtgtgataataggtggatttgaaaatgtcaggttttatcattaaataaatagtattctaatagagaaagtagaaattgaataattatctaataaattccaacagtgagaactactaagttggataaccaccctgaagtaatttgtatttttctttcagagtaaattcttttaacatatgtttaatttctttaaatgactccactcaacctaagataataagaatagcagtggctttttagagcattcagatttcaaatacattttctggtaataatgtttctaccaaataaaagaggattaactctgtagagtattttaaagttgtgttcttaccgtataatcacatagacatttatagttaatgctacatttcttccatttgcagatttaactaacactttcatgaacattgttccattttttttgttccagtagtttatctttacaataaacaggtaactataagcaaagtgctatcctgagttctgtgaatccttctagaaaattatggaatctgagacaatgtaatgggaacccccagatttatagcctgtgggtcaggacccaatgggaattggttactgacatattaagtgagagcagtcttgtgggactgagaccttaacctgtgggcctgtgctatctaaagacagtgtcagaatggaattgaattattggatattcaggtagtgtcagagagctggagaagacacagcatatttgatgtcaggaggaaaagatccttttatcaactgagtcaaattttgagctacactataaaagaaaaatgtcgaaattgaaaaaattttaaatacaattaaatgtgtacagatagacacaaaaacactgagtggaataacttggagataaatttgaaaaaatatcccttaattaagataaaaaacagtcaaggagagacagagagtaagaaaagatataacaaatttcattggatcaatccgatgaattaaacacaaatttattataatcttttagagacaaaaagcagactaagagtgggggaaggtgtcatcaaataaaaaaaattaccagcacttgaaagacacaaatgtgtgtaggaatacagagaatctaaactgataagtgagaggaatttttaaaaataacatacctaaacataccatcataagatctcaaaacaccaacagaatgtgctaaaacttccagaaaaaagaaatctacaaaatattgagaatcaggctggcatcacatatcacatcattaaaactagtctctaggaaataatgctttcaaagtttgtcaggaaattattttgactataaatcctatttcagtcaaataaccaatgccaaaataaatatttttcagacaagaagactcacgggatatttgcaggtatgtgccagaaaaacttagagtgaaaaccaagagaaaggaagatttgagatacaagaaacaatgacaataacttagaagtgcaatgaaaataagcctcaggatgatgcccaaaaagggaccaatttagaaaaggaaattctaagaatctaagttgaatgtcttcagaaaatgaaatggagtcaattagaagtaataatgaataataaattagaaaatgctaattaatatttgaaaaatattttccttctctggacaagaaaaatataaaataaatgagaaaattacaaaaatacaaggcatccaagtttcaaataaaaagtaaaataaaatgtactatgatcctaagcaactgatgagttcagaaaataaacaatttatctggacgtgactcaagaaatagtttttattaaatgtcttagaagtagtggacactgaaaccacaggaaagaaaagtgaatccaaaatagtttaaatgttgctaatggttttcagtatttcaaatcaattggtagaaaacccacagaagtcttaattatgtttactggaccaaaaacaatgttatcacaactgacaaatgtaaaggaaactagaggctggtggacaaagttgaaggaagagtaggaatactatttttttttgtttttttacatagtggagtgtgtagaaatagtttctaaatgtgatgaaatagtgagatgtttaggtgtagtatttgcagatttaaaggtaaccaacaggataaaaataataaagctcaagatatagggagaaaagttatctgataaatccttgtgttagtagaagccggaagatgctgtctaaagttacttaagcaaatagaactacaaataagtatttgtaaactaaacatagcattttgaatataaaatttgaaataactgaaaccccataaagttaaaagtacttgcatctgggaaggatagctcagcatgaggaggggcagaatgcaatcattggtaaaacacaaagcaaatctttgcttttcttccacattcaaaagtgccaaaatcacctattttaagagtaaaactaaataataaaaaatgcaacaattttatttccatttctttgtttctcataacatttgttaatagttcttgagaacctcttccaaccctttcagcctcctgtcttgtgtcagctgattctgtgcagtctttgaccagattcacacaactgccatctgacagcatttgcctccagtcctgcattgtgccctttgttttctgcctcagggcttctgtgtcctcacagctgtgaaatacccatgactacctgtttaacatacacatatacacacagcagatggcacatgtatacataggaaacaaacctgcatgttatgcacatgtaccctaaaactgaaagtataattttaaaaaataatttaaaaatttttttttaaaaaaaagaagtgtgaaggagttaatgaccttctgggacaaatctaacaaaaagggagtcagaagctgggggaaagatgcttctgagacttacttaagtttcaagtggtgcaatgggacagagcaacaagtcatcatagcaatagaatagacaatgacacatccttgtattgactcttctttcttgtctccgccatccctcacgcttcttgagttcatattctggatttaaccacccacatggaagccactatctctggttctgctttgaagaaaaccaaggctaagacccaaagaccataagcataattggcagtaaggcctgagtgacagcaaaatgcctttactgtaggaatcagtggcgactaatagattatgatattcctttggatgtaaaacattgccagtctactaaggggttactggacttgtgatattaaaaacaaaagtttaaaagagagctaaggagcagaaggctgatatcaaagatcacaatgaaaaatccacggtgtttttgagttgtaaatttccatatgtcacttctaacccagggctacttggctacctgattcgaggtggaccaggaagagcctgtaatgacactacaattgtacatagtaaaaatgcctctgattcttccttagagagaactgtggccatttaccaccatacttgtactctggaaggaggaatatccagaatttggagaatttttgagaattgtcggatataagtctgaactgacgcctgtcaagctatgatagtccactagttaatgtggactttggaatccagattgaaaaaaaaaaaaggctgacccaagtctgtgtgtgcactgtatatatggaccaattatttggttatttccccaattccttaatataaaattggatagatatgcctaattgtcagccagcaaaaccttcaaattggcttcctaccatacagagtaagagttgctatgatagaaaagccaactgaaagattcctaaatatcctttcctttccctacccccaggcaaaaatatgaaatctgaagaaataacacatcccctgaggaaatgtgcaaattagcaccaccagaaaagatttaaaaattgtaatgttagtactccattgtatctctgtttgattgagctgcaacaacaaaaacaataacaacaccaagtgggttgggcagttggtgaactacatataccattaagggtgtagccccaaatgtatctgctatgctacctgtgttctctttgctagaacatgtcaacacagcctttgaaacttagaatgtaactattggtctaatgattgtgttttttgcaactcacatcagaagaagagaacaaaagcagattgtctcttcatgtgaatgacagtagtacattttcagcgtcttgttacagggctgtttacattctcctaccttgttttcatattatagtccagggcaccttgattatctttgaattattcagaatattactctgttgcactatactgaagattatcctaattgacctggtcagcaagaaagacaagtaatttagatgtcctattaagataaacatgccatatggtgggacataaatccacaaaagccctggaactgttatattaaaaatacctttggatttccaaatatctatggcatcctaagacatcccttctaagattaagaaaaacaccttatttcatcttataattcttattattaagggcaagtcctattacttggtgggcttttggatttttgagccaatatctattgtacctataaatactgaccaactgaagagggaagaaaatacctcaagcctatgtaacaattcacttggtgtgaaatgtttctgtgagccaaaagtgggctgatgtctcattgtttttcatctcagaggtggttctaaacaaagtggcaaatagaaatctttctggaaggtggagctgtgagctgtgcattcgttgttctctttttaggcatggtaaagtgaccagagttacaaatacacatcaactcttgaccagtggtgaatggtttgtctggttagtaaagagtctggtaaggacaagaatggaagttaaaaacaaggaacaaatcttgatgatgatttgctcatttctttgtgtctcatgttagtgtccaccagagggcacccactgcaaagaggcggtcaaccacctagctgttgaccagtagagaacaacctgtttggtgaatgtcagttttctttctttggccacaggagtgctagtgcaatgagcccatgaattgagtgtccatggcctcaggaatagtagtgaagcatggattcaacagcatgggctccctcaaagcagagaagatgacgtactgccactgctgattgcctagtccactggcaacagagaccaatcatgactacttaatatgacatcattcctcaaggagtccagccacactcttgatgattataatagacattatccactctaaagggaacagtgatttattcttatcagtactgaaaactactcagggtatagattattttttttctctgccagcaacaccatctgagaacagaatgcctaatctatcattatggtgagatatatgtgtgtgtgtggtgtgtgtgtgtgtgtatatatgtatatatgtcatatatgtatatatgtcatgtatatgtatatatgtcatgtatacgtatatatgtcatgtatacgtatatatgtcatgtgtacgtatatatgtcatgtatacgtatatatgtcatatatgtgtatgtgtgtgtcatatatgtgtatatgtgtcatatatgtgtatatgtgtcatatatgtgtgtatatgtgtcatatatatgtataagtgtcatatatgtgtacatatgtcatatatgtatatatgtcatatgtgtatatgtgtcgtatatgtatatatgtcatatatatgtatatgtgtcgtatatgtatatatgtcatatgtatatgtgtcatatatgtatatatgtcatatatgtatatgtgtcgtatatgtatatgtcatatatgtgtatatatgtcatatgtgtcatatatgtatatatgtcatatgtgtcatatatgtgtgtatacgatatatatgtcatatatgtgtgtatgatatatatgtcatatatatcatatatatacatatatataaaaaactaagatcaagggacccattttgtagcaaaggatgaatgacgatggatgaatgacaatggaattttcaacggttttatcatgtaccctgtcactcagaggcagccagtcaaaaataatgatggaataaactgttcaagattcaactaagttgagagttccaggaacataccctgcagagttaatgctcagtcctctagaatatgaaatatgctctaagcctgcatttaatatatatggttctgtgcatagtgggtggaagacatggatccaggaaatgacaggtaatggtaacattagtctttccatttgcagaattttggcctcccatccccatgagtcctacctcttctctttaactatcttattccaatagacccaaagaaaaagaaaaaagttaatatatgagtagatataattaacccataatgccataagaagcctatttgctgctacacagtggcatctggaagaagtatgtttgcagtgctggcaattcagtggagtatctcctaagatttactgtacagtaataattgtgaaagggcaaatacagcaatatagtttcactagggcaaagtatgcaatattatcatctcttcaaggaaaaatgtctggattactcaaatagataagcaacctggaaaagtaaaattagtagtgaagcatgaagaaagtctagatttggaagtaaagaaatgaaatgatggatatgaattacggcttaagacaagttcagtaagcttgtgaatttttttctctaagtctgttacccttaagtcattgcagggaatttggctgacacaattcagaatctgactttgttactgattggacttaaagaaggtcatgagtagatctgagtggttcaaaggaggaactatattctatgccttgtttttctgcatcatttcaaatattctcatcctgaccaaacattcaagctaatgcttcattcagcctaacataaatattacctgacagtgatccatttctcacaattctcatttcccatccagcagtttctctgatactgagtactcacacaaagctgactcttactcatataggtatgtactctagatgtgtagaagagttaatatcccacaggacaaactttgaccaatatgtggggtggccacacagtctcactggctcaggattgatttcagctataccagttttttcagttactattattaatactttctcctttcactctggttattgtcctgttttacataatggggtatatggtcaccttgttactaaggtatcggagccaatagatagatgcttcttccatgcttaattcaggtggaaagccctgagaggcatttgatacactttaaagatgtctctatactattgaacacgtattcctatatggtgttgaaaaactcaatacatccttttattggcttttccttgctccatttttaactcacactgtgattactgttttctgagatcacgttttgaaatgagtggctaacgtgacaaaaggcaaaaactctttgactgaagctccgctcttgggagaacccagactaagtcagcttggtttcaataagtgataatattgtatcgactagttatggttccatagaaaatcatttcaaaattcagtggcttaagacaagaagaattgatttctctcccatgtatacaagatggatgagggtaaggtcatctaggctgtgcttagttgggcagctctgatgtttactgagatctttggatcaacaggaatagctctgttccaagtacttttcatcctccatggattgcagtttagccaaagtgagtttttctatggtaatagcagaggtaacaagaaggtaagaagaaacacaaacgacaattaaagcctaggcttatagccagcacgttgtgacttctagtcacatgttattggtcaaagcaagtcacatgtttaagccccaaatcaaggggcagagaagtatactccatctatgatcaggcaatggcaagagtgtatgtgcagggaaaggtgaggaattgagactaataaatcaatctaccatatgattataaaagaaatatcagtatatttcctgtgaaagaaaagcctatgacgtatttctggtaatgatgctagtaggccaataggtaaattctatttaatgggaactaatgactctcatgttttctatgtctaaacatcaaagaaacacaacacaacaatttttacacttcataaattacaaacaaacaaaaatggaggagacagaaaagttatttaagagactacactcttgatgcatagtaagattttagagggtatggcttctgacctcttcattatgcctgggaaataagatacagtaataattattacatgtggaacatctctcaatcttcagagttgaaaaaaattagagtagaagaggaatagcattaatgaaatacatttattttcactggggcccaagcaatgtattctataatttagaaagatcacaatgggctttatggtaaaaaatacctctaaaataataagccttgcagagcaattggcactcattaaaattcagtgttggaagcagcaggtggcaggcagtttcatggaacaattttgcagtgtccttccagggttgaagcaaaacaattcatgtcataagataccaggtcttacccagtccccattttaagttgccgtaagtaacagttcctctatttttatatgaatagattcaaggatcttaaattgaatgtattacaatagctttctaaaatatacattttcctaccatgtggtagaaggtgaatatatgcatttcacttactattttccctttgaaaaggaatacgtttcacggcaaaatgttgttacttgtttttccagagggaagtgaaatttgaatatctgtaaaattacacatatgtggtataagtgaaaaaaattgttttgggggcaaaagactaaggaaattgttatcaccctcccttcaatgcactttttcctgagggaaagtaaacgttgatatgtgcagtggatttctcttcatgacactctaatccctaccactccctcaccaaaaaggaaaagaaaaggcaagagaaaaaaaaatgatttccatttcctgggaccatttaatattttctattctttaccaaagcaccgtggaggtttgagacaaataattacattcagaccattttcatgaaaacaagcagttctttgaagaatgtcggacttaactatctaattaattgttaaatcttggcagttatagcctaaaacgttacatatttaagagaaactttttactataccttcaacactagaaataaccataaaattatagcacttattttcgccttctatttgatataccaatggacatagcaggggactcttgacaagaggtttagaatacaaatgctggggttaggtggacttggattcacatccccgtttatctttttaccgttgtgtgatcttggcaaaaacctcaattgctagtcaaaggtgataggaatatctgcctcatagggttgttaccaggactaagtgagattttggatttggtgtctagctcacaggaagcactcagaagattatagaagattattcatattttggtaatattagaagtgtctgtggtgaatagaagaaaagtatgttatagaaaatatttttttaaacaatggttatttagaaaagttgtacataccaatgggcataacaaacaaaccaaagcaataaataacaccgagacaatattactcatgttggtatatgacagatctttaaaataattgtgcatgttcaataaattattatgtgttaatctttgcttttaatttatttggagaaaaaactgtcattacaggtttcttcacaacaaggcaattatttaagagcaatagtcaataatattttcctgtaggaggcagaagtagatcagggttttgtggagcctgaagtttatagcattttgaatgcccacttcaagagttggcagtgaagagcaacccaagtatttcactggaaagtatcaggaaaagtacagacattggatttttccccctctttggtaaggagagaagaggaaatagcagctataggaagaggctccccttggggccttgagggattaaaaaaaaaaaaaaaaaaaaaaaggcagtgcttcctggttcactgaagtggattttactggcaaagaaactttgccacagcattccttcagagaaattctacttgtgagcttctgcctaatgtcggcgtccgccaagtgatgcaattccactggaatgtgtgcaactgaactgttgggatcaatgcctttgcaaacctcagaaggaaaacatatattcagtacaaatgttagctgctacactaaatacaaatgggacaagctaccctataaaaagacaacgccaattttttttcagtcaagctgaatgatgtttataagaaaggcatctaaaacagtgagaaaaagtgttaatattctagtatatacaggaaaacaaaaaccagaaagaaaggagaaatgctgaaaataattcatgtcaaggagatgtaaacatatttaaaaggattcttaagatgttatataatcataaaaacaaaatccactagagatatttatatatgtagtgtgtatatgtgtgtgtgtgtttgtgtgtgtgtgtgtagcctttatcgatgaaacagtttagcagcagaatatatagtacaaagcttcttgaaagataattgctccatttgaaaaatatttctgggaaatatttaagataccgctcacagaacttgacatgtcaagtagacaaaatgtgagaaagagtatagcgatttgaataataaaacaatattagtctagattcttgagtcaagctgcttaggttttattcttcccccactgtcacccagttggatgttcttgggcaatttagttaaactttttatgttccaattttcttgttggttagattttgcaaataatatcaaacccatcaggttgttataaggattgaataaattgctaatgccaatgtaatgctgaagacactacctgacacataatttgagttatagaagttgcctatcaatatgttcatcatcgtcttcatcattgtccagaaaaaatataaatgaataaaactaactcagatctataagaaactaaaatgtctaaacataaattgagattagagaggtgattgtttcactaaaatcaataataataataatgtacacaacaatattttggtagaatgatagacttattgattttattttttcaaagcctttaagagaatctacagtctgtcatcatttaattcattaaaaatcaactttattgaggtatactttacatgaaatgacatatacccatttgtctaggttgataagatttgtccaatacatatacccttgtaatcactgccacaatcaaaaacagaatgtttttattacccgaaacattccctgttgcccatttgcaatttatctctttctccttatccctaaacaaacattctgttttctgtcagtatagaattgcttttttttttttgatatctttctcttagcataatagctgtggaattaatccaagttgtgaatatcagtaatttctggctttttattgctaacttgtattacaattatgcattcaccacaatttgtttatccattaacctgttgatggacatcagtgttgtttccaacttttggctgttataaaaaaaatttgctataaaatttccttgcaaaaatttctgtggacatatgctttcatttcttttgggtgaatacataagagcggggtttctcagtaatattactttaagagtgccagcttgttttacgaagtaattgtagcactttatatttctaccagcaaggtatgagttccaattgtcccacatactcaaaatcttttggaattttcaatgtttttattttattttattttattattattatcattattattttgagatggtgctcactctgttgtccaggctggtgcacagtggcacaaacacggcttaccacagcctccatctcccgggctcaggtgatgctcccaccttaacctcctgactagctaggactacaggcacctgtcaccacgcctggctaattttttgtatttgttgtagagatggggtttcaccatgttgcccaggttggtctcaagctcctgggcttcagctgtctgcccaccgtgtcctcccaaaatgctagcattacagctgtgagccaccagtcccagactgaattttcagtggttttcatttgagcctgtttgattagtgtctagtagctgtgtcttgcggttttgattggcatttttaaaataatgatgttgagcatcattttaatgggcttaaatgtcatttggatatctttgctaaaaatgttcatttttttttcattttctaatgggttgcttatttttttgttattgaggtgtaaaaatttcttaatgatatatttcaaaaatcagtctttttaaatttaatgaagtccaatatttctatttattctttatgttctgtgtttttatgtgtgtgtatgcacatgagttttaagaaatctttgcttaatcctaggactcatacattttctttcagaagtttttttttttttcaacttttattttaagttcggggtacatgtgcaggatacgcaggttttacgtaggtaaacgagtgccatggtggtttactgcacagatcatcacatcacctgggtattaagcccaacattcattagctattcttcctgatactctccctcctcccacccgccacgatgggtaccaagatgtgtgttgttccccctccatgtgtccatgtgttctcatcatgcagctcccacttataagtgagaatatgtggtgtttggttttcttccagaaaatttaatgctgtacctttaagtgtgtgacctatttcacgttagctttttgtgtgtggtacgaggtaaggattaaggttaacttttttacaaatgaatattcatttgttcaagcaccatttcttgaattatgatgcctttatcattgaattacctgataactctgtctaaaatccattcacctaaaatcggcacatatccattagcacaatatccattgaattacctgatacctttgtctaaaatccactgtatatgtgctgatctgtttttgaacacttaattatgttttgttgacctatcctgccaacatcacaccgtctttatcgctctattactagtagtaaattgtaaaaatcacaggatatgtctgccaactttgtttatcattcgattttactttcttggttaattttattgctacataaattttagcctcatttgatgattgctacaagaaaatctcctgatattttcactgagattattttaaagctaaaaacctattgggagataattgacttcttaaaaatattgagtgtttttgacccatgaatgtggcatatttctttacttatttaggtcttaattaattttccttagtaattctgtgtagcctgtagtgtacagaccttgttttagatccttgatacccacacctcctcccccagtgtttaaaaattaataaaatgagaagatatcagcaaagggatctgagaaggagcaggtagtaaacgagaagaaaatttaagaaattaagcaaaagcaatgcttaaaggaggagtacttggtaaactgtattacttgtgagtgatacatcaagtaaaattaggactaagttgaccattgcattattctatgcgtaatttaatattgactatgaccagaaacacttatgtggaacagtggggacaaaagactaatcaaagcagattcaagataaaatgagaaaagatgaatggagacagtaagtacagagaattccttcaaggtgttttactataaacagaagcaaggaaatgcagtagtagacagaggaagacggtatgttaaaggggtgctgatttttaaaatgggccaactagcagcaaatctctttgttgtgatgctacagaaggtagggagagttgatgattccacagagagagacaagtgggtagaatggtcccttgagtagaagactatctaaagcacaggtggatggcttggtctaaggagggagcacggttcacctcaagtaacaagatgaagggagagtctgtggtcacaggggccaagtatgtgactagatgtagtgacaggagcttattgaagttttcttctggttcttattcctttttgggtaaaatagaaagcaaagcaatcagctgtccttgaatatgagtcagactgttggagatttgagtaaagggatattctttaagcttgaatgaatttctttccacaaaaaaaaaataaagcctactacataatgattatttttcttaaaactctgcagaaaaagtcatcttggcatttttacaaataaaatatatttttattcctacagagcaagaaatacttctattttttttaaaaaaaaaaaaaagaggcaataaaaacagatattctttctataaaattattagtctagtttgccttcttatgaattgggagaaacaatagggtagcccattttgagtttaccttgtgttaggaagcatcatctcctttctaaagcctcttataatgttggttagaccctgtgaagaaatccataggacatagtcataaaatgtagtcatagaaaccttcttgctcatcagatgaaagtaaactgaggccaagaaatatcttttgacttatttccatttgatttggggatttcattttctcagtatccacttactttaagatgctaagagtataatttctttgtatgccaacatgaaaataagtccaaactatcattcttttctcatgttatagttatgtttgtatgcactagagtctcagtgtgcatgtatgtgtaattcctattccttagttttcatccttcaagcagttagtcccttcaaaacccgatgacaagacccaaacatattaaaaagtttagttggagggcccagggtgaaacacaaaaacaattcttcttcttacagagctcttaggcaaacacatagacacttgttctctgcctctggaattacaaatatgttactcggaaagcagcaatactcttttggacttgtttgacttcactttctttacctgtctttaagaagcctcatacacacatttaaaaaatacaacttataaaggttttagtgatagtgcatacaatcatttgattttatttcccttttctcttcaccttcactaataggagttactggcatgcttcaaaaagcttacatttgaatactgtctaaatcagtgcagacccttgaccagcttaatctttgcttgcaaatgacaatgcagtgaaaccagaggaagaaaaaaattacttcctttcctgttggaaacctaataagtagttagtctgacccagttttcaataagagagattttctgatgacccgacaggagtgactatctccagtcaaagaaagaggagggtgaatttaatctttcatggccctggaatggcagctgctctcagctctctctgattctgtgaaggttgatgaagatagagctggctttcaatgtagaaagaattttccttttgaatattccaaacgagagctttgcacatgtgcctcaagaactgattgtctggctccgacaggaatgcagcaggagaggagcgtatttcatgcttaagaccagagaagagccacgcaatactcagtggataaaaggcttgcagtcccagctgggaaaaagagtcccattatctcccagctgcatagacattccatacggcttggttctgcctggacgcacagcatgcctggctgagagcttgaaacagagttctgcagaaaaactgtaaagatcccgagacatttccctggtaagatctgtaagtacaaaattgtgctgtgtctgctgcaatgagaatattgctgggcaagctgcagcttttcttcctttcaatgtctttgtattagcataacaggtaaaagctggggttgggggagaagtcactgctttattgatgctgtgtttctatgatgctgatgtttaaaatgcatttattccttgtgtgggagaaatgtattgaatctgtattccgggaggttaggatcaaaccagggaaagaaagactacaggtatatttctcagtgtttcactagtctttgctgcagtaaaactaatgggcaagacgggatgacagtgctaattctgggactttcagatggctacacgccctttctgtaacggcagatgggaaaatgtgatcgctaaatgttttttgtcttttttttttttttaatcaaagggatgaggggtggggtttgcagttctcaccggatgatttaaaagaatggttataaagtttcctaggggagaatttggtaaggggagcaaagcaagactggaggtcatatgggctcaccaaattttgtctggcattttgctttatacccagcttctagataacagcctctggagtttcctttaccatttacaccagttaagttgtcagtattaaggttcttataatactttatgaaaactttcagaagttgatgacttgggaacaaaacttttaagagctctgagattagccacgtataacccattatgttaatgggatactgtaacattggggtttggggggaaaattggaattcatagtttttgcttctccaaatgaaaactacttatgtttaaataatcagcatcctgactatgtcctctgagaaacattcacagaatgactaaatagaagttatactgagaaaaaatagagtgaacagtagaatcacacagaatcaatttggaaaatgaggtattcataattttatctacagtggcaatgttttctgaagatgtctgtaaaagaagaagcatatgctgaatattgaattgcttgttttgagcaattttcatttatctgatgggtttatcatctttttatttttgttgttgaaggtttcaccaatttatgtgcattgtattttataaggaaagaaatgtttaagcagactctttttccctcctccttcacacacatgtgtaaacatacgcatgttcacaaaacaaacataaacatacaaaaatacttacacaatttgtgtaaaaaaaaagaaatacagaagcatttcatctttgatgtttcagtggggtttctttttctttttttaagcaataatcatggctgtgcagtccaaagatttcaaatatataaatgtggaaacttttatataaagctttatgtgaggttatataaatgcataacttatcacatcttagcaaaaaagtcaatcatttataaatgacttcattgcattacttcctttgaatatttgtagtgaaggaccagaatttttttttagaatttttatgtagctttccttaatgaaaacaaattcacttgtttacttagaaaaggatcacatattttctctgagtttagaaccccctctaaaaaaaatcaattatgttgtgaaaaggatgtgtggtatattaaattgattgcatacttctgggttttttttttagtaagtaaaaatgctcagtagtataatagtaaatttgtaccttttaaattcttttatgtgaggagaaggaatacaaaatatttgcttatttattcactgtttattttaataacatattaattggaatgcagaagtataagttctacctattaaaaatgactcaaactatacataaaagttcaaaagggaaaacccatcacctgtaaataacaatcatgaaatttggcgactatcattggagacatactggtgcctaaattcagataagatgagagataaatacttttgtaagaatggtttcttactatacaccttttaaaaaataaataataaatatttagataatatagtcaataatagatactcttctgtaagaatgagatcttatcctacacttaaaaaaaaacagaaatattggccgcgcgcggtggttcacacctataatcccagcactttgggaggccgaggcgggcggatcacgaggtcaagagattgagaccatcctggccaacatggtgaaaccccatttctactaaaaatacaaaaattagctgggcgttttggcgtgtgcctgtagtcacagctactcaggaagctgaggcaggagaatcacttgaccccgggaggcggagcttgcagtgagcagagatcgcgccattgccctccagcctgggtgacagagtgaaactccatctcaaacaaacaaacaaacaaacagaaaacagaaaacagaaacattgagtttaatttttgattttagattttaattaaactgaaaaaagagaagttgaaacaacattgaagaaattgttaaatttcatgtatagatttctctccaatggagatattatgtccagaataatacccttacagttaagaccaaaaattttgaaaatagaaatagtttgaagatttttttggatgcacgtttaaatagtaaacaaacttttataacccttgttatgatagttaaatgcatttgcaatgtgacttgtcatcaactccacccataccacctcaatttaaactacatcagttttacattactgagtacatacattctggctgaattcccatggtctcagtttaaacttatttcaaatttgtaaggaattatcctttatcaacaggcttttactacccaattcaccatttctgtgttctttattttcaattattttttgggttgttagatttcagtaagtagtacctctccaccaaagaaatagtcataggtgctatattttctatgagtttgcatcttgaacatgtatttcttttgccttagacatgcaagatacgttatctttcttggatcaagcttaattttttcttttggaaatgtgtaaatgtttaaacatttttggagacccttcctgtactgaaagttgttttgcaacatttttaggtctgtctgcaatttccgtcattgaatgtgacttgctttttttctgataaatgcctacatgattcttttgttgtgtgtgtgtgtgtgagtgtgtgtatgggtgtttgcttttacagaatattcctggatttgttccattttcattaactttttttgaggtttgccccattaatttaagattcttttattttaggatttgttgtactatttcttttttgtcccttaactgggcgtggccaaattgtggttatcttgcttctttcttttcttcaggatcaccaattttgtacatgttgtatctcatttgtctactttccacatctttcatatccaaatttcttttcaattttaattgacaaattggttatcttctttatttgagaaccacttgttctcttgtttgccacttgaatgaatagtatagcttgcaataaacctattaaggcacaaccttctgtattgtgatcttgtaaatacatgtttccttctcttaacactctagcaatttcctcagctggcaggtttttgggcaatctgtatcctcctgaaagtaagagaaaaagaaagtactgatcggttttctctgatgtcccccaaaggtccatgatttttagtatttggctacagtggaaatgggcttcaagtcgtgttttggggttttgtccactaacattttcactgaagacggagggtttttgcttcgttttttatctgcaccacgaccactgccaccttttatatttctctttattgtttctgtgggacaatagaggacatttaaaaatctctttatttaaggagttttaaatagcaatctttcagtttggaggaattctttgaatgaaaattttattagaatgttgttattctcagtattcatattgaaaagagctgttctagttaagactgagttcatctgcatgatgtgttgtagtattaaacatttattacggtaaaggcgtaacacaggacatagtagaggaaaaacagagccattgggcatgccttctgataatgtcccctattagtttatattgatgaagtctgtggcctacttaactattttgcaatgagtcctaaggtaatttacagaaacgttacatcatagtaacatgaatcaaaatctgtagactcaaatcctttttgaaagtatactgagtagaaaacttatatgtattaggtttacaattaaatgaataaatgaatgaataaataactgaatttccctatatttcaaatccttaaaagaggcaataaaagaacatgatgtgtcgtatgaagtattataaaaaacgaatgatcttactaaaaagcaaatagcaatttctcagtgtcaataaaatgatagtgagagcaagattcaggaggcaagctcttgagctgaagtgccgcccattgtagatttccttccctatatctagcacagaatagctctgtggtcttaggcaagtttcttagcctctttgtacttcagtttccccattcatagtggagataatattagtattgactttacagtattttcaagagaattcagcaggtaaatatgtaaaaaatcttggaagaaagcctggcaattaagaagcactctatgtgttagttgtttagttattgttatattattattgctattataacatttatatatgagccttaggatcaattgggtaaaaataatataaaacaatgaaaagactaaaattataattatcatctaatcaattgtattgggtatttaatagagaattaaatttggagtgtaaatcataagtggatattaaaatagagctcaggaaaaatggtgagaagatatagagatgctggtctctggatccaactagattaaaaatagaaatggtatttctgtatacaccaagcaattggacatgatcaagaaaaagggtatatttgcgggggggggagggatagcattgggagatatacctaatgctagatgacgagttagtgggtgcagtgcaccagcatgtcacatgtatacatatgtaactaacctgcacattgtgcacatgtaccctaaaacttaaagtataataatactaataataaaataaaaataaaaaaaagagaaagggtatatttgattttttgattataaaagcaatgaacagaaaagcacgagaacaaataagccagaatttctttcttcaaagaaaaacatcacaaatacttgtacatttctttcctgttgttttatgttgttgttgttctttttttatgataatgccttaatcaagtaatgtatgcacctggaaacaacaacaataaaatttgaaattatagagaaaacaataaaataaaaaataaagacctttccatgatttcctgtcttatttcacagagatattttctatagtttattttattgtaatgttttccttctggccaccattatacatttgaataatatatttgacttctattgcagaatctataaactcaacatcatgtctgctgactccatttttttaaagatgggcagtttttcctattttcacactttcacaagacaattttaggtgttacataagtctttgaattcttttggcagtaatgcacacacacacacacacacacacacacacacacatatatatatatatatatatatatatatagtgggaaattttaagtattcaggtaaggattaaatttaataatgaccaattcccacccccagaattaccaaatgctaaattttattggagatttaacatcttcagtattcataaaatgaaaatactaatacaatatataataagggcctacgttgtaactctacctagtccattcctcattctacattaccatgaattgtatatttacatataattgttatatatgtatgcctatataaaatattattttaaaatattatggaaatagtatattgaaagcaaacttatttaacttgtgtaactcattccatattagactatttagactcattcttataaataaacacatttcgccgggctcagtggctcacgcctgtaatcccagcactttgggaggccgaggcgggcggatcacgaggtcaggagatcgagaccatcctggctaacacggtgaaaccccgtctctaccaaaaatacaaaaaattagcagggtgtggtggcgggcgcctgtagtcccagctactggggaggctgaggcgggagaatggcgggaacccggggggcggagcttgcagtgagccgagattgagccattacactccagcctgggtgacagagccagactctgtctcaaaaaattaattaattaatttaaataaataaatacagttctaggatatatttcaccttatgtgttttatattcttattattcattcccttattgagggatatttaatttattgaaaatattcactattgcagtgttctattatcacatacattgaaaacttatacacattaagtgagattttcattaagaatatcaagtccgtgctgcatgtcaacaatttcatgtttgttatttctggtctcagaattcctatgtttcaacaaatgtacttaattcatccgcacctactatgatgttgatgaagttggacttatttcttacttcttacttcatattcaaccaaagtgttttttagtaaacagtcttttattggtttgaggaaatattctttattcattttttcaacttttattagttaaaaatggtatactccctttatcgtattttagtaaataactattttaacataaaatgtacttttatattttcaaataaagactaaagatagtgtatatatcttcttcataaacaggacaatgacttgtttaaatttactctgagatatttctcccagtgctcatatttgcactatttatttttaaactgcccccaatatttttgtcaaggtttttttagacttatgacgtgatttcctgagttctttatttaccatattcttgctatttatgtgcatctcctagattctcttcttgtgctctgaagaccattttaaggtcattcaaaaattgttttaaactcccttaaaatttatttgttgaaaatcgcttatgttagtcacattctaaaataatactgtagttcatcagagcactctatgtggaagatacttttctctcaacaatttttgcatattctgttccatgatcttctggaatataattttgctcatgaggggactgtttatgatgtaattatcacacttttgaataaatattcgtcttttcactcggacagattttaagaatttctctttgtcattgatttcttcaagttcactgcaatgtatgtagttgtggagttgtttcaaatttatctcatttaggcctctgcaagctcctaaatctttcttccattctgaaaaattctcagctattatatatttcaatcttgcgtcttttaaatccctttattttctccttcaggaatgctcattcattatttctaggcttctgtctttgatttctttgcatttctttcattttctagtgttgcagtcagtgtaatttctaccaatctgtattttatacttttattttttaaaaaacagttttaatttctataatttatattgctcttttaaaaattatcctgctattctgcttgttcttaatagtttctctcccattcttaagctctcaaaaaaatttcagtaagtttattttagattgtgattgttttactattttaatttttagagtcaaatttctttattacttatgtctgctggatttccctcatggtggttcattcttcctggtgctcataatttttttatgacaaattcaccttcaacagatgttgttttctatgggagaccaaccttgtttgagttgtgtatgcttttgcatagcatcgcattgctattgattctacagtggctctacaaatatctctggttctggactattttatatgtgaattttttggcttcaaattatattaccatatagacagaatgaatttgggccctacaaccaagcatagtacacattctgggttctgattgcctttttcggattcttttttctaccagatcaccaagtttccataaggtcagctatgtaatgcaaaggacccctttttgggaggttattccaactttacaatctccttgccagtctgagtttctctccatttggtgcctctgagggcttacctctttaacatttaacctcggctatgtgtacttcttaaagagttttatacttacatagcatttacatgtgtttgtagtggaaaagaaatccctcttcacgttgcatggtgccgtgtacttccctatacttccatgttggctggacttgttcccatccgctttccatcatttagaaagtcatcaaactctcacttgctggtattttatttttatcaggtactcttatggtttcatggagttattttgtaataggcaatggaacatttgctaatttttttctggaaacattgtcaagtctcaggtatataatctaataagaaatggttaatgtcaattgtatatgtctttccattggctccacaaacattactgtaacaaattaaagtgcttgttttagtccaatgacagaatatgttagggagctctagaatttagttagaaaagcaagccagtggatgttattagtttatatattctttgggagtggcagctctattaattccttaagtttaatggtatgcaaattcttaaaatctagaggcaattattcaaaaactttgttagcacagcaattcctagtgacacagtacaagctgaatgctaaacggaccatatttttaagatgatttctgctgaataaaagtgagaatattggatgggtccttttaaaatccttttttaaaagtcttcttttaaggcgggaaggagagatcaaataagatatttggtgaagtttctagtaatttatcattcatgcatgtaagaggccaacatgaatgagctctcaaaagaatgtagacattttattttcaatgccttttttgcatattgtttcaaggtttatttggtttcccatatttgtatgtctaatgtggttgtgtaaggagctctatatggagaccgctgagctatctttctaaatagcaggagtgcaatatacttgctggaatagagcttttagtgaaagaacatgattttcctctctggcatctatcagggtctcccaatcactaaagcacagtaaatgaaagagaaactcagaaatcaggtgtgccgctaattttctatcaacagagttaagaataaattaagaacagtcctgccgggcgcggtggctcccgcctgtaatcccagcactttgggaggccgaggtgggcggatcaccaggtcaggagatcgagaccatcctggctaacacggtgaaaccccgtctctactaaaaatacaaaaatgagccgggcgtggtggcggcgcctgtagtcccagctactcgggaggctgaggcaggagaatggcgggaacccggggggcggagcttgcagtgagcagagatggcgccaccgccctccagcctgggcgacagggcgagactccgtctcaaaaaataaataaatacataaataagaaatagacatgcattaaaataataggtaggctatataatacacagaaaacatttatacaaaattaatgtccaggccgggagctgtggctcacgcctgtaatcccagcacttttggaggccgaggcgggcggatcacgagatcaggagatcgagaccatcctggctaacacggtgaaaccccgtctctaccaaaaatacaagaaattagccgggcgtggtggcggcgcctgtggtcccagctactcgggaggctgaggcaggagaatggcgggaacccgggaggcggagcttgcagtgagccaagatggcgccaccgcactccagcctgggcgacagagccagactccgtctcaaaaaataaaaataaaaaaaaaagaaagtccttaaagttgtgctgagatgaaaaagtttctgttattctagacttgatagaacacacttgtttaaagtggaacatgaaggtgttttctaggcatttaatgtcgttagtcaattcctaaacatgctcagttgtgaatctgtgttgctgacaggtagaattttgacagccctatatataaatttaccacaaaagtatatgctgaaaatggttctattagaattagccggtgcttataaaatataattttttcagagttgccgactttccttttttgttgtccctttgtgcagactgtgcctatgcggtttgtagaaaagagaaggaagttttctatctgctttctttagggcacttaggtggcaaaagtattatttttactgacttcactcttattctgtcttttgtcatgcagatgtacggagtgattttgcaataaacagaaacaactttctcatagaaaaagagagactggagtttaaaggaaaataatctattcgttatgcgtagttcaacataggaagccaaacagcagtttttaagaaattacacacacaagacacaatgcctgagccaattgcttttaccattagggggctccttttacttatgaggcaaaagtcatttttccaaagaaacatggaacaaaaattcattttctgccagtgaagtttcaagattcacatatatctttaggtatccaaaaataatgttagtctttgagtattagcccccggatgttattttcttttatgattttttttctacatgaaacggtcttcaattcgtacaaaaattctagttaattctgataaataatttaacgtactaaattaccaatattaataatatttttattcaacaatatatattagtaataattccacaaatattggctgaatacttactatgtaatagatgctatttcaggcactagtgatgcaactatgaacaagacagagaagagttctgctcctgtaaaattcacatctgatgcgtattcttgaattcaatgaagtatacaactctaccaggtggaaaggggggctaacattgttaattttcggtctcacctgacaaatgagcattagaagccattaaattatttaattccaagatgattattttagtaaagtaaacttgcatagtgagatgcaccaaaaagactaaataaaaagaaacatatatttactaagaataataattattcctctgtttttatagagagtgagatattctgggtttttcagaggattaacaaaaataggatctcacattatacacatgtttatggaatttcctaatcacagacccaactctttccctgaaaggtattcattttcgtcaagtgaatagtaccagtggatttactaagaaggtaaaatttgttcaaaatttgcaaactacactaaattattgaataaccttggtaaattagtacgtatataacaagtgaaggaaaattaataaccaacagaatatcatttaatacatttttccagttataaaatcatatatgtttattattacaaaatttggagaagacaaaatatgcatagattgttattctattactctgcatgtggcatcctttcagtcatcttgtatatgtgtgtacgtgtgtgcgtgtgtgtgcatttaaaatacaaaattgaaattaatgcatatgttctgctttatagcttgtttttattaattaacatcttataaacattctcaagtatcattaaatattctcctaatgctgaaggatttttcaccagatgggtgttccctttttactcaaaccaataacctattgttagatatttatcttttacacaatttattgaacaatgctatggtacatatccttgtacctgaatcttttaatatgtgtctgattatttcttaaaaacaaattcctagtagtacaatttgcatgtcaaattgtgggtttttaaaaatgtgagtgtgtatattactaaattgtcctttaggaagacaactccctctgtacttgcaggcaggtgagtgctctttgtgaccatccttgttaatactaaatattattaattgtaaatactctccgattggattacaaaacaaatacacagataacagtatttcagtattgctctatattacattttttggaaaatgcatgcctgaatgaatatttcatgagtgtttgaaccattcatatctgctcattttgctgaagtcagcctctgtcctttgtttattcttttgatattttacattttttcttatgctcaggaagttcatcagatatcggtgagataacttgtaattttcacttttcttcaagtttataagacatttaacttattacattttaagtgtgaaaccttgaaaaatgttttataaattatttgaacctcagttttcaaatgtacacagtgcagccggtaatacctgacctggctttcacaaactcagaatggtcagataaaaactgaaatagttaatgtttctaaatgtatttttatagctacaagtgatataaagttattgttctagtcttattaaagataaatcagtgtttgtccctaattgcacatctggtcataagcaagtctacaacttaaagtttcctaaatataggtccagtgttatcaactttttacctccggcacctagcattgtctggcctgtggtgtgtgatcattaagtgcctgcttaatgaatgtagattctaagtatactagagaaacataaattaaatacatctgtgctcattccaagtatgctattacagtgtcatctaaatctaatggtgaacaaaatagcacatattaagatgatattaatgttaaacttcaatttatgcctctgcccttggtaaccatgataatccactccatgatgaagcagtcaggaaatgtaagtagttatttatttcatcactacaaattgtatttgagacctgtgttttggaggtaatctatattgtgggctcttcaggaatttggtatgttaggaaaattcaggactgcataaggggaacaggaataggtttgagggtaaaaggaaattgtaatcatccctgaattaaaaaataatttatatgttacagacaggtaaagtatacacaaggtgtgtgatattttcttcttcaaaaaccctccccaaatgtgagatatataacttgcttttccagatagtcagaacaagaaagaacttcttatttttgttttagcttgcatttacgttgccataacacattatgttaatatttgatgttatttgactttggcagaacataatgaaataaggtgtttgactttgccaaagagagtttttggaacaaacctgtgtttgatttagatctgaggccaggtgttcaagacgagcctaggcaacaaagtgagacccctgtctgtaatacacacacacacacacacacacgcacaatctctctctctctcaaactttggcatatttagtaataaatattaaagccatgaaacaaacatattttacttatagcttagaataatcacctttataaatttcttaagtgatttgtagtacactgtggacttgactgttacttttatatcaggttataagtaatgttggctagacgtctatccaatgaactttccctttcacttcacatattctctgggctcatggttagccagaacaatttagaagccaaaaacataaccaaaattatcacatgtatttttactgcatggtgggattattttgttttattgacatatatcattttggtcaataataataataacaataaaacagcgttgagttactcaaatattagttggggctcttcagagaaatagaacgaatagtgccacattatctatctatctatctctctaaatatatgaattttccctttctccattttctgttttattaagggtctcaatggattacatgatacctacattggaaatggtaatctactttactgagtcccctgactcaaatgctagttttatctggaaacaccctcacagacacgtccaaaatattatttaatatgggcaaaccatagcctagtcaagttgacacataaatgtaatgatcacaatgatactagtaagagaaattcagttgaccttgctgataaataggtatttttcacacaaaagccagaaaatgatcataaaatatgtcatatggtttaaaattataattgttgagtacccatttcaaaatatgattgttcatttgaagaataaattttaagttggttcaattctatagataattatgacatgactgaatatttattcatggcaaatccaagagcattcatttgcaattgccattcatgtagatgtcaaagatgccactttttattgcacatattgtgagagggtaaaacaaataacctttcctccttaaaattagattgctcattaaatgtgtcattaatcatattttagactccaaaagatcaaagtaaaatggctctgaattttaaattttccagggtgacaaaagctgaacagtttattaatgtttgaccatgctccaggtgtggtggctaatttctgaagatgatgttcctctcctttcaattgcctttcagctctcatggtaggtgctaatgtgtataattagcatgatttcagagttgtgacctgaacgacagaccaatatctataagggttgtggtccagccaggttagaataataccaaattgatatgcaattaattgagcttgcaaagaggttactgaaaggagttaggtctaaattgcagtttcaaaataaatcacccgaaattatttaagagtataactgggactccccaaaagttacctccatctgaaaggtttagatttggaatctccagttgtgatgataaatataattataattaaggctctgggtgttaatgtcagtgttatgcagaaaattaccctagacatagatagctcccagcatctacatcccgttttcaattttatttctaataaaaaaatttaatccatttgaggtgacaaaattccttagagaataaatgttttttaaccttgggtagtagaataaaatatagagacaatgacatatatcaaactcatggtattagaagttgtgtatcccttatccaaaatgcttgagaccaaaaatgttttagagtttgaaattttctgaattttggaatattcgcatatatataatgagatatcttggggattgggacccaagtgtaaaaacaaaattcatttgtattttatataagctttatacatataacctgaatgcatttctatatggtatttttaataattttgagcaggaaacaaagttttgactacattttgactgtgatgtgtcacatgaggtcaggtgtggaatttttcagtttggagtcctgttggtgctcaaaaaattgtagatcttgaagcgtttcagattttggatattgagctcttgagtgctcaaactgtaatatcattgagctgtttagaattaagtttgtattaattagaatagtttctacatgtttggtgtaaaaagtgcttgttatatttaaggctctaaggagtctttgccagatttgatttgtatttgcacttttaattttgtaaataaataactgattttagacttacccgtttaagttgaaaagtactgtatataaaaattaactaactttttagaaaaagttttgaaatatttaaaagaagttaagatttactattttgtaagggtaaatacaagaattaaattcttaggtttttcttgttaaggacctactgttgatttgtcagactgtttagacactttaagagaacataataattcaattttagaattaccatttaaaatatttaaagcaattgtagtaaagtaagtcaaaagtcctgattgtttatgtgtgtttagtctgttcaacatgaaataattgaattttaattgtggcaaaagagaagaaagtttttcttgttttaataagattataaaaagaataacagacatataaatgaggctaaaaattttaagggggaaacagcgtttgcatttgaaattataataaatttgatattatgatccccgatgagcactggggctctaaggggattcaagggacttgcccgagactacagagcaggaattcacatacagattttcatatacgaatgcagtggctgtggtttccacattcattctcaaaaactcaatgtacctttttggagatgcatgcaaaattgtagaggaaaagaaagtaatatttagaatatagtttctaatcttttattgttaatcttcttgtttacaatttaccaaggcaaaaaagaaacacttttaaaatgtcaaaataatataaatattatctaccattgtttttctattcccagtttaatagacaagtttctctgtgtggcaataatttttaactctaaacagagccagtagctcctctattactttggactttttaaaagatatagttattttgagtttgcattcacacatattctaacttagaacacacaaaaatttacattatttattttctcttaacatatttgcaaagatttagttatatctgcaaaaatgatatattttttattcttctatttttacccaagttgttgatgatcttctgagatccatctgaacagaaaaggaagagacacatacttctatttatatacacactcatattttgtgtgtgtatacaaccttattagcttcttgacaaagaaactaaagagatttaatttttaaatgcttcttcccatactctatccttttattataatttttaagtctttaattatttttacatatctcttctatatacaggtctttatagctgggtccctactgctgactcagttttgaactacccatcgatcttatcttaaaattgttgtctagttagtggagcatttatttatcagcttttccatttgcttgaatattttacatggccaaatatatatctgaccaatgtccttctttaggaacagtgctttatgtttttcacatctgatatttacatcaggtgcattcaaaaggcagtgaaccaagtcctataaaaacagatagaagaatcacttttaagtattaatgtcagaagaagagaattgctttttgatttaggaaatgtaaatagtcaatcttattaaaagattgactttaaaacatatccaactctgctaaacaatggaagaatctaatctttttttgattgaagaaaccacataaaacaggtataccatcatggggaaggtaggtactttctgtattactgtcaaaagacaaaaattgcctcttgacttaggattccataaacttttatggaggtgtgcatggctggaagacatcaataccatgcattgttccttggatggtgggctaggcacatattctaacctttgaacatttctaaaatagtatctttcaaagctggcaaatttggggaaaaagaaattccttatacagacgaagcttgaaggaaggtgatgtatgttgtaatgggtttgctaagattttcacttaatattcagcagccctgagaagttttcttatcttctactctaagtcagtactttgaaaaaaaaaatatgaggagcaggtttgacaatgttgtcaggattgtgattgagatgaagctagaacgatgtgcagttgaagtcctcccaggtcctgattcaaatctacatctgatttcatgacctctgctgcattcctctgtcatgagaagagcagggactcttagtccgatgacagaatcaaccttaccctttggttaattagaaggggcagtagtaaagaactcgaattttagagccaggcacacctggatttgaatacttgtcagatgaaccacttactacatgattggccagagacatacactttgatttcactggcctcatttttcctatgtgtaaaattgagaaataatagttgtcccacctcatatgattgtatggaggattaagtgagattattgaatctaaaagtcttagcacaatgtctgacatacagcaactagtagtgaatttcagccagtgtagcattattgaaattattatgaataagggactattgtagatgttatgcggaaagcagtagtcccctggggccatatagtgaaccccagtgctatttagctcatttctattgtctacgcattatatacagttcaaattagtaacaatcacaacaagaacaaccatcaattgatatagtttcaggcactttctttagtactttaggctaacgtatttaattctcataaaaacctcaaaggatatgtggtatcattccccatcttatagaaaagtaaaatgagattcagagatgtaaagtaaatcggttaaatagaaaaaacagttgttagattgtagagtcagaattcaaaaccaggcaggcttttgccaaaattaacgcattttaccaccacattcttaattcccaaacagagcaccaagcaccctaggatgcaacagtgaactcagagaaggatcataggatgtaattaaatattctggtgaaacagtgatgctcaacatctgtcaattactgagtgtgaggtagtttcatttcaacacatatcttattatatttctttcaatatcatatatttattaaagctgggtttccagcggatgttgtggtaaaaaggaaatactgtgtgaaatcagtgtagaacaggaaatgaggctgggcaatcttattccaagttttgaaaagttgtgccgtgcccagtggtagtatgcttgttgtaagtagaagtgggtacttaagaataaaataagaatgctatttttcctctaatatatacatattatatttttaaagcatcctgtaagtcacttgaatataacttctttgagccaaaatacttaaaaatggaactattatgtagttattttgccctaggggtgccataaaaatgattgatccactaaggagatcatgatacgaataagctggggaacctctgaactatattattcagtttatcagggaaatatgtaaaacttaaggatcagttcatcaaacctcattaaccacctgttacttctcaagtacttagagattcctttctaaaagagctcacagcatagtaagaaagatagacactgtgttagtcagggtcctccagagagacagaatcagttaagtatgtgtatagctattatgacagaagtttattagaaaaattgagactctcgattatgcagactgaaaagtcccaggacaggccttttgcaagatggagcccttgggatgctggtagcctggctcagtctaagttcaaatgcccccaaaccagggaagcccatggtttaactcagtccaaagccaaaaacctgagaacctggagtgcttctgtgtaactccaaaagctggagtttcaatgtcggaggcaggagactagtgtagcccagctctggaggcagagaccaattcaccttttctgtttttgttccatccaggcccccagctgataggattgtgcccacccactttgaggacagatcttccccttagttcactcagactcacatgctaatttcttctggaaatgtccttgcagacacgcccaaaaataatgcttcactagttccctaggtattatttaatccgatcagattgatccctaaaattaaccatcacagacacaacgtgcatactgaaatatagtgtgtgaaccaaatttccaaggggccagactcccaggcaggtcacataaatattcaaaaggccatagcattaagaagtgagaggaagttgtattggggagaaaagcaaacataagaaattttccagaagagatgaatgaaagaggtccaaatgcatgctatttatagaataatgagtatggtaataatggagcccccactaattacactatcacttattaaatacttgttacgttccaggcaatgcattaggcactgggttgtagagatgaaagtcagagtgactttcctcaggctctgacgtctcttgaggagtctgacaagaaaaaagtacattcaggcaaatgataagagatgagactggaaagcatggctgtggtagaagtaatatattgcctgtaacttctaaagaggccagggacttttagaataattaacacaaggtctaattactttggattaactagtaaccaaatgcattcacaaatattgatgttattcaaatttgcttcatcttactaaaaaagatgctgtatttgtgtattcttctgccaaataaatgagaggcatatgtatatttttccagaatcatgacttattcagtttatggactaattattggttgagaagataagtaaataacaaattatcatatgaaaaatgtgagactgggagtaattaatgcaataaaatagattgctcaatatgcgaacaacttcattgtaaattctaggaaaagggcctgatttcagaagaaagataaagtcatcaaaagtcttaaggattaaattaaaagataattttaaacatttactgctgtagtatttaaatttaatgattctggcaatgagactattgaatatatgctgtgttatatgtttaaggggatggactcaggtagttaggatgtgattattactgtcctacgccctctagttaaatcctgatagaattctagttttaactgaagacctctatttaatcataggctgcatcaagttgcagacacaattcatgaatactcatatataatggcatcatgctactaaaacacattagttaaatactctcactcactcaaatggtagaggagaatcatctttctaagatatctctccatgactacagtatgggcacagagcaaggacaatcctgtctcctacatggtcaccattcctttatttattcattcagtagagattttcgtgcacagaggcagctactgtgatagcacaagtattacagaattcaaaagagaaagagatgatttccagctcggcaatcagggaagtctttaagaagtaggtggcattcaactaaagaatacactcttcggttctgtgtggcttgatgagtatacaccattataatcgcagactttggcagaacgggagggttgaaataagataaaagaaaggagaagagcagtggcaaaggcagaatgactggtaacattaattgaagaattctttatttgtattcaccagtgtgggcctctttcctatttagccatcacttgaatgcacgttgtcattagcttgctttactcatcctatgaatcaagccttggagatgttgagaacccagtttctgtgtgtggcagaaaagtaaagagatgaatagaagtaatgacatagaatagcatcctcttgctttttccactattaattctattctgccagcagatatttagcagcttttttgtgttaagtcctatgtggatacaaatttaagaaatgacacattttctttctcaaggggatcacaggtcaataggaacacagggatctgtcaaagatcatgataaatgtaataaataagagaacataaatgtggacatagtaaaatggtagaccagaaaaggcaaaagataattattgatgatggtcaaggaagaatacttcgcaaaagtggtatttttagtctcaagacattgagcaaagacattttttttgctctggtcatcccataaaatgactctcaataatgaatagaacaagaaacaaaaaactaaatttcattttcaatgaaacataggagaaaaaagtcacactaaagtgctttcaaaggaggacaactggaagaagcaagtgaattactgtgcagactcccctagaaggctcagaagctgggcatcttaggaggcagtggtagaaatgcttaaacctaaaatagagggctcatctgaaagtctgtcacttagaccttctttttctctcaacctacgggaggttggaaaatatttgtaggtaaattgagctgcaggagcagcacaatttcagttttaagaccaaaaaaatagcagaaagctgggagtttatatgatccttctgtgtataaggtgaaagacacataaatataaataaatgtaacatatgcacataggctcttaaatacccatgtttagaaattccccagtaaaaaccagagttagccttgataacctaagaagaaagcccacaagtcaacaagccacaatgatgagcacagataaatgaatgtattgctagggttatcacatttgaggagtcctcagtaaaagaaggtaagaccccaactaagtaattactggcattatgaagaaagattaagaacagttccaaaacatcaccattttcttcatagagattttaaagcctttttcaatcataaaagggaagcttaaacaataaacaaaagggccgggtacggtggctcatgcctgtaatcccagcactttgggaggccaaggcaagcggatcacaaggtcaggaatttgagaccagcctggccaatatggtgaaatcccgtgtctactaaaaatccaaaaaaaaattagccgggcatgaaggtgcatgcctgtaatcccaactactcaggaggctgaggcaggagaattgcttgaacccgggaggcagaggttacagtgagctgagatagtgccactgcactcccacatgggcaacagggtgatactctgtctcaaaataaataaataaataaacaaacaaaagaacaccaacagagaataagaaagaatttgaggacgtttcagttatgatagccagactcacaacaaacaaaaaaggcaacaaaacaacacttattacaagaattgtaagataaaattgaataaattatccagaaaggagactggaaataaaaataagttgatgatagtagcagtaacgtcagaatgctaaagaatttttaatcctaaataaaatgatccatatcttggaaccatagtgatacagaggacaccttcagcaaatatgagagtaaaataaaaatcctttttgtattccaaaattatgtaaaatttattccctgtaatcagaaatctgaagacatgctccaaaaatcaggaatacacaaaggaagctaaagacaaggagtgtaaaacaggagagtcaacaaggagaaggattaagggaagtccattaataatagcagtttagcaggcctggagaaaaacaaatgtgtattgtagtagtgtaggaaagggcttcaaagaaataactctagcaaaatcgaaggaatgagtggattatctgacaggaactatcatgaggaaaattgtatcaagacgattttatagagtacttgaatagcaaaaacaaacaaacaaacaaaacctcttctgtagatgccaaaacaataaaagcaatgaaacttacaaataaattattaactcttaaataaaaaagcaaaagttgtttacaatgaaaatgtgatcatactatttgaatcttcagtggacaacatttgtataggcttaagcatgaaagtactgaatatggaatatggatggaaagaaaacctgatatagaattatattggaaaactgagtggagaatagagatacaagagggtcgtattgttacctgttaaaattggatgccaatggagaatgccaagtcatcaaatcttttttttttttttttttttttttgagacagggtcttgctctgtcgcccaggctggagtgcagtggcataatctcagctcactgcaacctctgcttcccaggttcaagcgattctcataactcagtctcccgagtagctgggattacaggcgcctgccaccacgcatggctaatttttgtatttttagtagagacaaggtttcgccatgttggctgggctggtcttgaactcctgacctcaagtgatccacctccctcagtctcgcaaatttccctctgtggcttcacaggcatgagccacagcacccagccggggaatgccaagtcatgaatcaaagtatcaccgtgtcatagacattatttagagatatggaggtaaatgccagggagaataactggaaaatagagtggatgcttacagggaatggcctagggaagagatttatattgcctttgttgttctcaggtttatttggcttcttaaacacacgtgtgcattacttttatataaatataaataattgcttaaaattagaaaaatgaatctctgacaaagatttggagtaccatttggtgtttaccaggtggaccaaggacagaagaacatggtagccagagaggtaagaaaggttaaaaacaaaaatcagaaacagtaagtcctgttcagggaactgcaggtggtttgatatggctgaataattaggaggcagaaaagcaatgtgttatagtggttatgggttcaggctctggaccctatctttctagttttgtttgatcggtatgtgacttactgtgtgaccttactaagttctttaacatctctaagcttttgtatcaatttctatatgtgaaaattgggaactttaatttgtactgcaggaaatgaacctacaacctgttagtatgcatttaagttcacctgcagatactactggagagttccaagcttctctccttcaagttcctgcattgctccctgcatctttgaggttccccagaacttgctaaccaatgcatagggcaaaccagaaatgctgactggaagtagcaacaagtgatttaatgttcccagaggtattcctgaactgatgaagtaaaagagtaggttgataaatataccaggttctccatccctttatacagcaattctaaagtgtatattatatagaacctcagtgggtctacagagaaactgagcttcagttctttgcagtgtgattcacaccattctgcacattttactgaattttctcccttccctgtctcactttctccacactctgatttgtgcttctggtaatcacttcccaaataagcccttgcctcaaggcccgctgttgaagaaaggcaatctaaacaaatacctatgccatgttttcaagaggattaaattatatgctccgtacttagtaaggctaaatatgtaactctgctgcggtggttgttaaatgccagcatacgaggaaagttcatttatgcctgtattatcagttaagttattatcctaaaggtgaagagaagcctttcacaaaatgagttcaatccacaggactcggtgactcactgaacacgtgtggtgaggagcggggctagggaaagatagtgctctgaatgactcacagctttctaacctgtatatgacctgtacggaatagtaatgctcacaagcaagaagcataatagaacaattacagttttatttctaaacaaagcctaaagtcctggtttcataaatgaagaaaataatgctgtctaggtaaacaatttggccaagattcacaattcactgatccaaagtcctaagtcccccaataatgtcctttttctgtaagttttttcaactatcattcatctttattattcttgtctcttgaggtcatgattggtgcacaggtggtcaatataggtaacataattgctgaaagaattaataaagatttatttcctaaatcgatccaattcatgttgttttcttctattcaagtactggtcacttggtctttcatatagtcatgtctctctaattcataatttaatggaaattattttggcaactccagcagacatctgagagataagcatagcttttgtattgttagtgttttctgccagactgaagaccttggtgttaataagatggctgctttccaatacctcttaaaaaaaaaaaaaacaaacaaaacaaaacaaaaaaacaccattttcctctctcctttttcttttatttacaaatgtaatctctgatccatgaattcataaggtgagaacggtgagtggctagctttttatgggaccatacataaagggctaaattcagtgatccatctcccatctttctaactacttagggaaggaatttgaaaagaagtcaatgtggcagatttgaaggagaggctgttggaaagtgtgccacaggcttttttacattctgtcttcgagacaatttgagtctgcattttttaagtgaaactattagtaacgtagtgatttcaggttttttttttttaagttggtagatgtaggtcataataggactataattttatttatttattgatggtctgattttaagcccttagaatattaatgtctaggaacatttgagaaagaataacagaaaaatcgtgtgtgtgtgtgtgtgtgtgtgtgtgtgtggagaatgtctctttggcccagataaactcttcgagctttgacatcttaaaaactctatgattaccatatttttatacatagtcagatacatataggttcatagtcctgagaactggttaaactgagttgtcttattgccagggtctgaggaaatttgaaagagagcatcatagaagacagtgtgttgaacactgttaggctagtaacaaaagaatgagagccacaagactaaaagagaattccacttgtgcgtaaacagaacttcagttactagataagcatggctttttcctcatttttctaccctttcctttattcactttccatcaccccccttagttccctccaaaatatgaaattgtcattgactttattaagatataactcacatataacaaaatgcacacattttatgggtccagttaaatgaatttgaaaaacgtgtatgcccatataaatccctgttcctccctatcaaaatacagaatacttatatcacccaagaaagtactttcacacttttttgaagtcaatcctaccacatttcttgcctacaatgactgatctgattttgatcaccacaaattagtgtttttctgattctagaacgttatataaatggaagcatgtagtacggtgctttatgttggacatttagttcagcacattgtcagtttcatccatgtatttacacaaatcactacctttttcctttttattgctgagtagtattccatatgccacaatttgtttatccattcacctattgatggatgtttggtttttttcaagtttgggcttattatgaatcaaattcctattaacatttaagagcaattctttgggtagatacatgttttcatttgtcttacattctactttagagaggaattgatgggttatatgtgatgtttatcttagtaaatgtttttgaaagtggttgtgtcattttacattcctgccagcaatatacgaaaggtttagctgttctacctcgtcatcagtgtttggcatggtcagtctttttagttttagtcattattctgggtatgaagtgctatatctcattgtagctttaatttgcatttccctaatgacttatctttttatgtacctattgactctacatattttactttgtaaagtgtttatgaaaatattttgcctatttgcttctttttaatattattgttttatatattttagacacaaccttctatcagatatatgtattttgaatattttctctcagcctctgaagagcaggtagtcttaatttttataaagtcaaatttatctatatttttatggttggtcatttttgagtcctaagaaatctttgcttatcccaaggtcacaaatattttctcctatgtttccttccagaattgtatagttttagtttttatgtttactctgtgatctatttaaaattgatttttgtggatagtgtagagtttcatacagatatcttgtttttctgatgtcattttttggaaagatcatattcctggctaaattactttctttattacaaacttggaaaagcctttttaaagcctcttagcttttatctaatggtagagtacataaagtcttctaaagtttgtttggagattagcattattcctttgaatattttctacatttctgattttatttaaaatatgaacatagtagataggacacatactacataatgatcattgtttaataatatagaaagtaaattaatatagccaagtcactgagttgggaagaaagtgtgtgcagttactggcctctttattttctatgtaactccctttcctttttctgtgtcttcatatgtatgtaaatatttcttgagaggtatgtagtactgagctactctattggaacacagagttaaacaaattgacaggatcattattgataggagcttcagggaaaacattgttagaactaatcattacaagttttttgaaattgaatctcttatttataaaaaagcacagaaacatcagtattccatagctcctttataaggtctttgtgttatgaagctcatgttgcaagatggatattgagtagtttgccatattaattttgatttgtatttatttgtaaatatgatttcatcacattaaaacaagagctacaataacagaactttaagtaagagttaaaaatattcaccaccaatctatttctcctaccttactgatttcacttgcctgtattcttttgctaatctttgtatatagtcagaatgtttatataaggataaccatactacagaaatggtttgcctttctgattttttttgaaacatataagattacaaatatttttcatgttgctacacagccttcatatttatccattttaatgactacgaagtagtctagtaagtgatggatagtaagaccatcatttacctattttattactattgttgagtttaggtaggccacacatttttgcttagagctgactccaaacatgagaaaacacatgtgtattgccttttccttctttgtataatttatatttagaatatcagcataattaagtgcttgagaataaagaagctagatttttgtattgaaatcccacctttgccattttccagctatttcactttgggcaggtgttctgatctctctagacctcagttttcttatttgtaaaatagggataataacagtgcctgcctcatatatttttcatgaagattaaatgaattatttttttgcaaatcaattacagcagtaaaatgaatgtaaaaactatataaatgtcttcttaaagttctggttaatggaactagtatattaatttaatttatattgtccctgaatgtatgtgcatatccagatataccacagtatgaccccaaccttgcaggaaatatacatttacaagaaaaaagaaagagagagagaggaaaagaggaagagagaaataaataaaggaaaaaaaggaaagaaagaagggagggcgagagagagggaaggagggaaggaggaaggaaggaaggaagggaggaatgaaggaggaaagaaggggttctcaaccagcggtgatttaaaaacacagtttattgaagtataattcccatgacataaaagtaaccgttgtaaagtggacaattcggttgcatttaatacaggcacgatgttgcacaaccaccactatcctcttggaaaacatttgcatcaatccaaagaaagaagctcttaccaattagtaaatttctccccattttctccctttcactttccaggccgcaacaactaccaatctgtcctctgcctatgtagatttatcagttctggatattttgtataaatggattcatgcaatatatgacctttgtgtccagcttctttcacttagtataatattttcaaggtttatctacgtttcggcgtgtgtcagaacctcattgctctttatggctgaataatattccattttatgtacatatcacaatttgtttgttagttgagcatttgggctgtttccaccatttggctattttgaatgtgctactataagcatgtgtgtacaggtacttgtttgagtgccagttttcagttatttagggtatatacctgggactgaaatgatagggttacaaggtggttctatgtggagttttttggaaaccacaaaacgtttccagtaccacactgttttgattatcatacattcatatttagctttaaaactgggaagtataagtccttcaagtttgttctttttccaagttattttggctattcaggcccttgcaattacatagaaatttgaaaatcagcttttccataaccgttttctaaaaaagccattggaattttaacagggattgccttgaatctgcaatcacatgagtagttaacactgacatcttaaccacattaagcctcctaatccatgaacataagatatctttctatttattagatcttctttaattaatgtcagcaatattttctagttctcagtgtacaagtctttcactttctctgttacatttattcatgggtattttatccttcagaatgctattatacgttgatgtttttttcttaatgtgcttttcagataattgctggcatataggaacataactaatttttgtccttattttttatttgttttttaatttagtttataaaactaatttttatattttgatcttctacctacaactttgctgaatttgtcctttagtagctttttggaagactgagatttttatatgtaagattatgcaatctgcaaatggacatggttttgttatttattttcttcccaatttagataccttttattcagttttcttgcctacttgctctggttagaacttccagtacagtgttgaacagcaatggtgaaggagactattcaagtcttgttcccgatcagagtgggacagatgtcagtcttttaccattgagtatgatgttagttgcaggtttccctccaatgtcctttattttgagaaagtttctttgtagtcctagttttctgaatgtttttatcatgaaagtgttttggactgtgttaaatgattttctgtgcattaattgatatgatcatatgaggttttctctccccttcattctattaagatggggtattcctctgattgtttccttatgttgaaccacccctacattcctgggacaaatcccgattggccataatgtataattcttttaatattctgttggactagaggtgattttggctcccagtttatattagcaatgtcaagatatttttgattgtcataactggaggagggtgctactggcatctggtgcatgaagacaaggatgctcctggatgttctacaacagagaggaaagcgttcctttgtctcacaacaaaggattagccaggccaacgcgccaacaccacccagattgagaaaccctgaattataccaaccctgctactattcttggtataccccacccttatctctctagcctgtcattctgtcttttcccctccatctcctccaaacacataactttgtgtttcagtactccaaccacactgaacctcacttaatttcttctcttagtcaagttacctttggcctattatcttccacacctgtactttttctaatccgaacatcctgtcccataagaatgatataatcgagtttggggactcagggttgggggagattgggagggacctgagagataaaagaacacatattgggtatagtgtacactggtctagtgataggtgctctaaaatctcagacatccctgctaaagaacttatacatgtaacaaaaaaccacctgtatcctaaacattattgaaattttttttaagagaaagaacatcccttccgcttcttcactccccaacatcatcacctggttttacttattatgattcaattttcggccacttcctccatgaagattttctgactttccttagaccaaatgagttacttgtgctgcatttttcccaaacaccagcattgcccatgccatagcacttatcagagtttattaaaatcacgtgttaatttctacaaggtctgggagggtcgtattattgctcctatttgctcactattgtatcttcaagacccagatcagtgccagtcacaaagtagtcattttgttattcttgtttttaagttatagaatgaatacaagaataaatgaataaatcagcctaaatttttctgtatctggaacattcaggaaatgtgatagttaagaaatatgttaatgttttatgtgtgtacacctcagatatgcctgagaaacagaaataaccaatggaaatatttttattttagttatctaaatctttacttatctgtcttggccctaattgactaaaactatatctgattttttaaaaattctcaaatgtttgattcagtatctgtgcagactgagacacagacccaaagctttacagtgtgaatttttaaaactaaatcttgaataaattatcagatacataagcaaaatttggaagggaaatttgggacaaaagaaagcagttcattttagccttttacatcaatgggcttggaacatgacttccaaggaattgctggtgttccctggcagtgcccaatttctgaagaaagaagcaaaatgtaatctgcacacagtcaaatgccagaggcaatgtgagtattatgcaggttcaaaccaggtcagaataaaaatgactactaaccagccattcagcttgtaaaatgatagaagaactagttcttgcttattgcccttaacaaatattaaaaaataagtcagagtgtcagctactagatgcaccaagttttagtgctgctttatgggctagaagtgtttcaagtaagagttggctgtgatgtgaatttctgtaaattaaagcttagctttccacttaatctaatcaaagtaccggtaatatattctaatgatgatatgacaaccacagacatattgagatagtatcattttaggagaaaagatttgagacaaaagccaactccatgttatgatggtgaactagataatgttctgcttttcgggcactgtagttttcagtttgcttttagtttcagtttggctttagtttggatttatatttcacaggatttttcaaattgtattctctctttccaccgttaactataccccaaaacacgctagaatcgtaggaattctcctaggcctaagaatcttctcaagcaatattatttaccccagagtatttttgtctttcccatatgattgtctaaatatttaaatcaatgactgattttgagaaagttgctggttttattagcttattttccttgaaggctttctaagcctccattcctcactggaaaatggaaaggtataccgaaagttgaatcagtatgtgattttcaaaaacatgtatatacatgtattcaaatgtgtcctaattataaatgtttattaaaataaatatgattctactggttaagataaaccagattctctaatttccctcctttgtcttgccatgtagaatggtgagagtccatttggctcagagaatgttcagtttgaccttttccagtcagtttatctaaagcagcagcaatgatttccaatctcattataccccaggtcactgtcttattatcacatttattcccctcttcatacttatcacaatctttgttaattgtaactctgcctattttcctactgtctgtcaccaccatctttagaataagagctccatcatggcagtgagcatgtttgccttgttcaattttgtatcactgacatgaagagctcttagcacactcatcaatcaatatttgttaaatgagcttttcttggctgcagacaccacattttattgactggaaacaatgtcttgagccaagcctgaagagaagagaaagtcataatctttacattcagagttacttcctgtgtcccttcaacgtgattcttccaacatcaccaaggaacttcctacatgattgaagaaaagatagaaagaaagtcatctggagagttaacacatttcccattggtgctgaatattatctcctaatattctgaagatgtcatcaccaggtcaatggaatctcaatatcctaagttatatatagacatctgcatacatatgtacattatatacaaatacaatattatttaatacaaattatataaaagtatacaaattatataaaagtaaatttagtttttatatattttatatgtgctatatataatttatacatgcttctgtaaaagtgtttactatttcatttacgagcaaaatagaaaagttgaaaatgcctgtttttccctactaagggatgtggaaatagggttgcttcaaagacacattctagcacagtttaataataattactcaatcaccacagacaggaaaaagttaatttatttggaaactcaactttatataaatgttactagtatataccaatgacagtattacataatggacaaaaggataaatatttaataagtttgatacttcaggtacagtaagtaaaaatccatttttaattacataaattctttaagtttaaagttacctagtcaaatttatctgtactgatagctgctgtcagaattacatgtaaacgcatagacctctctaagtgattatgttgtattcttctataacaatgagattcagtaaaagccgtaaatgataacactagccaataatttgattcaaccaacacaaccagaagaagcctgtgaagtcaataaaccagttccatgtcttatatacaaaaataataggttgattgaatttttactttctgaatctgttactttgatacttattctagacattaaatatattttgttgattgaatttttgcacactgagaaaatacaatctaaatatagctggagggtcttttctatttttttccaaatttttcaggcctttcattcggccaaagcaacaattgatgtggtattttctaatatctgatacagcttttcaattttgtgtgtgtgtatatatacatgaaacacagattgttcaaggggaacagaagcctatgagatatagaaaccaaaggatatgccttttaaattgagtgagcacagtctttagggcctacagtttcaaagttttgtattagggaatggctgaccacagaaatttttctaaattaagtgcataccaactagaattacacaattggcttccgttttgctacttgaagctcccaccttgagctggtttcactcacttattgttgaattatagagacagttgtaactaaatttgactcttttacctcatccttttgaaattgtgatctttcttccatctccaaatataattttgcagaccatgaccttcaacattacttctgcatcataaatgtgattttggcatcttgttgcagaatgcctactctgaggccttaattctcacatctgatgataccctgaggatgacatgtgaggccaagagggagtgaagcctcatccccactttgtgcttctttattaaccaggtaacagttatagtgttctttgtcatctggtcaacatcactaatttatcctgtgcacaattggaggatcacctagtccaactgcctccccactccacaatttgtcaaagagctaacactcaatgaagcaaagtacattccaaaaatcacacagaaaattaggcatggtacctgcaccaacacttaagtatataaatcaacgattatctagagaagcctggagtgatgggatcattgagtttagaaactaagaacatagctgtgctggttttagagaaataaagtcactattcacctattctattttccttttccttttgagtgccaacatcctcctgcagatgcatatatttatttacagagcaacatgcttgtgttagctgtttgtttctaaagtttttaaaaaaatgacattagaacttccaattttctctttagcaacccaaacacatttaaattataaattgaaatatattgcacttttaatagttcaagctttctgagtactattcagttccataaaaccattttggataggtaacttttttatttcttatcttctctaatcttcacttcaatattggaacaactagatatatgccttcttttgtttgcataatttttctttttagtgtttatgtaaatacatagaaggtaaaaattagtgaactatattcaaggaagggtgttagaatactaatgtagctaatgctgtgcttgggaactacttagggagaaatagattggtttaaaaaggaagttatagaatttaatcaatcttgagagaccagcagcatgctattgtggaactataactttagagaacatctatatgacagtatgatcaccaaaaacttcagcatatgctgccaagataatgtgcatattttaagtgcaagttagagggctccaccttccctttttgcctgtggtctcctgattatagcactcaaagtattgcatctgggtaatcctccattcccaggcgacttgagaaatttgatcccgttggtgtgaccaaaatttccaagtgaaatacagaaattgtaccgtcttcatgcatataggcacaggctggggaaaggtttgggatgacttttggctttgccctttcctgttttgtgacctacagtaaattacccaactttctgcacagtcactttgcattttttcgtaaaatgtgaataataatgcctttctcacacttattttggagattaaacataaatatgaatgtgcaatgaattctaatatgcaaagtgctatatttattaaatataagatgttttctgtaactccagcaagtttccagtgtcaatgttggtatatccaacacttcctacatgacatctgctggaggcacatgtctataactgaaagttaaatgtatgtgacttctacatgaatttaagtatgaatttctatatatttatcaatagttattgatttcacgtctcaagtcatgcttttgaaaactatttacatcaagactctattcatttgtataaaatagtttgttttttaaaaacagtttttcaagacttttataaaataatatccttttgaatagatacatacatatacaggtaaatctagatatatttttaatgttgagtttaagaagtagtttaaaaagcaaatctttaatttttagtgtgatttatctattaaaagtcctgtcttctctatattctctctacttaatgaaaaagccgattgcaaaacaagaagattgattaggggtaataagcttggtattctagtaataaaaatccttgccaaagtccaatctttacacaggacattgactttatttcaaggccaatttctaaccctatatctaaaacatggcaggggtttaatcattgtagcagatgctgtctatgcccttagtgaatctcctaccctcactcccttcacccctaggatttgccactgtaaccctgaaagataacacggtgaaaacctaactaagtatccctgactgaaggctattttctggcctaggaagcgtgctttcctccaagcaagaaaaagcagaagtgcctgagagttaatgctccccagagcaactctcaagcaattatagatggggaattgataaataaatacccatctttctagccccgttgttgagttcctgagcattgttctgcaccaccttccagtggtccccagaggaactgagatccagttgatgacactggcaaatggcttgataacaaaccttcactggcttcattctctttctgagtaacccactatcctagcaatgtttcttgggatcccaactaaacttgcattcaaatccttgattcagaatctattttgggggggatctcaaatgaagacaacaatgtttgatcagtacatcaattgacatgtatgaaaaaatgtgcacatatgcagacaagaaagcttctgcctgtctgtgtcaaaataggaatgatttgtctttctttaacctggtttatagcaactattagaaatggaattcaactaagtgttgcaagaagtccatcatttataaattaagatggaacttacttactgtactttgtctccagagattctttgagtgtaaataacatagacaaaatcatggaatattaagaatggcaaaggaactgagaactctttctcacagctatcaggttgttccagcgaaataacaggcagaccctggagatgttccataaagctggctgctgctaaggtctgctctgatacctgctatgtgataaaagttcctgacacttagcaggagttgatgtcctggtattccacctgcaaatggtaggtctgcagggcacaccaagcacgatgatattcatcctggaaatgtagtgctgagctcagaagtaagtagggtgttaattatccatgactagtcacataaaatcatgtcttatactcagttctggcctggaatgcagggtacacaaagggaggtactcattgataccagcaggagctatatgcaagcttccaaaggaacaattagtccttcagtgcctcattcaaaggctgcttagggggttgctctccttgaccttgagttaatgggagtatgagtgttcaatgaatggagattagccccagaagacagggaagcaaattaaacccctattttgatttgaattgggagtgaataaagtgttcactgctcactaaactcaagtgaagttaacatgcaggaatgaatggagactaacttctctgtgtggcaaggaagacctcaaggcagttagcacctgggaacctccagggatagagctgagacagaggtggtcattcatcattctctggggtgataagagtttttcagtaaatgctgtatcaatgtagataaatcttcctagaaccaataaaaatgccctttgccttttctatcttctgttacaagtaattgctattcaccttgttatgaatatcttgaaagtagtcacagagtacttggagtgcctgcgggatggaaagtttgaaggaaaaatgtagccgtatatcattggcattcatgagaaaattcagattagatgtttgaaaggcaggtccccaggaggcaatagagaaatcaggaacaatattgtgccaaaaataccactctggccaggacatcagggagtttatgtcaggtagagtgaaggaaagcaatttggaaagaaaagatatatgtgcttttctatatgcatttagtttatttatatgcgtacatcctctgaaaaactagtatgttctgggaatcgacaagcagattgggcctgacacttctaaaatatgtaactgtgtttatgtttcttttactctaaaaactctgaataacatcttgtaatatgatcaatactttttcaaactcatgtcttttaaaaatctgtttgcaaccaataagccaaaaatgggatgtgctcaaatatcattttacatttgggaggtcaagtttatgccattggactttacgtgcagattacaaaatattttttctttctaaagacacacctactctggtgtcctaaaaatcagttatctcattgatgacacaccagagatatatgttttttaaaatgtgggctgggtatggtggttgaagcctgtgatcccagctctttgagaagctgaggcaggaggatcatttgagacaaggagtttgagaatagcctgggcaacatagaaagaccctgtttggggcaggaggatcatttgaacccaggggttcaaggttgcagtgagctgtgatcccactactgcattccagcctggataacagagggaaactctgtctaaaaaataaataaataaataaataaataaataaataacgtgaagatgttgtggatgatatcatccttgctgggggtcactttactgcacaaagaatttcacttctttccctcttctagagtgtttgaataacagtcacttgacgacagttagttcagcttaagcctacttacttttcttcattccctttatttaaaaaagtcttatgtgtctgctttcaaggagactctcctgaattctatcaagataacaagaagaacaataactcaaaattattattgcttctgagaggctttttctataatatacctgaaatacatttaaggcactcataagtagcaaccaatcacccactcattcattgaataaatataagttagtgcatcatgtatacaaggacacatacacaagatcctgaaaaatacaccaagcaatatgccgaaaaaggagacgtgccgcaaatattttgtttattcattaaagataaattgattagaagttgaaaggaaagtggaagtacttttaaatgaaggtttaatgaaaatttcgtagaataaggtcatcgaatcttgacaatgataaaaattagagaattccaaggagatggaccaacataaacaaagataagacattcttcaaataacttgatcttttcaatttggttgttttgtacttacttttgtagtaataataataataatagcagctagtatgtattgagagtgcagactgcctataaaatattgttctaagcaggttatatgagtaaacttatcctcaccttaaatgtggaaagtagctaccattattagccccattttactgatgaggaaactaaggcacagaagagttaagtaactcacacaaatccttcacctagtgagagccacaggtcagatttaaacactggcagcctggctgtatagcatggactcagctgtgactgccccctcttgaggcgctcatggagccagtcagtgactttattttcttttccattttcctacagacatgggtagactgacaaagtcaatgctgtcttggatatgtgagctcagggccatgcaagataaactcctagattaggttggtagctatgctctagaattaggacttctgattacatcatgcagggaaaaaggattactgttagggaaacatgtgttctcatattcttctttccttcctcggatcctctaagtctaatcagtagccatcaagactgaagcaaaggcagtatctggagcaacagcctgctgtggatctcactacagcccttcccttcctggatgttttctcaaaagtaccttcacaatcaatcggcctcctgtgctgtaagccagttaatcttttttttcagactaattccaaatacatatatccaggtagctaacaataatactgtgcttcctgtaaataatatggaaagaccactcactgtgaagtcaaaagatctgggtacaaggccccgatcgaccatataacgtctatgtgcttttgatccgttacttgaagtagtgttatattacttggaagtcggcctcctccttttggccacagcatctcgacttttatacttgtcgttactgagttgcctgctctcccatctcaatttggaaatctgagaccagagttgttgctccatttactcaactaatgttgctggtgatagatagtagggctgtcacggagtcctttggattcctggcccagtgttctttccactgagctagtctcctacagtgtgctctgtggaacctaagcccttggggaagctctgcagaaggtactttttcttccctctaaatgtgattttagcatcctgacataatcccctccacactgctagtagcccgtgatactcttgcctagacctggatacaaattaagatcacagttttgtcccaagtcacctacattcagagggtccaaaatgtaaaatgatgcttttaaaagaatatgaagaatttatcctctgtggttacaggaaagttagctaatctccctgaacctgagttttgttttttttgttttttgttttgttttgttttgttttgttttccgggtagtttaaaaaatcaaatgagacaatttatttaagaaagcatctttcacattataaatcagtttacaaaagcagggtactatttatataaacatgaattccagatattggaaggtggcaatgtctgctgttagtaagaatgcaggaagcacacaagcagtgtggaaaaatcttagataatattttagtcccctgcccttggagaaatgtatcatgaggtcagtgggtgaatttctttgcctgcaaattgtatctcctttggatacaatttgcaaagggctgaggaatgaggttggacccccatgccccatagcacaaagtatttctgctcagcagtcatgtattttgcaaaaataacccacccacaacgaagtattgcctgatttaaggttctgcaatttctaaaagccagggcacttaagatactgagatgaaataacattccctgttcccaaatgaataatgcattttctcactcttttttatttttattatttcaaaattcttgcctctcttttgcagagaaatttcccagagttttacagcatcactgttgacaggcaaccacattttcctcccaaggcgactcctatttctgtgaggtcaagattgacaatgggagcacatatcaggggatgggttgatggaagagaaggcaaaaggtccaattgtccaggggctgggtggggaccgtgaaccttagccaacagaaacagaatggaatcagtgtacatcctgctgtcagtgctctgtgattattttcccctttccttctcctaatggataagcttggaagaaagtgcattctttctcaggagagagctcagaactgcagggttttactgtatttattgtgctacatatacatatacacacacacatacataaatacactgtatatacactacatatatatattagtttcaataattctttcctaggtaggtcagaaaattcacattgctatgcattattaaaaagaagttatgaggccaggtgcagtggctcacgcctgtaatcccagcattttgggaggccgcaggcgagtggatcacctgaggtcagtagttcaagacctgcctgaccaacacagtgaaacgagtctctactaaaaatacaaaaattagctgggcacggtggtgagcgcctgtaatcccagctactcgggaggctaaggcaggaaaatcacttgaacctgggaggcggaggttgccgtgagccgagattgcgccactgcactccagcctgggtgacagaaccaaactctgtctcaaaatagaagaagttatgccatcgtgtgtggttagagagtcactgattggcatgaaagcaattaaaacccacccaattttcctgaccacttttataagacagagaaaatttaataagttaatcccttatggatatcttgggctctttgaaatttagagagctctattacatcctttattaattgaccctaaaaaaattaggagcagtctgtgtggtaggtagtatggtcacaagatttacagtgggcaacccaagaacagagattctaagacttactcaaactacattgttagctattgacacgattaggactctaagacctctgttattcttgtccatggctctttccccttgattagactttcccaaagtgtgttctgtgaagcgttcactgttggaaaagcactacagaaaaccgaatcccatgatcatggaagtttgggaaacagtgcaggctatacccctgtcttcaagttctgtaatgtacactggccctggagagatacagaaatcctgcaggaaaggaactgttttgccttatttagccttgcattttgcatattatttagctgcatggtgctttttttaagccccataaacacactgtaggaagccttaccctgtgccatctagctttataacaactcagggtgggagtcctcaatttgcacctctaataagtagaaatgtttctctttcaaatgttcagatttgagcaaaatctcccagagtaagctttcggcaaaattgtaaagtctgtaagattggccatcgggatgaaaaacatggactcaggattctgatgatactggtcaaatgagggatttttctgccacttatcatctgtgtgcactttgtccagttacttagttcctcccagtttcagtctcttcacctgtaaaatgaaagcaataattgtatacctcttatttgactgccgtgaagatgaaatgaggcagtgcatgtaactcctggcatagaatctcgcttctgttgggtatttgaaaaattctattattactattattctcattatcttccttttcagcctacctcctggcaccccattctgtctcttcctcctcctatttttctatcttgtcacacaatcttaaaggactctgcttccagctatcttgcttacctggtatagtgtagagatggtatacacgatgccttccaagactgggcaggtaatatgaaagagtgaagggaactaggtgtgagacaatagggggtgtcccccaaactatggcaaacacttgtgttaaagggccagtcactccggatatttgttgttgttaatgcctttttgttgtacttttaccgcatggaaatatggactagtgatgccaaattttcagataattaatgagaagtcaaatgtttatttttatatgtaattttccaatttttaaacactctttttaagaatctgttagactaccagttgatgacccctggatcaggggatttttagcatcctgttcctatatagtaataaagagctgcaaatttagaagtgtttaagaggtcatctagttgaacttcctacttgatcagaaatattatttataatatactagaaaaggtgtcatttatctattcctagtcagagagaactaagcatctcatggaaaaaaacattacactttgtatgtacaaactcactgaattctcttatgaacctcatgaggtagatgctactttttccattgtaattatcatgtcatccaggctcagaaaactaatttacttcttctaaagtcacaaagctattaagtgtctggtagattttaagaatggaattccagactgtttaggtttcaaagccagtgcacttaaccactggctaaacaattctacttgttaaaatgctcagggctgatattaagctgaaatttgctgccctgaaatgtccactatttggtcccagttttgctctcctgagacacaaataataagtttaatctttcttccacaagacagcccttcaaatatttgaagatgactctcctctgcctgctaaatcctctcttccccaggctaaacatactcatttcttttcactgaccctcataagtcatggctttcagccacttcatcatccttgcactgctccccaggagagtatttcaatttgtcaaagttcctcttaaaccgtgatgctcggaagagaacacaatccctctgtgtagttacacaagtgcaggtcaggatggaactagcacctccctggttttggccaccatgcttttattaatgcaacctaagtcatgccagatttttagcaactatgtaaaaagaaaagcaaacattgaatattggtccaacttcacactatagaattttattctctgctttttttttttccaaacttgaattgaaggaaagccacttttactcactctactcctacccaatatatttaagcaggtcatttttaaaactcaaatacattacttagtatatattcttattaaataccatctttatttatttactgttttggccgatactgatctgttttgttttttctttaatttgacaattatagcaaaacagaagagaaagaaacattttctgtagtgtgaccactttttcttaaatacattaaaaaagggttttttcctctaccactctaatattgctcacagataaatctatttatattttcccaaaaacaaaattttagaaagtgctttgcacacatttctgttttaataggaccttgctatattattgctttgtttagttttttaaaaaatttggaatatatgaagaagcaaaaacactgaaaaaatctgctgcttgccattttacttacatatatgtattatatatctatataattatatgttatatctatttgtatgtatgcatctaccttttcattcttttcattccagatatttccgatttctgctatctgatatactcactatctcttctagctttctgtgattctgaggttaatcaaatattcagtaggattgggctgagaacttaccactagaaacttctctctaggccaacctttagcccaggggtgggaaaactatggccatgaattaattattcttcacctgttttttgcaaataaagtttttattaaaaaaactgccacttccatttgtttatgtcttgagtaagactagttttgcattctaatagtacagtttagtaatggcaacagtgaccaggctggaagtatttgctatctagtcctttatggtcttttacagaaaagatttcccaatctctgctttagtcattagtaagtagtccctgcattctgttattgaattcattgctgagaattgaaactagcataaattcctatccctgtactaaaccgcactgaaagcaaaaataatttagctacttgcttcaggaaattcttgcttctagaggacaaaacttacttttcaagaccaacatcatcatctgtatcaagagcctgaccttcttgtactcatcaaattaaaactattatgccctaatctctacccacatttaatcagctcctcatcttgcaagaacaaccttaaaatcacctaacccaggtcacgaagccctaaaaatattgttttaaaaaaaaacttcagctgaattaaattgaaaggagtttaattgaacaatgaacaattcatcaatcaggcaacccctgattctggggcaaaccccagaatcacagcagatttggagagactccagggatacctcatcatcagaacaaatttgtagaaaataaaagggaagtgacttacagaaatagaaagcgaggtacagaagcagctggattggttacagattggcatttgccttacttgagcacagtttgaacactcagcagcgtatgactggttgaaacatggctgctgggattggccaagactcagctattgtttcaggcacatgttcctaagttagattttcaatcttgtctacctattaagtcaggttactgttggtcctcaaggactcaaatatagaaatatgtatttcttcaggccatttctagtttatattaacaatatcacccacttatttctccttctgagaaagtattacaactatgccaagttgtattctccctgactgtggaaagtctagcaaacttagatttgtccaatgaataagtatttcttgtcacctttttaggaacggaaagtcaacactacaaatcctcaaagctatagcagcgtcactcatccacattcttgtattctgatttatataaatacaaagagcatttctataagatataattacctgcatattgcagatagaaaaacaggtgcacacagaggctggagctatgctttggtgatgtgtgcagtgccccagatcaagaggtcacatagtagggggggaccctcaatcagggatctgccttcaagtcccaggtctcgttctaggtcatggactaaattttatttagttaactatcacctatatatgtaaataatggcaactacttatctcctctaggcctcagtttcctcagctatgaaaatagaaagctgacttctattatctatatagtttctttcaattgtgaaattcactgaaagtatgatttttcagcagtcttaaaactaatttcttcacactagtatctttcagcaagacttcatggcctcaagcaaaaggcatatgagagatactctcttgatgactgagttaagttctacagcttggtttctctgattaaaaaaaaattgtagaaatgattctgactatttccataacaaacatatttgcatttatttcatgctgttaacaacttaacatgtaatcatggctcctctaggaaaagcagtactgcttcttctatgatcacattaaacacgctgtgttacgtctttctactaatctatcatctattatggctgcctattttgagagcttggcataacaattatcataagtgatagcattatattctgaaaacaaagaatttgatggcacaatttatcttgctacttggcctaacttaatggtggtggggtttcctagtctgtactatatttttctcagatcacaaatagttcactttttaatttattattgatttagcttaaaagtaaataactccgtgaatgctaaagttggaaatctgttataaaaattattaaaaatcttctcttccttctggccatggatgtttatcacactgaaatcaaactgtggagctacctgaacaaagtgaatttgagatttttaatttatctggtgtaattaactggtcaactaaaaacaaaagggcaattagtgctgcacacatttgttctgatgatgaacatggcaactgaaaatggatcttgatcttcactatgaaatcctttagtatcaaagcaatgttgctgtaaataaggggagaacgaagcccgtgaggagtcacgcacttgcaacaatgatgtcctgataaactaaatccacaccagtaagacaactagagagagaagttggccaatatttcaaagtaatattcctccttgaccattctactgccctgtacttgaacagcaataaccaaagccttttagtagtagtttctacttttcctgctaccaatgtgagaaaatcatttcatgtactgcaaaagaggtaagaaaaaggtataatttgtaattgacctgaggatttccataaacagtatgtattaatgcacataattctccagcgtccaagtccatgtaacctagatgtatttatagaaattaaaaagcacaatgttgacagaattggacaagaataattttctattttcccccaccatagagtaagatgttttaaattattttagacattctctgtagcttctaagttaggttgggaagtaccaacccttcatgagcacctttcagaagcttattacagagctatgcatgcacatctactctgcctttttattcaagaaattgaccctagttctcactggaaaaaataaagttggaaaactcctctgtaaaagatagataagagaataacagaggtaccatctctgtttaggataactctcattgtctctcaagcctgccggacaaaccaaggtttaacatggcagccaccttccagaattttcctgatgcctgaggtccagccattatttgacttacacatttattcctggtttactggcaattgtgcacatttatagactgacgaatagttttagagccaggagatggagtgagtgacaattttccattcctaaaaaaaaaaaaaaaacatgattattctgaaccaaacaaagaaactcttaatgttgtttgggttaagcataattagcactgtgtataacctcactgtcacagcaataattgctgagttctttcatctgccttctgggatcagaagcaagtcagtgatacatggtgagaagaggtcgtataaaggcagggctcacagtctgcagctacttcaaaatacaggactgcatctttttctactacatagatggtattcttgttgagtacgtatacactgaattagaaaaatacagttggataatcctttaacagaaatcttcacagccaaatatattttagagtttagaattcattaaacgagagatcagcaaaagaaaattccagaagctcgaaagccagaaagggtcagataataaatattttcagctttgcaagccatatggtctctggagcaactattcagccctgcctttgtagcactaaaacagccatagacaatacatcaataaacaggcatgttgggttgcagtgaaattttatttaccaaaaaaaggcaaagagccagatttggtcagcaggctatggtttcctgacccttgttttagcctttagaaaggcaatggggtacgaattcgtatgtatttctatatatttataaatttgtgtgtacaaatttatatgtatttttatttgcatgcatatacatattatagacagatatgtacattaaagatacatataaatttgtgtgtgtgtgtgtatatatatatatatatatatatatatatatatatgtatatgcccaatgaacaatacacttatcatcaaccaacatctctgtttcagcagaaaaatacatcaatatttataataagctgggtaaaaagatctaagcaaccacacattgcttggtgtgtattgcctggggacagttctctgccaccaaataaattttgctaccaagctttcatgtaattttcaactttcagagattctttttaattgcaagaaaagtgattatagacctgtacatactctttccttgaagtgtttgaaattattacttttgtactgagcaatttcatgcaagaaaaagtaaatacacgttagtttatgaaccaagatactcactgctctgggccaaattatcatttaaaagacctcatctaaaacaaaatgctggtgatacatttttgagactctttttaggttctagaagtttctttaagttagatttatatactggttttcctttattacaccattttgcctcaagtgacctgtaggattctaggaacctagaattaattcctgtggctattttgcatgtcagtgactagcagaaattttactcactgaatatttctactcgattctgctgtgagtaaataactacacttttcttaactacattgttgtcattgagccagagtattctccttcctcaggcaatttaaactttcacaaatgaaacttttacaaatggcaacccatgcataaatattagctatttaggctagcagtatagaggaatgccaaataaaacatctttcgggctttggcctcattatagtatgctgataagcaatcagatgataaagggcaacatttgctatgaaattatacactggatggaatcaaaccatcttagaatattagagctggaagaaacttgaaggtgacttctaggtcaaacccttcaattttcaaaggaggaaactgacaatcaatgtgattgtacatgaatcactcaatgttactcagctggttaagagaaagagacaatagtagaagcaaaatctctagattcccaatgtagcctttttctctgtaccaccaggttgttcagctgtcaaatgcaaacctagctcatgcttgctgaatagctatgagctctgcattagacaccacgccgagtattacgagtaagtgttacacatggtgtttatcgtcaaggtaaaatgcaaaacccttggcttttggagtctttggtaagtgcaagccttaagagaaatacattgagtcagtgtgctctagaatctttaagagaaacttcatataaatttgagataaacgatacaggggactgggcactgtggctcacacctgtaaccccagcactttgggaggccaagatggacggatcactggacatcaggagttcaacaccaccctggccaacatggtgaaaccctgtctttactaaaaatacaaaattagccaggtgtagtggagtgtgcctgtaagcccagctactcgggaggctgaggcaggagaatcacttgatcccaaaaggcagaggttggagtgagccaagatcgtgccattgtactccagcctggacaacaagagcaaaactccatctcattaaaaaataataataataaaaaataaaaaataaaaaaagaatgaaggggcttggggcttgtcggattacttaggtagaaggagacaaaaacaaaatacaaacaggactaggcaaaaatttgtcttcttggctcaggtaagatgtttcatgattctacggtactgggtatgattctaggttctttggatgatggaatgaatcacagtaacactcagatacagaaaaagcagaactctgcttcttacagctccaaatgaggcaaagggcacacaggaaattgtacccaggaacagaactacagcaagcggggactgttggaggtagcttgcgaatggaaaatggcatagagatggctaggctttgcaggcctccggaggattgggtattttaaataattttctagcccaaggaagtaggggctgtttttgggtgttagagatttggagatctgtggtatttgggtctatgtgtattataacccaggattattaaagcctaataagggatatatttggggttgagtcttagcaaactgtccatgaaggggaactgaaagtttttagctgtagctgcaaactttcgtcaagataacagttgtgagatataccagatcaacgggtttattatctcttgatgacttaatggagagattatacactttttctgataatattgacagaggtcctggcttcgactgccattggtttcaattaagcaatatgctgaattttttacaaaatattatagccaaagaaatagataactgattgataatgacctggtcatatgcttgtccctggagcaagaaggtggaggcaaataactccccagctgtattgtctgatggtacatagggagatggttcctcaaaagaaagtcacagaccttttatcacaagaaggagacagaattattgggtaaaaaaataatgaatatccgttaaataagtgtaccatgtaatttacgttataagctgaggcttttttgagaaaaagagtctattgataattctgccatgacaattggatacatggaaactgtccagtgaaaacaaagatttatggccatgctaccattgtataggtttttagggagatacagaccctaaggaggaattctatgcaaattaaatgacatctatatagagataatacataatgcacgtgcacaggaagtagatctttgtcactagattggaaatatttagtagtagtctccttggaaaaggaagattagaaacctattgtgcatagtcttgaatatcattccaaagactttggatgtttgtgaaattgaaagtgattaaagtctccattgcataaactggcataattggaccaatctttgttttaggaagaaaattttggtggtaatatttaaatgagtagaaaggacaagagatttaaggcaggaagactattcagagatccaatttttttttaatcttcaaagccactactctatttaaaaccttcattattcctttcttgtactacaaaagtagcctttaattactctgtataattccagtttttactccatctctttcattctccacggtagccagagatataacataaattttgattctgttctgctcaacattctcaattatgatctgaaagtacagcattcatatgcattaacatgacctaaatgtcttgtatatttcagcctctttccctttctccaaccttgtctcatgccgcagttcttctgaatatcaaaccggactttctcatatctttgaacaggcaactcaaggcttgctataggacctgagcccactgtctctcttttgtttaggaagctagtctcatccttccttcatacctattgtaatccctacagctctgctgttttcatcccatgtacacacactctttgcctggcaaagagctactcatatttcaagcctcagctaaaaaatgctaactgaattccaccctataaatctcatacatattacatttttctttaatattatcatatttactacacaaatattttcctgtgtgcgtaaggttttttttgttttgtttctctgtttttgttaaatgtctcacaagagaacagtgcctcaaaggtagaaatgaaggattttaggctcaccattaacaccatagtgcccattgtcttgcaaagaatgtgattatataaagaaacaaacaaataaataaatgcttatgaaaatataattaatgaatgaatagatataacatatgatctaatttatgtaaggcattaaaggctgtggtatcaaaaggaatggaaagatgatgtcagatatgagaacatttgagaaaaacattgactcaatacctatgttgacccctgaatattgtttatttttcctgtgatttttatcctttgattaaatttggaaagcatttaacttaaattttatttaaacgttaagtataatcaatgtttttggtttaagatgaagtaactcatgacagaaagaaatgatttttacaatttaaaaatacatcaagaaataaaaattttattatttattatcatcacacttaaactccatacacttccaataaatatttaaggttgcaagaaaatatgtttccactatgttaaagtttccaaaggatcttatcacttgatatataatagttttatcaaatgtaacctactacatctcttgatagaaaagctgcaaaattataccataaaaaggccatagaaataataaaggcaataatagtggctgtttttgtaaacaatcaaccatagtctgttacaatcatacagttcataataactgagcttaattgtcaagattaattgttgagcttacctacatgagttgttacagaacatggacatagataagtttattctgagcttattctaaatttttatgagtttaggagtttttatgaacctcttattagatttctcttttgggctaaaggccaaactaacattttatcttgatttcatttatcactgcatagcttaaatgtcaaaataaattagagaaaattatgatgcaacccccttaggaaaagcaagtctcgtacctgaaagataacactgctagaaattgatttcttgcagaaattttgcagcacaatattaatttttctcttgtgatattaggacaaataatgttttctaatatttgaggtgtgaattgaaattaagaaaatatgagctgacattactggaactcgcagaacaaatgtatgtgtagaaagcatccatttaggttgctttattttggataataatattaatattaaattgaattaatatgcaacaaaaatatgcttattaaaatattcgtgtttgtacgtttttcatttcatgacaattttgtctttttcagactcttgagatactgactggaagatagactgttttgttccacctgattgtatgggagaaatttttgaccttagaaagtggaaatgaggttgctatggaaactggtaattctgctgccactcataaactcttctgcaggtaaagtgttctattattataagttttgattgataaatatattggcattgtatttctttctatgggtgaagcaattttcaaaatgcacaatttgtatgttatttgaatgactaagtgataatgttttgaaggtaacttctatgactcagacagggaaagtttaatccttaaaaatgtatcaaatgccagttttaaatggaaactaacattattacatttataaattggcaaatatgacatttttatacaatgtaattatgtaatatttaattatataatatactatgacattttaataaaagaatgtaattaaatatttttatcaccaataaacagtgaataattattcttattttcattatagtgaagtctttaaaaaattaaaattaaaatacatatttctctcatgtttagaaattgatatggcaaaaaaatcaaagctatattcatttagaagaaaagatgatatagaatgttacctcagaactagaaataaccttagatatattttctttttaattattttaaaagaatagacaagaacatgttcttttattcaacttgaacatattaatatctgtgtatcagttaacttttgctttgtaataagccacgccaaatgtgagtgtaataaaatatcaaataatcatgtatttagttgacaaatctgtgggttaacaacttacgatgggctcaaatgggtcttcttttggtttttgcctgggtgcactgcaacttcgatgagctgagtcatctgagacatgactagtctagaacattcgtaactgagacaactgtgctgccatggctgtggtccaaatgttaccctctgtgagtctgggttcttttacatggtggctgctcagggttccaagaaaacaaaagacagaagaatgcagcatttcttgatgccaacgcttggaactgctacattgccatttctgtgagttattttgacaattataagtcacaagacaagttcagctttaatagatgtggaatgacactacatctcttgatagaaaagctgcaaaattataccataaaaaggccatagaaataataaaggcaataatcgtggctgtttttgtaaacaaccaaccatagtctgttacaatcatagagttcataattactgagcttaattgtcaagattaattgttgagcttacctacatgagttgttacagagcatggacattgattagatcatatgattatcaaagaagcctctcttctaccataccatgcttcttccccccgactatgtgttgataggtactagtgaagtttcacgtacttataacaaagcagtaatacattgacagacatgcaggaataaacataatttaaaaggcagaaacacagtaattgtaaaggacatatattttatagcaatcctgagaaatagatatgctgatcttaaaatgaatgagaatgctaaaatatgcagaaatcaaacaggagaatcagaaaaccatacaaataaaagcaattttaccactagcaaagctagcagctagaagtgccatagttatatttactcaaagtgattacagtattttgattggtgacacctctaagtctctgtaacaaagatttggggttaaataatagtgtattctttttttggtaatagattaagaaaagacagagaaaactcatcaaggtgcccccaaatcatatatgtgtgaataagaattatattcctacccttaagtttcatcttcctgtcaaaattcaacattaacattttgccctttaaatatgtatattgaattagcataggatctctaaaagaccttttgtgttaaattaaaatgaattattagtctcagaacacgtatcaaatctgagaaatactccagctcttatattaacttttatttatacaaactggatgtgattcaacatgtcctgttgctttattctgatgggagaaatcatcatatacccttggtgcacaatttcattgtgaaagaacagattggatctattaagtagccatagctacttaaatgagataatctaagctaaacattgctccagaggtaaggatgttgataatgacatacacaagacaacactgctttaaatctgtttgttttgttagacgtttcatggtgtgtctccctattcgcagatactattttagtttagaaaattagattgtctgatgatagagttctgtgactatgcatagtgataatatcttgtttttccaaaacatactttttattcattctgaaatgccagcaaatctttcacaattacttactttttccttgctatttgaattattataatttttctaacaggttgatactttaaatctccctagactctaaattaaaacttaaaattttttgacaacctctcccctcattttctaaaaattaactacaacttctagtgcttttactatagtcatggcctcataggcctttacaatgaaacttaatccatacagtcatacatgattgattctgggacacttttaaagttttgagtacttaaaagtttaattgttctattttagtatttttaaaatattagaagaaaatgaaggcccatttaattaggaaatacagttaataattatatactttttaactgtttcattgatatgcatgacaggctaaataatggccccaaaagatatctaggtcctaatacctggaacctgtgagtgctacttgatacagtaaagtggattttgcagatgtgattaagttaaagatcttcagatggggagattaaaatagccctggactatccagattgtaagaaggaggcagagttagacctgacagaggggaaggcaatgaggcagcagagcagagggagacgtgaagatgctgcactgctagacttcaggactgaggaagggatcatgagccatggggtgtgatgaaggaagctctagatgctgggaaaggcagggggacagattctcccctctatctgtggactgagcatggctctgcctgcaccttttttcagccccgtgaatcccattttggacttctgacctccaggactctaagaaaataaatatgtactgttttaagccataacatttttggtaacttttatagaagtcataagaaactgaagtttcttcctcactatgctttaagcttccagatggcagggactatatcttgctggtacttggtagggattcagtaaatatttgttaaatgaatgaattaattaattaccaaaagttaatgttgtttgttctatttatgttatcacagtagaataaatttagtcatataatatcctctggggaactgttagtctggttcattcctttatggttgccagtgtgtattaaagttacagtcataagtttctagaaatagaattgtaataacgttttaaaagttttaaatcatgccgtatttgaaactctgtgagggcaggaaatttcatctggtttatgctttactgattctccatcccctaatacacagattctaaatatttgctaaatgaataaaagaaagcagcttcattcacttcaacaaatatagaaatatattagaaactatgatgtgccaggcaaggagcttgatgttgaccttcaacaataggtccatagtccctgccctcttcaacctgacagtctaaacagggaaaccagcaagtaagtccacttaaactgagattctgccccttgtgacaaaaaagttcttgactaatacagctttaaaaatttggttttgaggttgagttagtaacagaactctgctgggataaatgcttattcactaatgaaaatgaggaaaagagcaaataaaagaattttaagaagtcacaataattcctggaaggaaaaaaaaatcaagaggtttaatatagactaagaacgtttattctcagccctgagttactgaaaaatctacatttcttaaagtagaaaaaatatgttaatgagataatttggataaccaaattaataaacggagaaaaacttataactgtaagtctactttttgtctttgtagacaatgcacagattgttttcatgaggaaatattttatttatttatatatttgtttgtttgtttgtttgtttgttttttgagatggcgtctccctgtgttgcccaggctggagtgcagtggcgtgatatcagctcactgcaacctccacctcctgggttcatacaattctcctgcctcagcctcttgagtagctcagattacaggcacgcaccaccatgctgggctaattttttgtattttagtagagacagggtttcaccatgttgcccaggctggtctcaaactcctgagctcaggcaatccacccacctcagcctcccaaagtgctaggattacaggcatgagacatcacaaccggtccagaaatattttattttttaataaatactgaacaatgtcagtaatgggtagaagctgaaaaaccacgtagggtcaaattttgttgaccctagaatgtcacctgcctaagaaacccaagattaactgatgtgattaactgtcacattttcccacagtgaaaaattctcagaatgcacaagatgattctattttattaaatctttcaccttaccatggcttttatgtacaatttgaaaaatattagacagatttcaaaatttagttccaatctttaaaaatttgataattattaaaaatgtttaataaagacttgatgataataggttgaatcgtgtgctatatctgttcttatgagttaaccagggttagagatagcacaattttatctgcggactattagaagatctgcagtccttaagaagagtgtcagtgagtgtcaatggctgctattataactcaaacataataaacaatagcagaatagtagttacaaggagtgtgattttcctgatactaaatattcatatcatcttaagaatttctgcctaatgtattctcttttaacattcttattttaactaagtactactatttaaatggtagtttataaaacattcacttggttcataaatataaccacttttttgtcatttgtgtttgttttgccatgggttaaggacttttatatgtattttatgaaattacggactgaatacctatttggttagtcctgaagaagtaccagttattcagtatgagacttggttttatcatgaagaagtgcaataattcaagaaagtcaacatagagctagtcacatgtattggcagactagaatcaaagccctccttgagggattctaattattgtgttatgccaacagggcctaatgagctggtttctcctactgtattaattactcttgaagaataaactgagactcaaaattataataagtctttgcagccatcatttttatgtaatgtttgctgacaaatgtggttatattattttcaaaacttctcccaaagtagttgacttttaacactaaaataaagttgtttttagggctgatacccataaagaaagaaaaaatctattttgtcagtatttttacatagcttacttctttataaataacacagcctgaaagtgaatctgggagaaactgtcactctttctaaatactcacagtcaggcacctaggaaaaagggacattggaaagtatttatgattgcttgaatttcactctatttcaaacatagccttttattgaattgagaggcagagcaaacgaactacctgagagagaaaaccagaagaatgaaaatattcactatgaccaagatttcttcaaagacaacgatgtatcacacagcaaatccatgaaaattggcaggtgtaataaacctgctttgctcaaggatcccagaagcacatactggatattcctttgggtcagagtgtgaatgaatattgagtacgtcacaacccacactctgcctacggtcttgtttggatttattgttagcataatagcacctttaagaatggaacaccaggctgtatttttaagccaagtgacatcttcgcaatttctaatagaaatggtccaatttagaaatgctgaaaacaccattttcatgcaatgcttactgataaaggtggttatatgattatcaaaccttcttccaaagtaattgattcttaaaccttaaatgaaattgttaggactgataagaatgtaggaaaaaaaattatgttttgtcagcactggggggaaatgattggtatgcagactggcatactataggaaatgtaggctcttagttgaatggaatgtgagtaattgtgttttcaccatgaagtctttgaaggagagggtcaagtatgctatggaagtaataacaccaggtcatattttcactttaagggtactcaaaaatagctatgctatgacttgaaaatagcatggaaggattcataatatttttcttttcttttctttcttttttttttttgaggtggagttttgctcttgttgcccaggctacagtgcagtggcacaatcttggctcactgcaacctctgcctcccaggttcaagcaattctcctgcctcagcctcccaagtagctgggattacgggcatgcaccaccacacctggctaactttgtatttttagtagagacggggtttctccatgttggtcagactggtctcgaactcccgacctctggtgttccgcccgcctcagcctccctaagtgctgggattacaggcgtgagccaccgcgcccggcccaggattgataacatttttcttcccccgatttaaacaactccagatgcttaaaatcaaactccttgccattccatcaagtcacgaaacaatctggcttcttctgcctacctctttcatctctacttttacttaacttccctttgctcattgcattagagtcacatttttttcttatgctcatcaaaataccaagattgttctctgcttagggtctttgcatgtgctgttcagtcgtgtgaaacactcttcacatctttctatgactggctctttccattatacccatctccaatcagtcacctccatagtctgacgttcccttaggaccttgtctgggtaagtagtagcttatcccactattggtcctagtcactcttgtcaaccttttttactgttttcaatgagctcgtcgctatctggaattaacttatttatacattgtttaccagtgcactttctgcctatacctagaggaatataagttttatgtagttaaaatattgtgagtcgtataagtggctgcatcactgatgcctagtacagtgcctgacgcatggtacgcactcaataaatatttaaaataaatgagcacgttattgacctctcaaaataagaccccaagactgcttagggataaaccaatattcccaaacacctttagcaattgaactggttcttgttagaatctacttttaggcataaatgttttagtcacaatatatcttttgggcttaggattttttttttaatttttaaaaactatgctgtatactgaaagtagaaagctattcctaatttttgaaacgaatacagtttgcttagacacacttgacctaggcaggggtaacttcagtgtggtttgttcagggagtagaacatttaacatacagccagtgctgtttcagtattactgggtagcaaatacacgttgactttgtgtcacaaataatttaaatatttaaacttgtgggctgtattttatctcaagatgtatttttttattcctttttagttctgtcattaccagtcaagttgatccaccattgcctctccccccaagacatttgtaccagcctcctacagtttctctctattttgaggcatcctctgtgtcctttccaagacttagcttattgacacagatgcctatgcagagaaaacttcataaagcacggctgattttgtcattactctatgtcaagacctttacagatcccatctcctataaagttcaaactgtctaatcaagcattcaaattcaatttccttcaacaaatattggaagttctccaattaattcaattctacctgtgtcatgagccatgccttcccttactctccttcatgtatcctttattcaagtcagactgtgctacttgtaagatctctgcactttttaaaaatccccaagtctctccttatatcattgtgatattctgcattgttcttcttcagatccatttccatttattaaaggcaaatccaatctttaacacacttattcgaatgctatgttcattctgattaatcctcccagtaacatattcttccattttctcctgaaaccttgattctgtgaagaagaattttgtcatttccacactctttgcttagaatcaggtcatttctctcaaatatatgctcattctgagaaatatatagtatttacacttgttgaatttgtaactgtagaattcttagtcttaaagggaaaataaaaactcaactcaaatatttgactcgttatacctcataactagtgcattcgagtttataaagcactttatgaatagtgtttcatctgatcttgatagtgggcaaaggaagaaacgatatttgagtctcagactttctttctttctttctttttcttttctttctttctttctctttctttctttcttgctcttgctctttcccttccttccttccttcctttccctccctcccttccttccttccttccttcttctttctttttctttctttttttccagtctcgctctgttgccaaggctgaagtgcaatggcgctatcaaagctcacttactgctggcttgacctcctaggcttaaacaatcctcctacctcagcctcctgagtagctgggactataagcatgcaccatcgtgcctggctaattttttattttttgtagagactgcctctcactgtgttgctcaggctggtcttgacttcttggcccaagcaatcctcctaccttggcctcccaaagtgctgggattacaggcatgagtcactgcaccttgcctctttttttttttatttttaattttaatttttctgtgtacatagtaggtgtatatatttatggggtacatgagatattttgatataggcatgcaatgcataatcgcaatagggaaactggggtatccagtcccttaagcatttatcctttgtgtcacaaacaatctaattatactcttttatttatttatttatttatttatttaatttatttatttatttatgtacttattgtctctgttgcccaggctggagtgcggtggcacgattctggctcactgcaacctctgcctcccaggttcaagcgtttctcctgcctcagccttccaagtagctaggattacaggcatgtgccaccacacctggctaattttgtatatttagtagagacggggcttcaccacgttagctagcctgatcttgaactcctgacctcaggtgatctgcccgccttggtctcccaaagtgctgggattacagatataagccaccacgcctggccctgttattttcaaatgtgcaattaagttattattgactagagtcaccctgttgtgctatcaaatactagcttttattttttctaacttttattttgtactcattaaccatccccacctgtccccctcccgccgtcccagtttccttcctagcctctagtaaccatccttctactctctatctccatgagttcaattgttttcatttttacatcccataagtaagtgagaacatgtgaagtttgtctttctgtgcctgacttagcttaatgacctccagttccatccatgttgtttcaaatggcagaatctggttcttttttatgactgaatagtactccattttgcatacgcaccacattttctttatcaatttatctgttgatggatacttagattgtttccaaattttggctattgtgaatagtgctgcaacaaacatgggcatgcagatatatcttcgatatattgatttcctttattttgggtatatgcccaccagtgggattgctggatcatatgggggccctagttttagtcttagttactggatcatatggtaactctagttttagttttagaggaagcccaaaactgttgttgatagtggttgtactaatttacattctcaccaatggtgtatgatggttccctttacttcacatccttaccagcatttgttattgccagtcttttggatataagccatttcaactggggtgacatgatatctcattgtagttttgattcacatttctctgatgatcagtgacattgagcactttttcatatgcctgtttgctatttttatgtcttcttttgagaaatagctattcaaatcatttgcccattttttaatcgcattattagatttttccctatggagttgtttgagctccttatatattctggttattagtcccttgtcagatgggtagtttacaaatacttccttccattctgttggttgtctcttcacttcattgattgtttccttttctatatagaagcttttaaacttgatatgatcccatttaaagattgtttcttgacacagactcaattttttttggcagcgggcaggattttcctctgtcactcaggctggagtgcagtggcaagatcatagctcactgcaccctcaaatttgtgagcttgaactatcttcccacctccacctcctgactagctgaaactacaggctcataccacaatgcctggctaattttatatatatatacatatatatacacacatatatatgtgtgtatatatgtgtatatatatacacacatatatatacacacacatatatatacacacacatatatatacatacatatatatacacacatatatatacacatatatacacacatatatatacacatatatatacacacacatatatatatatacacacacacatatatatatatacacacacacacacacatatatatatatatagacaaggtcttgctaattcttaaactcctggcctcaagtgatccttttgcttaagactcccaagtaacagactcaaatttatgaaacagttaacctttaaaatctgaaaccaatttaaagggggaaatcacccagggccttgtaagtcatactaaggaactggattgtgttcaaattaccgcctaattaccatagtgggggcttattcatggaggatatgtgccaatcctcccagtggatgcctacaaccatgaacagtcccaagccctatacgcattatgtttcttcagtctgataacagagccagctactaagtgattaaaggtgggtagcatacacagcgggggtgcactggacaaagggatgatttcctttctgggtgggacagactggaatggagcaggatggtgtgggatgactggagatttcatcacactacccagaatgcaatttaaaacttatgacttgtttatttccaaaatttagcgtttaatatttttggaccttggttgagcatggtagctgaaactggggaaactgaaaccacagaaagtaaaactgtggataaggcgggactattatatatagaatttttttttattttggcaaatatactgtcattaattttatttctttttatcttataaaaataaataccttaatatatttatctagtataaattgacagaacaattaatctatataaaaataatctggttctcaaacttaacttcacattggaatcacttgaggacatttaaaaaatactgttactacaatcccacttagaaatttagagttaatttatctgtgttcaatgtaatcattcgtttgtttttctttttccccccctcaagacaaagtcttgctctgtcccccaggctggagtacagtggcgcggtctcagctcactgcaacttctgcctcccaggttcaagcaattctcctgcctcagcctcctgaatagatgggattacaggcatgcgccaccacacctggctaatttttgtatttttagtagggacaaggtttcatcatgttggccaggctggtcttgaactcctgacctcgtgatccatctgccttagcctcccaaagtgctgggattacagacatcagccaccacgcccggccaatcattcagtttttaatttttattaaaatccaaaatatctcagtaagtataatgtgcataaattgtgtcagttcaatgaattttcataaattcaacctacccatgtaagcagcacacaaatcaagatgcaaccatggctggatcccagaagccctttccaatcacagctgagacacagaagggtagccattatctgacttctcatcacacaatttacttttactgtatatatatatatatatatatatacacactacctatatggtcatttagtgtgtattctttcatttctggcttgtttcattcaatatcgggtttgtgagattcatccaagttgttgtgtataatggcaagtttgcttactctcattgctgggtagtacattattccattgtatgaatcttttacagcctgcctttccattctactcatgatggaccttggtgtttttaaaaggacctaagtgcttttaaaagctaagcaaatgattctagtatgctgtttctgaggttgagtatcaccaatgtagtcataaatgtacgtaaaaaaaaaaaaaaagaaaaattaatttgatatcccattaggcttccatagaatttgtggtagtgtttttaaatttgcataattctcatttttatttatctctagttgaaaattaccgacatatttagccagggtgtgctggagctgactcgtagcagctcatgaaagctgagtgttagtttcaggaattttgtaagcaagtcgtttaaacacagctattattaaaaattaaatagacatccaattaaaataattatattcaaaatttcataaatatttaaaattcattacttccaaattattttagaatattttcctattacttatggtcttgaggttgttcatatctattgtatttgtatggtggaaatatcatatcatggaaactactgtgcatttcttcccaaattatgtcatgttattatctggaaatcactcatgggtagtatttacaccacagcaactggcaaaagctacaaagcaggtcctcacttagtgttgatgctgaaagagtttcagtaatggatataatttgtatgacagtgagaaatagtctaagattatattgcatataatgatatatgattatatatatatgatatatatatatatataatgatagcaaatgcttactgggaataaagttagcagcagattgggatacaattccaattgtcaggtcatggttgaactgcaactgaagcttagctagagacataaatattcaataaaacttagcaaaagccttctatgaaaatcaattgacttatggaatttgtaattaattatgatattatatattttattatttttaattgtgggctacacatcacatccattgcattagtaaatttgataataaacatgtgtatatacatatatatacatttatatgcacacaaatatatgtatccacattcttttcagagacatggttgttaaataactgctagcatgctgctctgttgagctatgttttattttttagccatttttattagtggaagtatgccatgttttgcagatttattcggtacaaaaaacaaggtagagaagtaagtaccaagaccccatggtgcccttaggaatatatatatatatatgtatacacacacacacacacacacacacacacacacaaacatatatatgttctgtacatgtatatgtgtgtagatatatattttctatacatgttacattacactaaatgatattgtaattgttttgtctattttagcactaatttagattttgatattttatttttcatacagaattagtactaaattgaagaacaaagataacatatttggactcagttaaaaaaaaatctcaatctgaagatacctaatagtttaccagaaaacagatgaagagtttctttcctccctcataaaaaatcaaacttggtttaccgaaccttgcagctaacaacaggtgctgtctgctcactttgccagaagctcacaatagaacagattgggtacacacagaactaaaaacaacatttgagtaaggaacaaaaccctcccaaatattctgaccagctctataatcagttcttaatattgagcctggaaacaataatgatttctttaatgtcaaaatgggcaaagaaccttgtttgtattgttttgttttgttttacctgtatttgtgcacatgggaatttcagaaagcacttataatcaaacacaaaagtgctacatttggggttgtacagctcagaagggaggggaaaaaaaaccccttcttcttcgtaaaagtcttacagagaatcaccaatcacagagggagaagtgtgttctaatatcaaatctgtgtggctgcaccatcccttcttaattgccaattgtcttttccactttgtcctctttctgtaacattgctaaactgaatctgaggccagggctttaacttgatatatctaagttcatggccatacatttattttacttactcaaacacttagtctctcaaatagaattgatgatttgtcaaatgatttgttgttgcataatgacatagctgtggaagccggatcttgctttatgtttgagaacacatttccagagtccaaaagcacgtgaggattgatggcacagatgggcttgaagaactggtttcagaagtgccatcttctactcaactgccagtttttctgtttatcatctagctagacattctgaccctttgtatcctcccattgcttatatttttacaacgtcaaaatcactccaaatgagaaatgtgggaacagaaaagcaaagcaaagagtattcagaccacagaaaatcatctgtgcctagggactggcctggcagcctcttgttttctgtttgtcccttgaagacaatggaattgtaatccttgtaccaggagatcacaccatcctttccagttctgattacccaatgattctaagatgagaagcgttacacagttttacaatttcttaatagttctgatgaaagaatatatgaggacaacgcagcttgttttagctaaaaggcaatttgggactcttctgtgaattttatttatccatcttatgctattcccttgggtaattatgagtgaattgctctgtgctgtgtttcatcaaactttttctgactgttattttgaaattattatcaagagcatcactgaaggaacatagtcacaaatggataatgcttattaaactgcagtgttatatttgaatgccactattctatggctaaggttgtgctatgccctcatgtgccagccttgaaagctcattaatttgtttggttctgccagtcaggctggagtgcagtgacgcgatcatagctcactacagcctcgaacccctgggctcaagagatcctcctgcctcagcctcccaagtagctgggactgcaggcacatgccaccacacctggctaattttttaaattattactactttacagatgaggttttgctatgctgcccaggatgatctggaactactggcttcaagtgtcttcccacctcagcttccctagttgctgggattacaggcatgagctactgtgcccagcaaagctcattgattagtctgcctgtctgtcaatgcggtcaatcagttaattcagtgagatactcagacactccaaacaaactattaatctgaggagacaacctgaaacacatgattagcagctgatgtcgtaagaacataaacacttagccaatctgtaatcaatggattcatctcaatttaaactactgcttcttttagtggtaaacattgaagagcaggggaaatctgcaccaggaaacaacaagtttcactagactgacaaccttggctgagctagaactatgttttcagaatttctcttccctatccagatctggattagagatgaacaaaaaggaaatttgtgtgagatttggaaggtggaaatgatgctactctgtgaaagctgcatgtaagtttgtctggtgagaaagagacacaggttaacagagagctcgtcctctgtttccttcttcatatccaggttttggcccaactggtggcactactgaccaacattgaccttaggtccactccagttttagaggcaacagttcacaaacgcttccccttcacatgcccattctggcagctgaacttgctggcttccttgcaagatctgacttgaccacctgctccagtgcccaagagggcttgttagcagtatcactgtgatatttcccctctcacttttgtaccatcatcttctcttacaattacataaggtcttcctcctaaaatgaatcctctattttacatgattcacagtagttttgctttcctgattgaaccttaactagtatctgtacagttcaaatttgtcatacatgacaggggaatgatatccaaatcactatactttggtttttcctatgatagctggtgaatatggaggctttggaggggctatagttttcatgtagaatgtgattaggatactgaagaaattcttgacatatattaggactcagaagcctatgcaacttggcataggtattttttgtctcttcctctgtattgtgaagcctccctgtgccatttagtttttaggcagcagttcctgcttaccatccaaaccccttttgaaccttacagaatccccaaaagtcagccttggccttaagtcccacagtactgtgctttacctagggagcatgttaattcatgcataaaaattaaggactcaaggtacattatatcactgtacatctgagtggatttttttgtggcttaaccttgatttttagtgctataacccaaataaagaaaaatgcaagcatgcattggagggtattgggctgtaataaggtaataaagactgtttcagtggtatcatatatagtgctttacagaatatagggtattttcacacctcacctcatttacagttcatgatctctcatgacattattagagggtcagagatgttacatgcttgtccatggttatttgtgtggcttggaggaaccagaaaccaaccaagtgttcatatcctagtgttcatttcactgaaagatctggctttttaatgaagccgttggctcttcccattcccattctcattaccgctcatctaggctgttgcggaagactctgcaatcctcttttctcctattatcagccccactcttcctcccattacaccaataggaaatcataatagttttatgtttctcattttgcaaatgagtttcaatggtccatctgcttggatcaaacgcttcaagtgctgtccctttgctgcagaaccagatagattcttctcaaccttgtattgaagctctagcaggattccaatgagctttttcaaacttttttcctacctttcttctataaagacactttgtgctggccaaactgagtgcatcacccccactacacacacacactcacttctacaaggacttataataataataatcacaacagctacctgcattgaccatttagtagctgctgagtatctcactagttctttatctatattacccaggcaataaccatgagatgtgcattactattgtttccatttgtaatgaagaaatcaaagctgaagaggttaagtgacttactcaagataacatggcaggtcagtaacagaagttgtattttagcacggactgaattttaaaatggcactctcaaactctctgtgccactgcctttcttcgagcactccccatttcttacagtgcctgatccctctgaacacacattttcatttcttccttcccttcaagggccactccaaaatcagtaagtcttccatcatctccacattaccacttacccacagaaagtctccctctcttgaattcctacatctctgagaagatgcatgaggaaagagaagtataacttatgagtcggtaacattcagtgctcatttctcagtgcgttgcttggatcctggcatgcaggggcagctcattggcatcaactgttctaagtactggctaaacaagagacaagctctgaggcatatagtcacaaatatgggcagtaaggagttatcgtgggagtggtgaatgtggaggggctctgagtgggaaatagttcaacctcattttatagatcccacatctaggatacaaatcagttaagccacttgcccaatgtcattcagataacacaagagtacccgggagtgctgagatctgaacccaagtacacatatattcttcctgcattttgccaaacacaaggcaatttctaggcttagtggagttaatgatgagcaaaaaaaaggcacatcctagaagcttctggtcaaatggcagagatgctaagatacagattaaaattttttttaagaaaatacaagtttttaaaattgttttaaaggaatcaaactacacatctcatccagatgacagatgctactggggaaggaagcacagcacttatctatcagtagggctagggagctcttaagctgattaaggacacaggctccgcaattaaagacacctgtggcacatatacaccacagaatactatgcagtcataaaaaagaatgagttcatgtcctttgcagggacatggatgaagctggaagccatcattcttagcagactaatacaggaagagaaaaaccaaacactgcatgttctcactcataagtgggagttgagctatgagaacacatggacacgggaaagggaacatcacacaccagggcctattggggagttgggagcaaggggagggagagcactaggagaaatacctaatgcttgtggggcttaaaacctagatgatggattaataggtgcagcaaaccaccatgacacatgtatacctgtgtaacaaacctgcacgttctgcacatgtatcccagaacttaaaattaaaaaaaaaaaaaagaaacagtggttgtgagagaacagtgcagtagagtggtagggatgaaagacaaattataaatggtggaggagtggggagaataaaacaaaaacaaacaaacaaacaaacaaaaacaccttggttcatacctggcaccttactacttgtgtggcagggcaagctactgaacccctctctgtcttacatactgcatgacaaatgatacacattcaagtcacactagttttcattttttcctatcagttgccaatttcttgtactagagatctttacgggaggtcttacctaggtgttaccttccttttcacctagatgacgtatctgaaatgttgcccagatggggatccatatccaatgtatctttttactctgtctccgaagtacctaacatggctttggtaaatatcttttgtttagctagcaagcacatattaaaataatgaagtgccccgtgagtcacaatgatcatcacaaacagccatacgacatttcctatgcacttttacactcttttaatctcccaggtgattagatatatagcttaaacataccgtaagtccctcaggtgggcaaattgtattggccccattttacagatggggaaaatgagggaagggtaagaagcttgccccaaggtacagagtgagccagtggtggaactgggatttgaatgcaggctgtctcgctcctgaatctaacttcttagctgctagattcaaccgctgttcaacagagtgaagggatgctaacacccaacatatattgagcactcatatgtgctttcaaataattccatgagttaggatctcaaaataatttgacgacataggaaatgtcattctttttttcatttcatttatttattttgagatgaagtctcactctgtcactcaggctggagtgcagtggcacaatctcactgcaacctccgcctcctgggttcaagcacttctacttccctcagcctcccaagtagttggtactagaggtgcacgccaccacgcctgggtagtttttgtatttttagtagagagggaggttccccatgttggccaggttggtctcgatctcctgacctcaggtgatctgcccacctcggcctcccaaagtgctgggactacaggcgtgacacatcgcgcccggcctggaaatgttattaaccctgtgttttaggttgggctcctccagaagccgactttcagaaaaaaatatgaatgaaagtaatttatttaaaagataatccccaaaagccccagtaaatggtaagtgagacagggtgagaaaggatgaggtttgttattgagcagtgcacatctagtatgactgagactctgtatacaggaggtagtgtagaacacacctcagtgtcttatcagaatgtgactaagggaccaggaagctgggacacttgcccgtcactgccctttcatcactggcatcaactgttctaagcactgactaaacaagagacgagctctgagacgtatagtcacaaatatgtgcaataaggagttatcttgggagtgttgaatgttgaggggctctgggtgggaaatattttaacctcattttacagatcccaggtctgggataaatatcagttaagccacctgcccaatgtcactcaggtaacacaagagtacctgggggtgctgagatctgaactcaagcacacatatattcttcctgcattttgcatgttctctctaagcacagagcaatttctaggcttagtggagttaatgatgagcaaaaaaagggacattctagaagcatctggtctaacaacagtgatgctaatatataggttaattttttttaagaaaatacaagttttgaaaactgttttaacggaatcaaactatattgctgatatagagaataactcaggtggacgtgagtgggaagggtgtttaaaaaggcgtattcctggcaagggaaagccaaagtcactcatccgtggagacaaagcaggccagaatgactgatggggatgcagtgagtggcagaggaaggatggtatgaaatgaggaagaaggaagggaaaaggcagacatactagtctcagaggccctagtcatgctttaggatttaattctaaaagcaatgagaatttatcaaagagcatgcaattggcagaggatttgttcttctatttagcctaagaggcctccagattaaatgttctttctaaatacttaaaaaaggtgacatagtctaaaagggagacagcaaaccagctagaggctgtggtcaggtgtggggaaggaggggacattcagcctccttgttgtattcaaccgccttcctcagctctgtcttctcttttctgattctgtccacattccactttaatcctcaatgcttgtgagatgatccagagtttgactgcatatttagcttttcagggatactgcagataatgatgagaattattcatctttcttcagcataaaccgtatttaacgaggggctagaaaaataatataaagaggctttatggtcaagtttcagagctgagttaggaaagtaattccaagtagtagagtttcagcatattttatttcctccttttacttctctaaattttccaaatggatttatactatttttaaaataaaaatggtcaagcctttaaacatttgtgccaattatgtagatagcctgcaaagctgagacacttctcactatgctaatcagataactggctcaggctttctattttatttgataaactttggtcattctgaatttccaaatatcaccaaaaattctgactttgataaataatcaaatatttagctctattgtgtattttcttacaattttcaagtgatatgggtggcccatattatattcaccttaaattttattagaaaaagaatactttcgccggttgcggtggctcatgcctgtaatcccagcactttgtgaggccgaggcgggcggatcacttgaggtcaggagttcaagaccagcctggccaacattgtgaagccctgtctctaccaaaaatacaaaaaaattagccggatgtggtggtgcaagcctgtagccccagctacctaggaggctgagacaagagaattgcttgaacccgtgaggcagaggttgcagtgagctgagatcatgccactgcacaccagcctggatgacagagtaaggctccatctcaaaaaaaaaaaaaaaaaaaaaaaaaaagcaatacttttaatatgcttactcacactattcaaagatctttaattataatcatttaaaaactgtgaggtagaaaggacaataagtgttattctccccaatatacagaccaaaatatgggtaacgtaagctaaagacccacagttagtagcagaacccgttgaaaatcgagtgtctatttaaataacaaacctgggtgtctatttggggataaaacacccaatctctacagccctttgatttcaaaagaactgatatcccaggaagatagagaacttaacataaataagaataaccaaagtgaagcttaaacatttgtacaaaccttgacaatttcattttttgtattgtttgtattacccaagtcttatcacaggggacactgagaaccaaattaagtgtgtcaaaaatcaaaaggaaagatacataagccatctcctctgaattttttcctccttcccttgtttcttccttataaacactgctgggtacttaacttttaaaaacatgggctttgaggaaggacatagctgggtaccaatcccatctctgctctttaagaagttgggttacctctgacaagttacaaaccttgcttagcatctatctctttacctttatattagccacaatacccactccatagagtgggttttatatattactatttgtacagacttgcaagaatgcaaagtgcgtagaaagtgctcgataaacagtaactagtggtgactggggtaggggtagtgccaatagttgctttaagaacagttgaactagcagcaatggccaatgccattggcaaccaaattgtgctcataactctatggaccagatcttaagactccaacactgggaaatttgctgtcattctttgatccctgggcttaaatgtctacttcttaatgctatgagctaaatattcaatgttaaaatggacagggggtcatgctccatctcatttatcataagtgaataactgggttattttgaccatagatcaaactccaaaaatttaagcaaagaaataatatgtgtaggttccagaaagagatggggaaaatgtgaaaatacagctaaaataacccacaatttaaattttggctacagagttaatgtcctatttgtaaaccagaattttataatctcaacactgctgagcagataactaatcatattttgaaccaaataattatttgctgtgtgagcctgtagatgtttagcagcattcctgcctgtacttataaatgccacttgtgccaccaacccccggttgtgacaaccaaaaactggcttgactcccaaatccactggagcaaaagtaccttcgattgagaaccactgctctatactctttttttttaggcagagtctcactctgttgcccaggctggagtacagttgtgtgaacaaattcattgcagcctcgacctcttgtgctcaagtgagcttcccacctcagcctcccaagtccctgggactacaggtgcatgccaccatgcctggctagttttttaattttttgcagagacagagagtccccatgttgcctaggctggtcttgaactcctgggttcaagccatcctcctgcctcagcctcccaaagtgctcgcattacaggcgtgagctaccacactcggcctgctgtatactcttgactttagaatgctcataattctaaagaaccatgttgcatcgtgccttctcataaagcctcagccttcaatttcacaccatccaaacccattgaagctcttgagtcccttgacatggtaactcctatccctctcccatcagaccatctcctcatggaggtgacagacaattcaggaaaatctcccattaaatccactcccctaaagccctcttggaagagtaactatatgaactttatacttctctccctcccaactttgtacctactttctcagaggtgcttaaaaaatatcacttctctgaaccccagttctctcttttatcagtttcatgtcttcaaaaatagcaggattatattgccctctgcagatgctactggtgataaagaataaaaattgaaactgactttttatgtaacagcagtgtatcacaaaggaggaaaacaagaaagaagggaattaacaatgattaaacacctaccatgtgccagcctctgcactaagtacctataatattacttcatttaatctgtatagtgaaactttcgagtaaagttttctgagatcaaaagaaagtgcatttctgacattatcttttaaataaatggtcatttcagattgttccgcccactttagtgtaccatttcccaaaagcatccaagaatccttgtgaaaagtgaagacagtctgcaataactctctgtgtgtgtgtgtgtgtgtgtgtgtgtgtgtgtgtgtgtatcacaacttaacccatagttttggaatgtcagtcatctcaccaaaatccggaatgaactatgtcccagtggatcacatattcttgaaagggcagtcagatttctgataagcaactcatatacacgagagcaaaggcaaggttctatctatagccctgtcatgaggcaagctgtctctttttgaaaatgatttagaggcagctggcctctggtctgctagtctgttggtgtctcacttggctattcaacatcagaggcaggaatctctgcccattttcacataatgcacatgtcttcctactggaagatctttctccaggagtggagggttcaggtcaaggtctctgctcacaaaataaagacagaactcagcactatttatatcacaccagaactgactcagcgccattgcccatttaactcacttgtcttgctatttggagatgttctctctcttctggcttttctgccatctgtgacatctctccaggcataccgtaaggagaggacattttgaaggatcactctatttgtttcatcctagaaaagtttatatcagtccaattctgctgctaactggacttcgtctctggcttcttcatttggaaatctacctcttatgctaagtgcccttatatcacctggcggtttgcaaagaggtgagtgtgaatgctccagtaaaaacagctgcctttactaagctttacagcatgtgctcgatattgagctaagtgctttacgtgaattatttcatttaatcctcagaaaatcctctaaaggacaggaagtattataatctccatttagataaaggcaactaattaagataagttaacagctgccaaatttcatacaactagtacatgacgaagttgggatgtgaacccggacccatccaatcccaatgcccaaggatgttccactttatcacaccacctccctgtgagcttctgttgagattatttttttactgcctgatccacaatattattgtcatctttatttggcttggcggttgacaaaatgaatgcatttctagaatcttcaatgacgtgaaaattggattacaaacaaaaccatctctggaactgcctgtttcctgtattttccttttggggaaaaaaaaaaaaaactaaaataatgagctagacgagaattctgatctcagatatgccactacatgctcctgcacaccagagcaatgatgtacctctcgagacttctgtttctttatttgtaaactggtggggttggaattatgaattttaaattcctttctatctccaatacactgtgattttctgatgcagtgggtattactgcctcacaaagggcttacaaaatacactggagaaaacaccagtaatagaaaactctacattcattgctacttaactttgtgctcattcaaatatcttcatagtgtctctctccagagactccaagcacttacttaatttaatatagccctttataaaatgggtcttctctgcaaatctcagcttgaggcatttctctggtacccacacaatacattcgcttttacagaggctttattttttcccctaagaatttcctgttcatttagctacagccagaggtaaagctaacaaatttgtacatctcttcagaggcacccaatttactaaatgtcttttaattggcataggagctcatagaatgtcctctgagaggtcacgttaagagttattttgttaaatacaaaggtatagaggaggtattttcagatggaatctgaaactcaaacggaaattttttagcagcatctcatggaacttctcagttttcttatcacaaatgttctcctgtcagatcttctgtcgtaaatatgaccctgtagactgaacaatggaaatgacagccactgaatccatctctctttctcttttctgcatttaaaattcaagattataattgtagtacaaagtatgattagtaactatcagtgtgaactttggagtccacactaatctcctaaaatttcagtcatccattcaacaatactcatggcttcacccacatgctcacttctgtgtcccttaaatcagtggctgacacataggaagaacccaatgaataataatgctaaattgatatgccaagcactgtgctacaggtaaagcactgaacaaagctgacattgccccaatccttaaaaagtttatagtccggaaataattgtttattcttatatgcatgcgcccacacacgcgtgtgcacacacagacacactcccaagcacatctataatcagtgtattaaaacaaatatcttggcagagtgtggtgggccattcctgtaattccagcatttttggaggccaaggtgggtgatctcttgaacccaggagtttgagaccagcttgggcaacatggtgagaccccatctacaaaaaacacaaaatttggccaggcatggtggtgtgcctgtagtcacagacactcagggagctgaggaaggaggattgcttgagggtgggaggcccagactacggtgagtaccactgcactccagcctgggcaagagagtgagactttgtctcaaaaaaaaaaaaaaaaaaaaaagacatatctttaagagcatgtaaaaggaaaattccacttgatctaaggagttcaaataacactaccataaaaaattgactttctaactaaaatgtgaataaaattttaccaatgattagatacagtggagaagaggcatttagggtataggcaaaaacaaacaaacaaaagatcaaagtgaggtatgggagaaaacacagtctactcaaggctaacagcaggttagccaattgcagatagcaactgggagcacagcagatgaggcagcagggagaggcagggaccaaactatataggactttgtaggtccttttacaaattactaaggatactctactatattgtaaaacaatatgaagttattaaagactttctagctgcaagagggcagtagagcaggagaggcaaacaacaaagacattatctgatttgtatatgcaaaagaccccattggctactctttggtgaatatattgtgagagtggaaagaatgagaattaaaaggcagtcatagaaatcaaagccaaaatagcaatagtgtgatgcgggactcttgctgtagcaacagaactatttgaatagatttaggatgtaattgaagggttaaaagtgagacttggtattgcattttatatagatacaatggagaagaaggaatttgtcaaggaggactcttaggtgtctaacctcagcaattggttcactggttgtggcattttctgaaataaaaaaggagagaactaaatctggggtgagattgtaagtgcttccttctacattttgatttgaaaagctctgagtttattgtccctgtagaaatattgagtacaaacagtggatgtttgtggaataaaaagaaggaaaaggagtcagagttgtgatgaatttgggaatcaccacaacatgtataacaaaatatagtagaaatattgggaggccggggcgggcggatcaactaaggtcgggagtttgagaccagcctgaccaacatggagaaaccctgtttctactaaaaatacaaaattagctggatatggtggtgaatgcctgtaatcccagctactcgggaggctgaggcacgagaatcacttgaacctgggatgcagaagttgctgtgggccaagatcgtgcaccgcacctgggcaacaagagtgaaactctgcctcagaaaaaagccccagatcaaacttgaggctgtttgattcaacctggttagccgaagagagtggctggtagagaatgactagcatgcaacggtgatggagaaatattagccacaaagatacgaggcaaactagggagtatggaatcacaaaaagcaaagaaaaagcaagttttcaggtgagggaaaaatttataactcttgattattcaagtatatagagaagttaaaaatatctacaggtatcataacaagcatgtcacctacaactttagttgaactatgtctgtttatttaagagataagtaaaattgaatttactaagtggaaagtgtggaaatagaagcaatagatacagacaacaattcatagatagatgtttagctgtgaagggttttaaaatgtttatgctaataaagtattaatgagtcaaaatgtactacacatgatctctaaatatcactccacagattatttcttcattacaagcagagtaaaaggcctcctcaatgctaagaggtgcactttctactacaaccaagtgatcaaattttgcatcactcataatgagaccaactgaaataatacacctctggatgacaaaagaaagcatagaatattactcatgtccttttcttgccataatgtttaatcttaatctaatcctgaggaaacaatcacaaagttccaactgggaacccttctccatggcctgggatcttcaagaacgtcaacgtgataaaagtaaaaaatgtgaggaaaatgttctaattaaaagaagcgagagattgcatagtaaacacaatgttggtttgatattttaaaactcagatataaaaaattttggggggtttgttgaataaacttgaacatagattataatgaagtattgtgtctaccttaattttctcaagtgtgatgttgttatgattattgaaagagaatagtctttttctcagaaaataatgctgtggaatttagggatgaaatgtgatactctgcaacttctttcaaagcagttaaaagtaagaaatttaaattgtatttttgtcttcatttattgcatttatagatctcttaatttccttgtcaagattcaagattctatctagcatcaccttttttctgcctgaagaaatttttaaaatatatttcaagttcagctctgctgacaatgtaatctctgaatttttgtttacctaagaaaacctttatttctccataatttttgaaagatactttcactgggtatagaactgtgggcagacagatttttttctttcagcactttaaagacatcactatgttttcttcttacatgcatgatttctgaagggaaatattctttactttttttatttttcggtatatatgtataaattttttttctttattggtaagattttctgtatgtcttgatacttctatttgaatatgacttctgtcttgactggtgttcactgagtttcttaaactccccctgccctttccattttttttttttttttctttgagacagagtctcactctgtcacctaggctggagtacagtggtgcaatctccgctcactgcaacctctgcctcccggattcaagcaattctcctgcctcagcctccctaatagctgggattacaggcaccaaccaccacgcctgattaatttttgtatttttagtagaggcagggtttcaccatgttggccaggctggtcttgaactcctaacctcaaatgatccacccacctcagcctcccaaagtgctgggattacaggcatgagccaccacgcccggcctcccctgcacttttcttactttattcttccaggattccaattacactcagctcttagatgctctgttctgctttattcactctttctctctttgtgttttagtttaggaattccttaatgacatcttcaagtctaccaaatctttcctttgatatgtcaagtctactgataagatgaaggtttcttcatcactgctactatgttttccattcctagatttctacttgatttttaccatctatctattgaaattagcctgctgatgatgcatattgtctgtgttttccagtagagcttcaatatatgaattagagttatttcaaattctctatgtgatagttccaatacctatgtcatatctgattctggttctgttgattgctttgtctcttggtagtttccttccccccactgttttctcatatgcttaataactttttgctgaagctcgacattttgtccaaaagagtggagactaaatagtttctaaacctaagaataggcatgtttttacttctgataggtcgttagtgtggaagtttgagcaatgtagtcagtagttgtgctgggtttgggtttgttatgcttgcactctaccactggcttccacttcctttggttatacttgtgtttagagtgaggactggtttgccagagagtagtctgtttcactcccatctttagggtaatctcttcacactgcaactctctgttagtccatttgcattgcattcctatgtaaaaggaaatcctgaggctgtgcaatttataaagaaaagaagcctattttggctcgtggttctgcaggctgtacaagaagcacggtgccaacatcttctggtgagagtctcaggacacttccactcataggggaaggcaaaatgggagcaggagcatcacatggcaaaagagggagcaagaatgacagggggaaggtatcaggctcgttttaaacaaccaaatcttgcataaactcattgagtgagaacttactcattaccacaaggacagcacaagccattcatgagggatctgccctcaggacccaaactattcccactaggcccacttccaacactaaaggttatatttcagcatgagatttggagatgacaaaacatccaaactatatcaatctcggagtctctacccacacacttttgtaactctcaaagctcttaatcactgttagatgtcactggaggcttttcagcccgggagcgtggtggtaagaggagcattgctgttctaattaagccttggttttaggcgaattatgtccttaggtttcagaaaggtggctgcctccgtgttccagtgtttcccacagctgtaattctgggaagggagtagagttttatttttaatgcttcttatctctagctgcaatggctgttccctagttccctaagacacttcctcctgcagtttaaagcttttctcccaaggagaattaggggagggtgggatacaagcaggacttcttgtctttcctgcagtggctgctgttctcctccccatgttttgtacaatgaggattctaccacagtcatttttttgtgtgtgcatgagcttctggtggggcccaaggaaagagcctattctgggtgcaaatttccctgttatcttgccccaaggttttctacagtgagaatctacaagccagttaaaatttgttttatgcctgcagccaactgaaccacattccttctttactaatttgttaccaggtgagcaaatgctagcttaccctctctccccataggcacatatctttttttaggttttaagttagttggtattcctgcaatcacagctctctgactagttcaagaaaagttatgaatttgcaatttgtccaattcttttttaatgctgagagtgggcataatacttttttattccagctttgttcatcccaagcaaaagttggaggtctctgaaacttaatttcaaatagttcagcaaaaaaaatgaaaagaaagagaaagagtaaatgaaagagaaggagaaagagagagagagacagtgagagaaagatacataaagaaagagcacaaatgtggcaacatatcaagaattaatgaatcaagatgaagtggggatgggtattcataatactttccatttctgtgttgacacacaggcagtgctcaattaattaccttgaatgtaattaagacataatttgctgaatgacagtattattcttgttattagttcccaccaaaatagatgaatcaatttttttccctttctagtttgacattgttaccctaagatactaatcctgctgactctatttttaaaatccaggtttactaaatattttatctacttatctgtcagcaatgtttcaactagaatagaaatgcttttgcataaattcatcactcattgagggatcagctaattggaaagagcattagatatggaattttgaaaaacaggcttaaatgcaagcttattcatttcaccaatatttatggagatcttacagtgttctattgattgtatgagaggtttgggagtgaatagtagctctgctgcctctcagtcccttgcacctgcacacatttatatggtttgagccttggtctccacctctgtgaagtatggataacaacgcctccctcatttgtgagagttaaaatccctgttatatgataaagtgctttgtgaatcataaacaaatgatccaaaagcatattattctaattctcttttagtttcttcctcacttgttcttattttttttacttttttttctttgcatttttgtaatgtccttggccttggtttcttactttattttattatgactgcttacactgttgtagtcatttacaacttcatgttaatcaaaattgtgaatttcggcaaaggcaacagtccctgcctagtgtatgaccttttttcccctttgatcttggcatctgaaagctttttatacattctaattctcttccattttaatagctctgtgaagcagtactattttctttgactgataagatcattgaaggtgacctgattttctctagagatgcacaatgaataaaacacattctccactacacaactcacttactcacatcccatgaagggggaaaaatcctgaggttgctctctctctataaaggtcacagaaaaaggagatgacttctcagatattgtgattatgcatgtatcatcaaattatgcaagctgcttattattccaaatcttaggggtttttttgttatttcatcctgttttacataaaactgagtagcaaaagtggcaaaacaaatatagcatttgtctttgtttgtgtatttttaatgagccgaataacacaaacaccttaattttgagggtgcatcttgttgagacacaatattatagatacctgtttgtacttgtgtgtatgtgtgtctccaggtattacatttatgcagttttcagttggaaaggtgacctctttctacggagtatgtgccctgcacatagggtttatcccttgtgactggtttgtgtgttaaggattcatggcttaaacagctaggttattcatgggtgtggaaaattgatatttgagagcattttattctgctcagtcaggctgattctttataaggaatcaaaacagtgataacatttaccaaaaactactgaatagaatattcaatgtgtatctatgccacacattgtttctttccatacactccatcataaaatacctcctctgcctatcatcgctctgacaacgtcactgccaaacccctatcctcatacactcatcacagaacatctcttcattttgttcagaaactgtgcttttttttcttaatcgttctgcttttcaaagctttattctttctaggcattcaatatatattgaataatttcaaggtatttttatattcattcattctactaatattttcttaactattttcagctactcttctaaacatcttgttcaggaattgtggaagaatctactcactgttttgtcccaatatccaagggagaaaaataaaactagctcaacatccctgtgcatgaacttttagtaactttatttccccactagaactggaatctgatgatgagcatctttgttctccagatttcaaggaggtactccaggtagctgactttccacagagccctagaaagtaaatcatggaggtgaggatactgttctctgaaattaatatagaactatagttacttggtagtttatcttgagcaagtcttgttaattctactgtaattcaaaatggtagtatcatcctaggaaaggatgacaaacatgtagttatagtgagtattctcttggtttaaatcacagcattaatcggcattctgtattaagaaaaaggcaatcatttgcccacattctccttttccttagttttttttttttaatttttagcttcagaaatgtaactcatatacaaagtacgcctatagttataccatgtatcacacatttcatatgagtaaaagaacagaaaattgatgaaacatgcctgaatgcttgtgatataaaattatatttcagttccagctataaaagtgtaatacaattgaaatgtttatcatgcatctatgaatattttttcttgcatgcataatggtgttgcatgaacaatttaatttcttttttgaaaaaagtcatcctagagaggtctattctataccttttcgacagattcatctaaagaccagctctataaatgtccagattgaatgcataaaatgtattgtctcaagtgattattgtttaaaaaaatttaactgtattgttaacttactgaaaagcactggcataattccgcaggcatggcctcttttcttcttatcttcatgtgtgtgctaatgttgtgatctttttaaaatgccaagatgaactgtccggtatacgaagataaaagattttaaaggcaacgcataatgccactgaattcctattgaaatttacagttttcaaagaaatagtattcattctaacatcaaaattattgtcagaaaaatataaacatagtaaaataaaaggcacctgtgaatccgaagctatcatggttcaaactcttctatgaaaacacaatggcactcaaagacttactatggcttaatatctattattaatcaattagtatttttcattgtatgaaaaatttataactaaaattttaaatttaaaaagaaatggattgattagaggccaggtaatcaggctcttggccatgaccatatttttttttttcagtattagttaagtaccaaagtatttcacaaagtccagtattcaattgattgcacaatacacaactagatttcatatttttgtaatccttggcattacttattttctgcacattctggacacattcctacatttttatttaaatggcttttacatcttataaaaagagtactttttggattcaaatcccttattccatttctggcaaccttccaagagaactctagtctgaatcattgcattgattttctgttgctgtataataatattaccacaatcatagtggcttcaaaaaaaaacacatttattatgtcaccttttctgtgagtcagtagtctgggcacagctcatctgagtttttgcttcaagttctcatccgaaagctacaaccaaggggtcactcatgactgggttgtcatgcgatgactcgactagggaagggcctgctttcaaactcatttggttgttggtagaactcagttactgattgttggattgagggcctccattcctagctggctagcggctgaaggccattttcagttccttgcaattagggcctttcctacacagatgcttgcttcattacagtgtgcaatttgagtaggtagtagagatactctctcacaagatggaaggtataatcttatgtacctggtcatggaagtgatatctgtcccattttctgtgttttattggttagaaataaggcacaggttccacctacactcaaaaacaagggatgtaacagggatatgaatgccacgaggctggatcactgggggtcatcctaggatcttcccagcacactttttttgttttacatttggtagtttggtaatttttccaaatgaatactataaaagtgtaatagaagaagtagtatatgtcattgaatgtagttctaacccagaaattacagtgaaggtaacgctcatatgataggatgggcagtttcattattatttgtcttgcctgttaccaagcattctaatgatgtttcattgagaagactgttctttgagattagtatgtatcataaaaatgcctctctttaactaaattgtggatatttgtctatgaagttcaggtatttgttttcataataggctgtatttgaaggacacaaaaatttatataaaaatactaaacaaactgaagcccaaatttgttactagttctagtgcaccaccatgacatattgattacactgaaatacaataatgactctcaatatggacatctgaaaattaataataactatttgattgtcctaggaaatgatctggatagctaaatatagtctgactgaaacttacgtagcccaggcattaagtacatatttgaatgggcaaatcttatgaaataatgcattatttactagaacattttccctactggtattttctactagaagtccaaattagggaatcatatgaggatataaaattaattcaaatatataaaaatattttggctgtgtttacagcattaggaacaagctgtactcattctagcattacgttaatgtacacttggtaggcattagaggaataaacagttctaactacaagaaacagtaaaaaataagatatatatactcataagtcttctcattctgttaagagcagttagtaaagaattatttctaaaatttgtgaaataattattgctcataaaatttttagctaataagaaacttcagatggttcagaaggtaatagaatatgtcctatttggttcaggaaacttaaaattccttctccttaaaagtgttggattaaggcgtttcataatttttgaaaaattttgtatttattggcagtggtttttacacttagagattcttatttcttccacagtgaaattgtttatttaaaaaagatgtttctaaaatatgtgaagagaaaaaatagtgcaaaatattcactttgataccaagaagagctttgattatacagatactctaaaaaggtattaagaacctccaggggttccatttccacagtttgataaccactgcattagcacaaatccttggaagtatgaaacactttgtctgtgtttggtataaaggccactgaatgtgctaatctatgtgaccttggcatgtagtcagcatctgttaatagatttcaggatataaatgagatagtgcatgtaatgtacttacaacaattaatgacacaataaatattatgtgttagaaaagctacatgtagcatagtaattgagagtacggactgaagactgcattggttcaaatccttgctgtgcccctctgtaagcttgaataaattatttaatccctgtacctcacttttcccctttgtaacattgagttattagtaataacaacttgtgagtattatataaatgaaaaacacagtgcgttgatcacattaaacactatgtaatttaaaagatcattgtaaattatttagttcctagagacagatgtattcttaatacattttaggcctttgttactttcagtcatttaacaaatatcaattaattcacctactacatccaaaacaattcaccaaacagtatgaagaatacaaaagggaatataaatgtgatttttgtgatggaagtgtttattgtttaatatagaatataatatattcacatataagtagcatatggaagaaaacgaaagacagcacaagaaattaaattctcagagaagagaaaaaaagtaacttctatgtatttatgaaagtcattttaagaagtattcagaaggttgttagaattgagtcacagagatggctgatgttaccaagggttacttatcattggaaaagagattcataggtacatgtttaaatatggaaatctttcatatcttcagacgttatcgtcagctcaaacccgattttcacagatggcttcacacactgcaactactctctcataattacttatgagagaaaatgacctgtttccctttggccattttgagaaactttcaggaaaaaaaaaaatctttaatttagaataacttaaatattgggccttacagattgactggcaaagtcaaatccaaatgcaagttatttcactactctgcatcccacttaggtgtttttctttcgtgaattatttcctgggagttagggctctttcatcttttatttgcaaagtgaaaagcaaaattgactcatcttaacttctaatttagctttctgaatcggaaagacaacctgaaagtggctgtggggaggagcgctgcttggtctagctggctggagaccttttacagtgtggatggagcccctttctcaatggttaagtggctgccacactcagtagcctttctgaagtcgcttggtcccattctttttatttttttctttttttaataaaggggttaaaagaaaaaaaaaaagaggtaagataaactgcccttgacagtatgattcctttcccttccctctgcccaaatacagatagaaaggaagtctttccatctatataaaggcctatttcatgttaccaaagaggaaaagagaagttgagaaatgcagccaattaggagaaatgagagcaaaacaggtagtacctccgtgtgtcctagcaaatggcccaacacgaggatttttacctattttatccacatagaatggcttgcgaaaagcctttgttgttgttgtttttacaattcatagacttcccactgataaattccaatggtcgattttccccttaaagtgaaaaccttcctttgggaggcaagcaactcaaaaaaaactgcctgatgcgtaatgaagtatgttttttgtaacccacaccagttctatccatacatactttttttttttctttctgacaccttcacctcctgccttacgttcctttgagctatggaagccaatgaggatgaaataattaaagtttgtgcctgctgtacaaaaatcattctccataggctctgtttttatttgatcttttgtagaaaacatagcgtctttatgtacacagttataggcccatggtgtcaggctacaaaggcttcatttcctgctatccagagtcctggtgttattctccaagcataaattctgtagtttccctcctctagcccagcaggtgtctgggtttcatttttggttgttacagttttcatagggaggctggggtggtctgaagtgtcacagcagggatccagcattgcccctacccaaaatttgctacataatttgtgaggccaagggaaaaatgcaaacgcaggacctcttgttcataaatcattaagtgggtgtttttaaacacagtgtgctgtgaagccacacaggtcagatgcccaagaagctggctctgcccctactgtgccagtgcctcctgggcacatggatggcagggaccctgtgtgttgcccttctgtgaaacaagaagtctgtatggttggttgggcaccgtatggttggttgggcagtctgttctttcctgtgcacttcctgtacctcctatggtggtccacacctcgaaagccccacactgcaccaccttccttggaggacaactctattaaattctgcacacccgctacccctgccaaatcttactcttttttttctatttaaatgccatttattcacaccccctgcaaatacatacatgcaaaatccttcataatgacccaatgatgcaagcaaatagtcaagcaatgcttaatagcaattgaaaaaccatatccccacctcaagggtagagaggactgaagtctttatgaactcaatggctagtctgcatccccagaactggaggggaatgcttgcatttcttcatttaagacttctcccctcctcctttccagaatgaactgaaagaattcttacaaggcaccacctcttataaccctgtcccccaaaaggagatttttatattcaaaaacattgtacattcatgtattaaggcttttagaattagcaaggactttaactctttggaatttgcagaagttgataatgcaattatattttttaaaagtttacattgtaattgctttagaaaaaaaattagtgatactgcatatacggaattagccaagcctgtgtacacttgctgtttctgtggtctccatggactggaatttggttaaaaaggcaagtttatcaattgaggtttttaaaaatgcctgctctttcaacaaacccaacaataaataatgaaaaataattaacactgtaatatcaaaagtgaatattgccaaggacaaagataaatgatagccaaaaatacagtgaaaaatctcaatttaaatataggaaaagagaacttggcttctagagaacagcaggtttcctcccaagcctatgctgagtaatatgatatgaaattgttaccactgcttttctattagaaatcttccaattcagttttctttattgacccaattccctggtgtttagggctaggctgcttttttctgtacacatgtgtgattgcttatccgtctagcctaggcttgagttattttatttgattggtaacacagacctggcagaagcttcacctttggcatgcagatgtccacaggtgatgtgaaaagagattgaaaaaggcatttgctgataaaaacaaaacaaaacaaaacaaaacaaaaaaaacaagctcagcatgatttgattgccatctagctacaaagtgtagctagaattgatacagtaggccagaaattataattatatccgccttacaatttcagaacagccatgtgacccaagtttataattgttggtgccataagagacaaaatagctgagtaaaccactcctacaatgtttttgaatataaaaatctccttttgggggaaagggttataagaggtggtgccttgtaagaagtctttcagttcattctggaaaggaggaggggagaagtcttaaatgaagaaatgcatttatacaaaacattatacattgtacattcatgtattaaggcttttagaattagcaaggactttaactctttggaatttgcagaagttgataacgcaattatattttttaaaagtttgtccaattccttcctgaatcctttaaagtgcttaccacattcacttgtacatcctgaatagacttagtatttgtttaataaagggatatatgaaataattttggactgttagagccagaactttagattatatataccttgactggtattacattgcctccttcatgtcgactccatttcattatctgtggatgcttgcatttagtactaactgcaatgagaagcctttgaggccacatctgaacccaatgggaaagaatcctgtgattgaatagtaatgtctgccaaacccaaggaagagaaaaaaatgccaccatctctactataaagtgactctcctccaccagaatgtgttccatcccctctttttacaggcaaacaaattggggatcagagtggcaaagcattctattgcatatcacaaaattagtagcaaaatgatgatatgaatttaggttctcagactctggttgtattagtcagctcagtctgccataacaaaataccacagactggctgtcttaaagaacagacatttacttctcacagtcctggcagctggaagtttgagaccagggtgccaacgcagtgaatctggtaagggctctcattgatttgcagacggcagccttctcactgcatcctcacatggcctttcctgtgtgtttgcacaggagaaagggagagagaaagagaggggagtgggagaaaggtctctgatgtctctttttataagcgcactatcccattcatgaggaattcaccctcatgacctcatctaaacctagttactcctaaagtccccacctccaaataccgtcacatcgggggttaggaattcaacaaatacattttaagagcacataaccattcggtctataacgttagtcacatgcactttatatgtcacaatgtctcttctcctattaggctgactctagttctctttttactgaaaccgccttgctttttgtatcatcgttttaggcttggagaattctaaacagcctctaggaaatatacatggttgagttgtttgacaggttatgaacacattgtgatcaaatgcagtgactgtttataaaatgggtgccttgcagaggagagtttaagcaaagtttaagaattgggaaaatccttaatcacatctctacagaaagaaaaaaagctgtaagagaaagcagaatggtacaggaaatactcctcagagaacagcggtgagggagggataatatgaactacctataaaatatgctcttgaccaaccatatatcaccttcagcctgttctttttgacgcgtgactcactatctagggatccccttctgttggctcacttggcagcctctgagattagttttcccaaagcaatttattacccaggtggtgggtacatgttacataagtccaaaagtcatttctcaccacttttcttgtcttccttttattattcttttaaaatatatgctacttctacttcattattttcaaccatctcagagcatgttgaaagtattgacatgtactttcagcatgaggaaaggaagttactgcagataacataagaagaaatatgtgtttagtctctgtccctggttctaatactgagctcctaaaactcttacaatttccttagtgatgagtgctatgagcatcttttgtcctagtatttgttttttgtccctggttcctgacacagaactctggagctcctgattccagagcttggaatttcctggatcataggagtgtcatttgttctaatgatgtgactcatggtgggctcctggatagcttcagaatgggagctggccactggaaagcccaagctgttagtagaagcttggaactttcagtcccgtctcccatcctccaggaaggggagattaggttaataattaataatgtctatgtgatgaagcctcaacaccagtccctagcctatgaggtttggaaagtttctgggttacaaatgcatccatgtgccaggtgggtggtgcaccccaactccacagggacagaatctcctgcacataggacccttctggatctctccctaggtaccttttcagccagctgtttattcgtatctttgtaaaaacctgtaaatgtgactaaggttacagcaaattatctcatcctagagggaactgttgaaactcctaatttgtagccaagttgagcagaagtgtggacaccctgggtacccaatacttgcaactggcacctgaaatggagggtgttcttgtgggattgaactcctaacctgtgggggctacacttactctaggtagtttagtgtcagaattgaattaaattgtaggacacatccaattggcatttgcagagaactggagaattacttgctgtaaaagaaaaccccatacatgtaatgtcaaaagtgttgtgagtagaataacagctttcttttactctaaattataattttttgaaaaatcactgttacagttcacattctgatcacaataataggtaagcagagcctcattttgacacctacctactttattgcggtgccgtgctctagtatttagtctgtatctcaaataactcttcaatctgcctcgtccttttgatccttttaggtcagtccttcattatctcctgttagaagtctcctaattttctaatggataagctcatctagtggataacaatgggataatattcaaaattcttacatggccagaaagccttcattgattcttttctgtagggtaccaccaattctcacttttctgaagtgcttatctttcccaaggcactaggattttaatttctctacatcttttttacttgctagtgcctcttcctagaatttcttcccttaccgtgtatttctagcaagctactactaatctttcaaaacttaaaattaatatcttctggccaggaagctatttcctgtctagcattctggttgcaggaaactggagcccacatggaccatactatacattatttgcagcatttgtaggcaaaggtgcctcatttgctgcaaatgtataatggaccctgtgctcattgagctccatcttcagtctacagagtccagaactgctttcagaagttctgttcttctggaggtaaataaatggaacctaagtccaaaattatttatacattgtcacagatgcacacctgctgctaggcctcacatgtgcaccccaacaacaaagatagcaatgacaaccacacacacacacacacccctgttgtgctcatatatgtataaatacactcattgtacagaaagccttaaaactgcccttgaatatgaaaataagatatttctcttttatttttgtcctcccttatccagcttagaattagtctaccttcaatgcatccattattgcttcctcaacttagctcacccacacagcaattaaactccacgtatttgaacaactcaaaaattccatgtgtgcaagaggctaagtgcataagaatcctagggcctagatgacaagaattactaaagaaacgtagcccactccttctcactcttttgcagttttgtatgttatatgtacattagtatgttacatgtacattaatttgcctgaagttgctgtgttggcttaatggaacaccattgccacctgctagccatattgagctattaaagtcctgcaattaaccaaattaagcgcaggttaacacaatcaggttttgctgtgctattgttttaaataacttttacgtatttaaatttagagtgcacagtgtgacacagcttgccatttaatgactcagcatgcatacagtaacctcagctaaccagcattaagtggaagtattatgtcttggcactgaagaatatagactgacatcaaaaataagagtttcaaggctcagttccaccatttgttagttatatgatctttgataagtcacttaacctgtctagactcacattatttaaaaaggtaaaaatagaataatagtagtgccttcttcatagggttgatataaccattaatgaaataagaaatttgaaatgcttacgtgataactaccatatggtcacaatcaatggatgttcctgcatattatttctctagcgttattacacctttcttctgattgccaaatatgtaaattcaactgtttctctgggcctccattttctcatgaactctatggtttaatttataaatatgttccaatgtagtttcatttgttttataaaatacagtccactacaggtagtgctccatttgttcaaccttatttgtatatgatgcagtccactctgtgaacatcagatttcaatcatcattgccttcccactgcactcacttttataaagtcaaagcataatttatagtaaataaaatacagtgatcttaagtgttcagatcaatacgttttaagaattgtatataccatgaaactgccatccaaaacaagatatgaaacgttttcttgtatgtaggaaatgcctcatggcttttatctatgttttttttccccaaagcatgtgttatccttatgcaggccctatgctaatctctgcatcatgtccattttagttcacgcaaccaaagtagacatgacacattgcaattctgatcacctctctttttctcacaaatccagtagaaattataaagaagaaaaagcaacaattaatccagaaatgctatttagtcaattgaagatcaacacattctaggtgagcgctgccccaagaatgtttaaagggagaaatcttttaaaataaaatgcaactataacattattgatatttttaaagggagacaacaggatatctcttagagaaatggaagtacctgtacagggcatcatgttctcagactcctcacttcagaatctgattcttagctctgtggacttgggagactgggttttcttagcattctcagagtggatcagatctttatggagaaaaacttgcaaagaaaatttagaaaacatttacatataaatcagaaaaatgatatatttacttacattaatatattaatatgctaataatgtattattgtaatctgctgttttcttttttcatttaccatatacttacatctcttatctaggattccctgttctcaacctttagttcattatcaccctcctctcctcacaaaggagacttttgagaccactgccaatgaaattttgatactgcatttgtattgtttatctgtatatatctgtttatgtatttctgtgccttatacatggaaagtaacattttctttcatttctcccaataccccagagccaattttcacctccttgggggtgatgtcaactccattgagaacatgtatcttattccttttttcctgctacctggcagcatgagatgttatattaatcctgtctttttattttctgtacttttgatgctttgacatctagggacttgctgactctggaaagactgccctttccaaagttaggcaattcttagagattaaaaaaaaagactccccttccagcatccttttcatatgcctttaataggcaaatcaaacaatctactacccacatcccaaccatctcctttactgatcctttacactccacgccaggttcagcttgtcctaattattccggggccaggttccagacaactaaagacagcctctgcaccccagaatctgaagagatgatccaactagccatttctaagccttcttacattgtattcttttccatggaaacctctatacaggctcttgcctatgtttttctccactttctctgcctctaaactgagcctggtgattcctctgaaaccctgcatggtgggtcctgccccctcctcttgggacctgtgaataataaaccatcttttcaatggtaatcttctcctgatttcttgggttcatgatacctgaatagtaataaaacctaaatttaaaaatacctatgtatcagggagttggttggccagtatggaatatgaataatcttgagagatatttgttagagttttgatgaagacttgtaaattccccctgttccttagaaagagtgctgtgaaaacactaccaaactcttgttctttttacttttacttttcttttctgggtctatacagacatctttatagttaattgactttttagtaaagagtaactgattaaactcatagcctttgtttaggctccacctgattctgccttcttagtttaccttttgaatgaaactgagtgtctccaaacattttcaggcatatatttatagtcaactcttgtggctattttgacaggtggttgacctcattcattatgtattgaatcttactattctcacctttagtataatcttatttctacatttttgggacacatcactgaaaccttctgtgttccatacgagacctgtaccagatatctctgcagccaaagagaagttttttttttatttttattttttcatgagctaacacaaggcttgcacaaaactcagcagcaagtaattcctttcttgtccagtatgaaaaagtgctgtctttgtcataaagcaaaaagagacaatgaaaggttaggttcttattgccccatctcattattgttaatgcaaaactagactaatttgcttgtggttatggaaatacctcctttaaccttggtgactgaatcagaaagaatttgttttggagatgggcattgcttaacagcatttggcatttgctcaggctgagcattcatcgtgagagtaagagccttctttccttctttagtgtagtaatctctgcagaaatatcacatgaaatatggtgcagaaaaccttcagcatagtggctgggatagaggcagtgtgctttgagtaaggctcttcagttggggcctgcattttctctggagccaagatacttctgacctcagcaaatggcttaactgctctgataaaaagtggatgataatgataacacttccttcttttcagatccataagaagaagagatttttttgtttttgtttttgtttttgtttcatctcctgctgtatgcttggtctctaaaagtgactggcagagggaagacaataaatatttgttgttgaatgaatgaagtgttatgatgagggttaactgacattataatgcaaagctcttggaccaagacctgacttatcataggccctcgaaagatattccttccaaaaacaatgacagcaaaaacaaaataaatgcttcatactcaataaagtgtctggtgatgggtttataggaaatttagtaattttaatattaaaaactaccatttacatcatctgattatttattcgccaaatatgtatcaagcaatcactaaataccatgcattattgcaggtcttggagatttagaggtaaacaaaaatagccacaagtaaaagctgtccacctataaaactttctgcccagcctagcgcaggttagagttcccatatgtctatcagtgatcaatagctgtgggagaagaaacctgtagaacactgaaaaaaataaagcattcagatcattaacttttttattaatcttttgccatttgtggatctgtcagcttctctaaaactcttgagatacaaaagcattatctctgagacaagagataattcccaagctctcctcttgattgcccacgtttgcctgagagaatttctcaaccagttgtttcaggttatagacataattggctattagtcattgcagtgccattgttcattgacatacctctcagcatcatctctcacccatctgcaaagcaaggtcctggtttctgattaatctttggctggtcattgaggatactgaagcagctcctggttaattagaccattttgtctctaacctcatccattctctggatgtaataatagggatagaggtggcagcaattgtaagcacagccctgaaaacttgctaatcggcctttgtgatttgccaggggtgccattgtttaaattgttaaagccaaattgttgtgagaggcagtaagtgggcatttttatctccaagtcaattacacacatttagtgaaacctaaggagctcataaattaaaagtaaataagtaaataggaaagcagcatctacaacacttagtgatgtaagtcacacacatacacaccacatacagggtgataaaatagcaaaatgtgcacttatgtggagaggaagcccacgtagtgataaggggtgagggctcctgagtttaccagctgtgtgaacttgggcaagtaaccgctctctgaaccttcttatctgttaaatggaagtaatattaaagcctacagggacatcaaaaggattaaattacattaatattttatgttatttcattaaataagattttataaactatctcaaagtctgctctattacgtgtgctaattatctggtagttactattattctagaaaagcatcctatcccccctaactcatgcaaagaaacaatgaacgtttccaatacttcacattaaaaaaattactttgacagtatccacaggaaatcaggtaaaaagcaaagacagacaagcttagctctttccactggactttgtgagatgtgtctagttgtactagagttcaggcgagcattctaagagatgctggagggcagaaaatgaagtgaacttcattctatgaagcacttgagacttgtctttcccagtatttccccatcatctctcaaagaactgcctattaataaaaaacaaacaaaaaaaacttattccttggtatgctaccaaaaaaaatattcttcattcaagtaagtttggaaaccactgagtattacatttccctgtgaagaatcataatcattattttggtgttaaaaggcctgagaaatcaggaaaagctctaataaaaggaataaaaagaatagctttgaatcctttaacctaatttttcaaaaataccccacacaacatgtgttaccacacaaattgcattttgaaaaaatgctggccaggcacagtggctcatgcctgtaatctcagggctttgggtggccaaggcaggtggatcacctgaggttagggattcgagaccaacctgaccaacatggtgaaacccgatctctactaaaaatacaaaattagccagtcatgggggtgcatgcttgtaatccctgctattcaggaggctgaggcaggagaattgcttgagcccgggagatggagtttgcagtgagccaaggttgcaacattgcactccagcctgggcaacaagaacgaaactgtctcaaacaaaaaaaaaaaagaaagaaagaaaagaaaaaatgctgagctacaacatagtaggttgaagagtgtcctccaaagcatccgcacccactcagaaactaagagtgcgatcttatttagaaacagagtcttcgcatatgtaatttgttaaaaatcttgtaatttgttaaaacctggattttgactgggccttaaattcagtggctgatgtctctatgagaaaagaataggacacacagattcagagaagatggtgacgtgaagatggagacagagattgaaatcatgcatctacaagtcaaacaatgccaaggattgctggcaaccaccaaaagaaaccagaacgtcatgggatggtttttccttcagagcctccagaaggaaccaaccctgctgacacctcggtttcaggctgtagacttctagactcctgaaccatgagagacaatatatgcttttttttttttttttttcctgagacaaggtctccctctgtcactcagtctggagagcagtgacaccatcacagctctctgctgcctcagccacctcaggtccaggtgattctctcacctcagcctccctagtagctgggactacaggtgtatgccaccatgcccagctaatttttgtaatttttatagagacagggtctcaccatgttgccaaagctggtctcaaactcctaggctcaagcagtccccccaccttggccccccaaagtgctggaattacaggtgtgagccaccacacccagccaaatttgttgttttaagccacctagtttgccaaaattggttgcagcagcactaggaaactaattcatatttagtatttttaaatggctatttgaaatgtaaaaaaaaatgccatgaaatatattgcaattaaaaactttgttctctctgctgcctatttgttttggttccattttttggcaatttgaggtagaggaattggaacacagacgggaggagataagaagcactctctgctaagtgagtgattaagagctcactcatggctcaaaaggaaactctccattatattttctattatcacttgtgttcttgtcaatataagtacttgccacttgtgaatcattttggcgtttgcaaaaactttcttaaacagtcaatttcttccattctaccaccaaaagaaacaaataaaataaacaatagacaaatgcaatagcaatgtttactaaaattaagtttttcactctgcttagctttgaaatctgtatggaaaattaagataaaggcctacattttcatagataaagcggtagaaaactttgtttttagacatatatatatgtcttttttttagacatatatatatattttttaagatgaagtctcgctctgttgctgaggctgtcactgcaatgttcacctcctgggtttaagtgactctcctgcttcagtctcatgagtaggtgggattacaagtgtgtgccaccacgcctggctaatttttgtaccgttagtagagatggggtttcaccatgttgaccagactggtctcgaactccttgcctcaagatatctgccctcctcagcttcccaaactgccaggactacaggcgtaagccaccgtgcctggctcagcatgtatttttaattcagctctttggagagctgcatctactgagcactgcgtgggcttagtctcactgtgtagttgaatcttggtggatggaggccatctgtggtacctctaaagctacagtaagaacagccaatgccatggcatcaaaggaagccagaggcatttggaccttttggggtctggcaggcaaataaagaaaagactagatttggcctgagtctagtttcttctcatctggacactagctcatagctcataactgggctctcttttttaagctccataaatgcaagcatgacatgcatatgtgtatacagaatttggacatgttttccaaattgtaaatgtgatcacagccttaagtaaaatttatgtctcccaaagccctcaggattagttcctcattctttaaggaggctcaaaataacttcatgtcactttggttatctctctagccccatttcttgtcaactttttccttaagaagaataacttgacttctctaaatactcctttatttctctcagggcatatgcatttacttaccctatactctttcttctttctttccctttgtttctttcgttctttttttctttttttttttttcccaaggtctgattttatcgcccaggctggagtactgtgacacaatctaggctcactgcaacctctgcctcctgggctcaagccatcctcccacctcagcctcctgagtagagtagctgggactacaggcaccactgtgcccagctaacattttgtgtgtgtgtgtgtgtgtgtgtgtgtgtgtgtgtgtgtgtgtgtgtattttttgtagagacagggtttcactatgctgcccaggctggtctcaaactcctgagttcaagtgaaccactcaccttggcctcccaaagtgctgggattacaggagtaagccgccatgctcagcccctattctctttctaaaagaatccatttgctctttttttccctatgattgggttagcatcatggcttccaatgtttgactgaatggttttaaattctaccctccatgaaacgggaaaattagcttttttttctcatggagttttgttgagatttgaatcagataataaatgccaagttactacatataacagagagttgtcaaaaatatcatcactctcatttttcatatcccagcttaactatcattggaactgaaaaacactccctgaacctcacaagattcgattagataaaattagctgtaactattagaacaaccccaacatcaattcccttatatccagtagttccacttctagaaaagtttgctaagaaagtaattctaaatttaggaaaaacttttattattgcattatttataatagaaaacaaaaatatggagctacccaaacattttcacttcatttagacttatcagtcttgtgatggattgttagggaccttctgaatcatattattccattaaaaataaaaattcacaaggacaaattaatagcatagaaattcctatgttatattgttaaccgaataacagcagggattaaaaattgatgggatagtatagaaaaaaaaatcctggaattacaggtgcaaatatcttaacagaattattttgtaatgtaataattgggtattttttctctatttttctgagtcttgcaaatattccataataagcatccattacatttataacggcataaaataataaccttaatctttaaaaaatgctagtggagtaaatgaaacttttcctgcattttcttgccagttcatgtcgctggggagtgtcacttatttctcttgtctgtttccctatggtgaaaaacatagaaacatgttgataaagaacacaaagaaagaatgcatgactaggaatgaggagaaggaaaagcttcatgcatactcagctgtaacatgtttgggccgggcgcggtggctcacgcctgtaatcccagcacttcggaaggccgaggcgggcggatcacgagctcaggatatcaagaccatcctggctaacacggtgaaaccgcgtctctactaaaaatacaagaaatcagccgggcgtggtggcgggcgcctgtagtcccagctactcgggaggctgaggcgggagaatggcgggaaccccggggggcggagcttgcagtgagccaagatggcgccaccgccctccagcctgggcgacagagccagactccgtctcaaaaaataaataaataaataaataaataaataaataaataaataaatacaaataaaataaaataaaatttttacaaagtcaatgtaacaactcagggaaactatttgtcttcaaacattgaagtaagaaagacaggaacccaaattcagaaccagctgaaccttgaaggaataaacagtaaatgtcaagggcttttctcacacagggaatgaaccggttttcctgctcataaaagaaaacaaaaatattgagtatgagtctgaaaaatatgaacttcctcatgtttgtcatctccataaactatccctgtcattttatctttttactgagaggaagataatttagcaaaatgaagcacgggctgctatttcattttcttattacatatttgaattcagtctagtataattatggtgtttatgaagtttaaactgatgtagcaagagagtaataggaagaataagtgatcatccactctcaacatgataaggagcatttcttgataagaaagttgactttaccaagtacaggaaatatgtaagaggttttatcagacaataattttaatttatgagatgctttcattgtgttccactaagaaaatatacatttatttctaaataagttagttttaaagcaaagtgagaacaacagtagcaaaaatgtctcacagttacagacacaggcaaaacaaaaacaaaaatacctgcccccatctgtgagaaaagagctcacaaagaaccaggaaattataaatgagcagatttgcccttggctgtaggcaagatccctgagacagtaataagaaatgaggttaccaaacatccagagagatatgagctgataaaacttaatcaggctagtttcacaaagggcaaatcttttctgacgaatttggtggcatttttgcatggcacatggggcaggagaagtacgtgacaggaatgcgggatagaattcaactgaagaaggtagaaagccatggatgatacacatgaaaatgaggtacggtcttagctttccgaagaagagcacttgggagacgtttagcccaaatgcgttgatttcatgaagatatttatgttgacaataaacatgaagcgtggttgatggactggcatgcttagcagtgaaaccacggtagcaaaattatgtctgttatcatcaaataatgcacgcttggggtgcgtatgtatgtttgccattccagattttttttagagtattctcatcagttatttgcagtcatgcactgcataataacattttggtcaatgaccgactcccccctatgagatggtggtaacttaggattataataccttttctatgtatagatatgtttcgatacacaaatactccccattgtgttacagttgtctgcagtactcagtacagtaacatgctggctgtgcaggtttgtagcctagaagcaataggctgtgtaccatacagcctaggtgtgtagcaggctatactgtctaggtttgtgtaagtgcactctgtgatattcccacaatgacaaaattgcctaatgacacatttcgcagaatgcatttccatggttaagccactcatgactgtatttactttttccaaatgtttatgttattagtatatatagagagagccaatgacatttcagagagacacactcttatctcaaagaggaaccaatgggccacactgcaatatctcaatgataataataggttttacagcatttctagcatctttactctgagacatttttaaaaaacgcttttagttgttttgtgtacttgacagtaggctgttatttttcaaaggttaatgttgaagtgttctaaaattgggaaagtaatagggtcaaatacccagaagttcaaaagaaagaatctgagtttcctgcttagttggtccctcagcgtcaatgtacaaataggcttgtctctttcatcttaaaaagataaataatccaaactgaaatacatacatacaaacaatttctctacctcctgctgttgtttctgctcacctctcccttctctttgctgtctgacttctttatagagcaacctgtacaccattccatagttttatttcagttcccagtttatctcaagcttggcctttatgtctcaattcatcttgatttgagagtgaaatttctcccaaagaagaaacaaggactttctgatgatcaacattagtgccttattgctgttgctcttgtttttcacggttactctctaacatatataactcttaacatgtgtaactaatataactcttaattacatcctccttgttaaaaactctcctgttttggcctcccatatgatggatggggtaggcagaataatggcccccaagatgtcaatattctaatccctggaacatgtgaatctgttagattacaagacaaagggaaattacggttaaaaatggaattgaggttgctaataaagagattattttggattagctggggaggcctttgaagtagaagagggaggtagaaaaagggccagaggaaaatgtaactatggaggaatagtagagtaatttaatgtgagaaggactcaacatgctgttcctgattttaaagatagagaaaggtgtccacaatccgaggaacgtgggcagtctctagaagtcgtataaggcaaggaaacagatttcactccagagcctctaggaaatgcagccctgatgacatcttgatttgagctcactgagacccattttggaattcaaacctacagaactataagatagtaaaattgtgttgttttacaccattgagtttgaggtaatttgttacggcaacaatagaaaaatagtacaatggtgttctggcaaaatagtctcaacttctcatgcagatcttcctcagaacattgggctgttttctttcttttgtcaattccctagatgttgacagtccttggttttcatccttagctttctttttattcagttccatgctgttgctgccttttacaaagcaatgccatcaaactcagtctctttccccaaccagattcctgcttgtagctacctatctacatctacaagtccctcacaaaatccaaatttaacatgctttatgatagtttttaaaaaggcaaaatcatcaatttcaaagaaatgtaaatgaacacatgaaagattttctttaactcactgatcaatgaagggaccagtaaaatgttgcaacttgttcaaagaagaatccaaagtaccacacatgtgtaggtgataaggaatgctaaaataaatgtataaatagatgcagaacaggcttaccatgggtaaattggatggtatgtgaattatattttaagaaagctgttacaaaagcaaacaagcaaaaagtttggcttattcattagggaaaaataggaaaaaaatcacctgcatttcattggacacagtttatttgcatttcaatgaccaaaagtcatttgcattcttaatagttttctcctctttacattgttgcaaagtagttaagagtcattgaaaggcagggttaatcttataatctgcaatctgcaagagtacctaattgcagggtactctgcaatctttccatgtccatattgaaattttcgcaagttttcctgatatgtcctatcacatatctctaatccaaatactttctcattctcctgaagatcatttcacacatacatccctcttaaacctcccatacttcccctcctatcatctgtctcagctgatgatcttcctacttcccaaggaaataagagaaaaaaacagaagataattttaacttgctttccaccccacatgcatcagtgtattttccatctgtctccacttactctgccttccctcctgttactgtggatggaagctttctttctaaggccaaccactgcactgtgaactcagtgcctccctgtcaccaccagggtgtcactcaaggtattgtcttctccctctcctgtatcatcatgttcttatgcaactgcatcatgcccagaatcatgtcaatataatgtagtatcccatctcaaccaaatgcaccattgaccccatgtctttctgtagtacaaacctatttctctagacccttttatgagaaactccttagaattttttctttttcaaattcactgtcttcaattcctctctttacatactccatatcctcactccattcaggatgtacactccactcagcaactcttgctaggtccttagtaacctcttccacattgctaaatgcagtggaatgttttttactcatcttatttgcctagcttccctatttgtcaaagctgaccattcagcttctttaattttagattctagtccatcactctcataggacactcctacaacattggctattgttcctcagtccctttactggttcctcctcaccagtgtgatctttagttgttgctgtgtcttcaggatgggtttggggtctttgtttgtttgttttgctttgtatacactcaatccgatgatcttcaaatgcatataccttcagttcataattatctccagaactccagattcatctattggatgccaccttagatatttcagtagaaagtctaacagaaacctcaaactcaacatttataaaaccaaagtctttgtcctcctcccaacccccagcacaagccagctgttctacttgagtgttttctctccccagaaaatggaaaacctatccctccatttccttaggctgaatacctgatactcattcatgatttccaaatttttctccaacatattacaaatctcattgctttaatatacaaaaaaagatctagaatccaattattatacatctataccacaaatactttggtcccagccaccattattttcccttaaattatatcaatgctttcagtctcaggggtttgacgcttgctgttcctctgcctagaaatttttctcagtgcatgttttattatccacttttcttttgatctctgttcagatgtcaccagaccagtgatgccttccttcactgccttttataaaataacacctgacttcagcatttctagctcccttaccctttatttctctccatagcactcacaacaatctcatataacttctgtttgtttgttcatttatcttatgcctccctcaattagaatacaaacgctgtcacagactcaaagttatctgttttgttcattgctgtattttcaggctctaagatggttctcgcacatagtaatcccacaaataaatgattgttcagtaaatgaataaaaaataaattaaatttatatctcctctctcatcttctttcattctcactgctcctcatctttctcttctcctcttcctttaacagctaaggacttcaacatacatgcattcttccattcatccctaatagctaactcagagtaatctctaatgctgtctttgcctctttcctcacatcaaatcatttataatattttgttggtattgtgcctacatactccaaaaaagctctcacatcattcttgtcctctttattcctactgacaatgcccaattatctcagtggtttcaaacgtttgataaataatctccttgatctgtggtttctctttccctatccttcctcccgtgagtcatggatctaaacatatcataatcttgcttaaaactgaaaacacttccatgttttctaactgtttacaggtcaaattcaaacctctgtcatatcatttaaggtccttcaaaactgttctaaatctgccattccatctttttatttcatgactctcctaccttccagactagttatattcttttgaatgacaggtattttcatatctttattcaagcttttcttcttcttaaaacttccttactgtaactcctgtttcaatgccattcttattttcattcttttacacatagttcaaatgttgcctcttttggcattcttccaaaacctctaggtagaattaattgcttccttctctgggctcctttaaaattatatttatacttttggtgtagtacttatcctgtaatattgtagttcgttaattgttttcttattggcttccctttctggagtataaatcatagtgatttacggtatgagttctggagtcagtttgcctagactcaaaattgagcctcaccaccctttagctatttgatattgaacaagttatttccattctctaaacctcattttctcatctttaaaatggaaatattaaaatctgcctcgcagagttcttgaaaggaccaaataagataattcatattacaagtttaacttgattcctggcacttactatgctcccaaattattatttgagtgtcagcttcttgaatgtaatccacttatttatttttgcattgtcagtgcataaagaaggttcaacacagagttagagctaataaaagttggtcgagtttacttatgttggatttatcactgtgtgctggcaatatctagataagcaatgatgtagaattttattttggtctggctttaacctaaagagatcaacagaatgtgaaatatatgctaatgaactcttcttattataatttactttatgatctgcatgccacttccaatatggcatatacattttaggcaggtttaatgcttaatctcaaatcacaaggtcaccatagatgtctgactggactgaaatacttcatatttcatatttgaatactggatcttcaactttataccatgtgtataccattagttcattctgctagagtaacataaagataaccagaatgattccattatgtgaaaagcagctttcacattaagaattgtcttctcaaatgtctactgcatgtaagaaataacaagcatggccactgtcaggtgactgtgcagcttctcttcttcacatctttggtgttacctagagtaagaggccactgagtgtccagtccttagacacagtctagctttgcatcttgtgaagtgagtgctgatttcaagtatggcttgaatctaactgatgcttgatgttcaagcgttattgaacatatacttttgaaataattccaaatacatttgttgaaagtattattatcaaatgattattacaatgaaaatttatttttattacaatttaaaagacaacaattcaaaaatcagtctcccatcccagcccttaaatactgagcaacatcagtgtctccagttgttggttggacaggtaaaactgtgagccccagcaccatcaaaatcagtatctttatacctgaattagtattttttcctaatacaagcattcctcttttctttattcctctattttgaaaaacaacaaatatctgagcaatctttaatgtttccttttcctttaatcatgctcccacattcagttaactggcaaatcaccttttacctttgctttcaattcttgctcccaccaccttagtaagatgtatctctctacttagactagtataagaatttcataactatttttaaaactctagctttatcatctttatttttgaacatagctgacaaagtttacttttttccttttttctttctcctatgaagtaagtctgacatatcttcactgcataaaacccttcaaaagataaacatcaacaggcagtgggatctcagttcagagcttgatcttttgacttaaagctccggtctgcctctagttcttaagtaggacacttgacctctctagaattacttttctgttttattttttttctgtaaattaggtaaacatttctctaagtattttttctattttaaaattttgtgacttgacaggaagtttaaagaaaattggtaaaagataaatacgtgtggtaaggggagggagaaggaagaaagaagggaagtgaagggaagggaaggaaagggaaggaaaaaggaaagaaaaaaaaaaggcttaactctttatagaacctgcattccaagaaagatattaagtgagtttagtctagcttaagctctacaggttaaagagtatgagtttgaaaaactaaggtagaagcttggtaatagaagaaaaataaagccagggagggtagagcttttatagtactgaaagtatgcagaactcaagtggatgtataatttgtgtcactctggacttggagtcaaacctggatttgaatgccagctctggactattaatagggatgtgattttgagctaattatttaatgtctttaagttttagtcaggttcaactacatcatttgcagaccccagtacaaaaggaacatgtgagccccttgttcaaaaggcagaaaaaaattgccattaaaggcattaaaatataaaatgttttcttacttccctggtatctttcttgatctggaatgatgttttttatttgctttttaatggcactttccttttgggcatgggaatactttctcagcgaccctcacatgacctgggggccttgccccaccattcagtgtaaatgtgactcactgctgacccactgacttccaggttctccctttcatcagctgcctaaccaatatgcagtgccccagctcatagccccaactcacactaatggaaaatcctcaaaggctttgcaacatttgtgcaaattagacttctgcggtagaagatattctggaggttccaggagccacggtggggaaatatattgggagcaacaaaattctaacacagaaagatctcaggtactttatatctgggtgtgatcttggagctctctagtcttatccctgggtgaaacctgaaatttacccaggctcatacaatgtgattcaggtagaaccaaaaataatatgacttttagttctgtgttcttttagatacaggctttctaatgtatgtgagtttcccttgtgatttcctctaaaagcccaggttgtctgcacttttgtagttctggagaggaaaagcagccaaacactggtctctttctatggtttatttaaagctatctttctcaaggctgttttagttgtaagaaacagaaaccatacaattagtggttcatgtaacctagaggcagatctcactagaaattgaaaccaaagatctaaaaattcagggaataaagcctctctcctctaaattactcattctctccatcattctgttcccccccaccctctctctctatcatctacttatctcaatttctgcctttgtgtagactggtgttctctacctcctcatgagttttatggacgatggatattataaaagttatgaacatcctcatctctgctcaagcaaccagcagagactagcatctcttaatattatatctaaattcttgggagagagaaacaccagagcccaagaagaacatattcacttctcatccagtcagccatggcccaaggaatggcctaaagcagattgaacatgcctttaaggatctccacagtttaagagctacttctccatgaaatggttcatgggccattcagaaatgccagaatgtcactgcattcgaataaaaagttctcagtatttagggaataataatgaacgttagataccagtaggttagatgtaatattgcagtcagatcatggaattaactttttaattccatagaagataatggaggaagaaaggtagggcagaaccctttatgcattttcaacaatattgtacaattttcatataattattacttagaaacatttatttttcagtgtctacctattccaaagttcttgccttactgccaaataaaacttgttttttttttttttttttgagataaggtcttgaacttctgggctcaagcaatctgcccgtcttggcctcccaaagtgtggggattacaggtgtgagccaccatgcccagcctctctaataaaacattttgtagagagtaccattataatcattggtgattacaatgtatagtagtatgtatacacatatagtttttatatgtgtgtgtatatatatacacatacatgtgtgtgtatatatatacatgtgtgtatatatatacatatgtgtgtgtatatatatacacacacacatatatatgtgtatacacatacacatacagtagtatgtgtcttcaatacaattactcactgattgtagcagtggctcaaaaataccaacaccattctttttcccaaatacattcttaaagcacaagtatttgaaaatgcattttgatttcttgtttttgatatcatattgtcacatgttttcagctgttcctatacagaaaaccaacattgttcttgctttctgattgtatagacaaaacaataaagacttgctgttatttcatcatttcattacagtatgagaaaaatctaacaatttaccaaaagatattaaacaattagttgaaactagactttttacttatcaagtggtataaattcaagctcctaaaaagttgataacaaatataaatgaaaaaaaggaatgatatcaactgactgatgataattcaacaagacctaacttctgtgtctttcaaaatgacctaaagttacttagaaaaatgtctttaagtttctcatctatcaaatgggaacagaaatgtgcatctcacaaaaggcatcacagggatttaatttggaaactgctgtatgtatatattttttgaaaaccactaatcattctcacaagtataagatattattaagccaagttatacccccaatttggactacatgaagtttaaaccagacttttctctgagtgaaagtaaaggaaagcaaatgaattagcatttgttgtgtgcttgttttgtgcctggcataatgtatgttgcttaatatgcattatttcaaccaggttttctttttttgtgtaggaggtagggggttggaaactttaaagagattttatggagatctgcaaaaaagtcattcatattcccaccatcaaaaattaagttaccatctcagcgtatttatttcccatctcttttcttcattttttaaaaaatctgatgtttctttaatataacgcatttttattttaatcattcaaactatgaaatattatgcaaagaaaataaaaaacctatctccaataaaactttctctaaaaataaaaattattaatattgggtaaaattatagccatctttctatatatataaatacagaaaagatatactgtattcatgtatagatagataatagcatagaagaatacaaatattttataaaaatgagatcataccatagacgttacttttaacgtcaagattaaattttattttagaaaacagaataaaacaaagtaaaaatgataaataatttgaacttctaataaatgatttgagacaaaaaaattttttaaatgatttctctaaggttaaaagatacaatgaatgatacaaagaggtcagagtgcctttgtttgtaaatacaataatattatatgtatatatgtgtacatgtatgtatctatagactttttgctgtgaaagatgatactagcgctcatactagctaattatattccctcattcacttctcatttttctattttgttgtttatcttatcgaggttgtagcatttatattctgttctataactaaaactagcagagttcttaagtgtaagtttgtgtttgaaagtattctgtgtgtatcccattattcctctttcattctcaagatctgcatattgattcatatttaattgaatggatttcattgttaagtgatctctttaagaataatcatctgttatttttcatattagcttttttatattagtttttttaatgttcaaattgttcaaatgtgtttgttggatgtcttttttttttttttttttttttttgagacggagttttgctcttgttgcccaggctggagtgcaatggcgtaatctcagctcactgcaacctctgcctcctgagttcaagcgattctcctgcctcagcctccctagtagctgggattacaggcgcccaccaccacgcccagctaattttttatatttttagtagagatggggtttcactatgttggccaggctggtctcaaactcctaacctcaggcgatccacccacctccacctcccaaagtgctgggattacatgtgtgagccactgtgcccggctcagatgccattatatttgaaagatatattggtgataatactaaagtcatccttccatttggaatatttacagacttttcttcattgacttctggtataaaatggtactgtttaaaatcccagcttattctgagttttcttttttactctgtgtatgtatgtgtgtgtgatggggtcttgctctatcacccaggctatagtacagcagtgtgatcatagttcactgcagcctcaaatccctgggctcaagtgattctctcacttcgtctcccaagtagctgggactacaagcacccaccactgctaatttttcttttctttttgtttttggtagagacagggtctccctatagtacccaggctcggtctcaaactcttagcctcaagtgatccttctgtcttgatctctcaaagtgcagggattacaggcatgagcccctgtgcccatcctttcacttttacttagcttgctatttctgtccagtcttcttaaagaagcttcctcttgatgttcttcaaatattagtcacttaatcagcaaacgctttggtgttgagtattcactctttcaaatatttctggaacatgttctttccatttatagtaacttttcttaatggtatttactgagacatgtgtttgattctataactcggtgacatcaaggatcttaatgttgaatcatctttatctatgtttctaatccattaccttctcctcattgttttattatctgtgcttttttcacattatgtgagataattacaatcatctcaaaacattatagcagtaatgtgactttcagtgggtatctgttttgttgcttgcctattccaattgatttatttgttatttattgatgttgcctgggttacagtttgcatccttaggttcatggtctccaaatttatctggttctattgtctgtgtatttttttcatattgacattgttatattatttttaaaaactcatgctcttattctatagcataaaactgttttgaggaattccccaggttttcttgagttatgttttcttttagattgagtattttccctgtcttggtcatgccatgttttactcttttattgctgcaatatatttgcatagttactattccatttcttttcatattgttcatgcttgagaaactgtgtacagaaaattcattttacttaatggggaaatatattttttgaattttatttttattatatctgggaacaattttttttctccttcttagctccagtttggagacaggatttatggcgagtacccacattttgtagcctgagagaatgatggggccaaggaaagttcagcctttttaggatacctgggtgcttctctctatcctaagatttctttttcaatgaattgtagccagattattattggaagagacttcagtatacttcattggaagatgtagcacttttctaatgggcttcagaggcttcacccctgagtgcatgggcatgacattattaattggttaaacagagtcagctttactatccatatttccccactttacttttttttttttcctagaagcccttttcattgctcttcagccagaaagaggtaaaagaaaaagataagacctttccatctgtgtacatacaaatctgcttatctccagatttagaagttataatgagaattctcagaatgctgttatttcaccagtaaatcctatagggtgtgaggacgacattaggaaatcaagaactccttcccttctctgagcctgaccagactgcttttactccacagttgtttttggtttttttctttaagtaattttgtcaggatatgttccttttcttttcaggcattgttaatttctgtttgtctgttatttgtacttacaacgtctcacacatttcattaggcactgatactgatataagaaaactcactcaaacatcttcaatccacttgctcgatcatcatttacaggaacactaaaatatatgacatagcatcctcctttaacagctgagaaatcagagaacaagagtggtgaagtaaattgtccagcactggggagccagtaattgaccaggctagaattaaaacctctatctatctacacttctaggtcactgaggaaaggtgcctaaattacaattttaagatgaggttaataaaagaacttattttacccaattgcaaatattttagaagactaatatgatggaagcagatctgagtggatggtgaaaacaatggagagggaatcaggaagccaaagtttaatttcttgctctctcttaagacagatgttaaatttggaaaagatgattcaacttcctgggtttcaatttccttctctttaataataatgatggatgatgatgatgatgctgatgattgtcataatttgatgactatatatctactcattgtgaggcacaatgtgacatattttataaacaatatattattaaatctcaaaacaaccatctgatatacacattgcatctattttaataacaaggacacagaagattgcttaaatcccctgaggcccatttgattccagagcacacgttcttaaccagtagctctatggtctttccaaccaagaagtctgacctgagtggtctgtaaaagatcttccagctttgaggttctctagtgctgtggttggtatagaaggaaatgactatgggttaacataggagaagcaagctcacacatcactcaagtacaattattagagttacagactggacttcaaattaagtcctaacatgatcaggtttacgcttgatgttgtgcattgcactggaggggagaaaacataatttcttttatttccctttttaggtttttagttgagacaccctcctacaaacaaaaatcaaattaacaaaagaaaagcagaaatgtattaacacatgctggacccatcatgccgagagacatcaattcaaaagtatttttctcaaggcagtggcttggggtgatgtttcaataatattttatcaaaatgccataaattctgcatagtaacaaggcaaaggaaagaacagttttagtcctttaaaaggtgagaaaatgtgagaggatagtgaaatctgttctcagattcctctggtgcctgctggtgccttctctgggctgataacaagtgctgtctccagtaaggaagcatggatgtcctgccatcaagcaaacagaggctgaggccgggtattctcctgccttttcagtgcctttaactcaacaatcctcaatatttggggaagaaatattttggtttctttcaagacattaaaaaataaaaaccacagaatttcaccttacacatgagtactaagctcttcctcatcctcttccccttccctttctttcatagcaatttagtccaaatgccatgaattggagctgagtgaggtaggcatccatgtgcatgtggaagaggagagccacagcagtccagcctgaggtgctggaacctgagagaggcgagagaggcatccatgcagggcaggggttaggacagtggtgacttggtgtgagtggcagagcccaagtaaggtgagaaggccatacctgtggtggggtggcctggcagagggtatcagagcctgaggaaggggaagagggttccattgttaggggagggtgttgaaggcagaagcctggagtctggtgttggagccaaggagaaggagggtggtttctgggggaaagagagctcccgtgtgatctgaaagatgtgagaaagcgagaaagctatccatgtaggaatatgtctgtgtaccaagtgtcagagcccgagtggggtgaaggaggacatccacactggaggcagaccctaaacagggtcagaatctgagtgaggtgaggagggaggaatcacccagctagtggtgtcagggcaggtataggagtaaaactgggagtggacatcaggacctgagcagggggaagaggacgctgacagtgatacgagactagtcacatacaggggaagtgagcaaatgcataaatatgtcaaagataatgggcaccagggttctcacagcctaaatgggagttgcaaatataaacagaggacaactgtaaatcaccataaatgaacacatcacacacgtataaaatctacgcacacacacaaatttgctgagaggctctgggcaagagcacctcaaaaaaaaatgagtacggtgagcatcctcatgatggcttctaaataccaatctctaataaaggaagccaggttgttttgttttgttttgtttttgtttttaacaacaacaacaaaaatggctactttgctggcagagcaggtgaaatacaagatgatcctggaactctctcttgtatcagaaaggaagaattcaaagaagggtaaggacatgccaaaggcaagccatttgaaagcatcgaataaatagcaaatgtattataactcatttaccaaaataagaaaccttggattcacaccgataaaacagatcatcctcatagaaatatatgaataaaaagtttaaatgtccagtgaggcatatttgcattgtctaaaatccctagccacaaaacactaattataaagaaaaaaaagatacttacttttatactggagaagtctgacaggtaccaccttagtcaaatgattatttaacttcaagagcaatgggacagatagaagtcttaaccttctacctgacagaacgcagcataaagagcacagcatcctgaatcgaattgtaatgaaagtggtttattacctccaatggtgtatccagtgaaggaggagaggatagagggaaagagggcaagacaatgggatcagtgtacttgctggctgggagaagccttttttatagtgatttttaaagccaatttttactgcttttattattatttttgaacatctttatagacccttttattatatgtgcccttggcatatagctcctaccaatacagggaagagtctgtgacttgccattgatacctgactattcagacaagcccaaatgaggtgaaactttaccacataactgccttgtgatctaaggtgttaaagtcagggaaatcaaggaaagactgtggaattgttgcagattgaaatagactaaagagacataattaagagaggccatgcatggtggatcatgcctgtaatcccagcacattgggaggctgaggtgaatggaatgcttgagcccagaattttaagacaagcctggcaacatggtgaaacaccatctctacaagaaaacaaaaattaacctggcatggtggcaaaaattaacccaggagggctaggtgggaggttcacctgagcccaggaggttgaggctgcagtgagctgtgattgtgccactgcaattcagcctgtgcaacagaatgacaatctgtctcaaaaaataaaaagaaaataaaaaagaaaaaaaatatcaactggattcttttggtgtaaaagattttattgggggccagacacagtggcttaatcctgtaatcccagcactttgggaggctgaggtgggagaatggcttgaggtcaggagtttgagaccagcttgagcaacagaaggtgactccatatagccaggcatggtggcaggcacctgtagttctaactacttgggaggctgagatgggaggatcacttgagcccaggagttagaggcttctgtgagctatgatcacactactgcactccagcttgggtgacagagtgagacactgtctctacaacaaaaatgaaacaacaaaaaatagaattttattagaaaaaatgggaaatgggacctgaagattagctgcttagagctgaatcaatgttaatttcttgatattgttggttttgggggtgttatgccctttgtttgttggaaatataaactaatttatttgggtaataggggattggtttacaagagaaaaaaattctttgtccatttttgtaatactttttgtgaatttgagattgttttaaaataaaataattttaaatatgtatattgaattgatatttaatatagacttgcattcaaaacagggccacttttttttcatgtgatttattcttttcttttcccaggtgatggtcttttaagccgtcctatttttactcaggagccacatgatgtcatttttcctttggatttatcaaaatctgaggtcatcctgaattgtgctgctaatggttacccttcgcctcattataggtaaaatcctacctgtgggcaccacactattttgttcttcctcactgaaccaaaacatacacaaaataaagtgttttataaaatgtcctaatttgtagtgtacagctcaaggaatttctctacgggtatgcagccatgtgacaatcactcagataaagatataggcatttccagtaccccagggtattccctcatgccgctttccaggcaataattaaccccctacccaccagctccaggtaaccgtacttatgtctctgtcttattgattaggtctgcttagaacatttattcttgagattggtgccatgcattgccttattgtggtcagaaatgagagagagagagaagagagataggggagagagagaagagaaagacaggaagcaagtaacacaggaagccaggaagaaaagaaagataaaaggaaagaaaaaaatgaagagaaaggaaaaaaaaagatttgtttcctcaatttgaaagactaaaatgtaagctcattttgcatttcccacccctgcctcaatgcggaactgcagcctcagttgctgcatatgcaatgattatgaaaatgttctataaggaatgaatccagatggatatctagatttatttcatcagataaaattatgtgacttcactggtgggtcacatcacccaaaaatactgattttagaaaaatatgttgaagacagctatgtaccctctaaggcagaaagggaatttttattctgggcaaataagaaaaaaaaacctatatttgtttctcacatattatttgtggaattctagggagaaagggtcagtaagtttttgttcttatttatcaagttgtagcaaaggcagaatttgcttcatattgtgggtggaatttacaaatttaaaaatatatgcatacgtaaatattcataggtaaatactacagatatttagttagtagaaacttcatatgtagtgttaatacaggaaaagaaaatacatattaaacttttgtagctttgggttttaaaacctttttttaagtcttgttttacagatgtgaagttgatatgacacacacaaagagtaacaacttcagtgtattttggcaaaataagctggtttagcctgattttattttgcagtaaaaatacactcttgatgtgcatagttatttagatcctaaaattgtctagattaatgagttaaatgacttaaatgcacttaattagctaaatgacttcaaagctaaaggcaattctaccttatcttgaatttttttgagctaacttcagtgtcttctttttacaacaaaggagctgaaaaaccatgtcttctcattccacagactaaagcttccttgtctttatcatacccaaaccagtgaaactcatctgtcaggggaagatccttcactttgcaaatttgggacactcaattcagagtttgttgatttgttagtttttcttaaatgatgagctgtcctattagtttaatatatggttaaatatatgaaaatttgattaatacatttagtgagatcacctaatacttaaagtagtaattttatgtttgagagctaactaggttgatcctaggggttagtagagaaagaatataagaattcctataacattttttgaaagtttgctgaatataagacagacacataaatacataaattacatatttatataaaaaatctattggcttttaacagttagaaggatataaaataggttctcaagataatttgctaattagttttatctgtgaaaaaatagaatgaaggcaacagttttcaatgttgttaaatggcttttatttctaagatccttgtaagctaaaaggctaaagacaagtaatttatgtgcttatttccagcccccataacctggtttggctcatttcttttttttttaacttttaagttcaggggtacatatgcaggtttgttatatagataaacttgtgacatgggggtttgttgtacaaattatttcatcatccaggcactaaccctggtgcttattagttatttttcctgatcctctctctcctcccatcctccatcctccagcaggccccagtcgttgttccccttactcatagacaagaaactatggaaagagagtgagaaaagaattaagtttttaatgcttaaatgtcagactcaggcccaactttattgataataaagcaaaggacagaggtatttcagataacgtgcattaccaacaaaatgtaaaagttcagttttaatatgaccctttctaacttaaattttattttttaaaaagcctcacaactatattcaccttagatggtgtgtgtgtgcatgtgtgtcttagaaggaaagccttcacaattcacagattctaacgttatttgaggttacctgggtatagtgtaaagcaacataaaagaatccttgacttaaagttatcatttctagtcacagctctatcaatccattggtgactttggaataatcatttttctctcctggcgtcatcttccttattcataaaatgaggctgggtttgattttaagatgtgttttctttcttttagtaaattccatacagcaaatgaaatctcagggaaaataagcaatattaaaagcaaactttttgaaagagcttaagcttgcccatgaaaaaggattaccctttattctttcaaagatcacataacacatgagaatatgaagtccagccctgaagccctgcaaagggaagagaaatgggctacccaaagatggtgctttggaaggattgcttatacctggaaagtctaggaaaatcatgtagcaatgaacttagttctacctcagaatatatatttgatttggaaaaatgaaataacatacacataaattatttctaaatagaatatactctctatcagaaaaaaggatttctgacaatcttctctctacctggtcaccagaggagactcctttctgtaatttagtctactctaccctagtcatgaacacaaccttaagtctagagaagctctaggcctctaagaaaaaactataatagtagtgactctgcccttctgttctttttattcatttcccgcaactttatccttttaacaatcctgtgagataagcagaatatacattattgcacacatcgtataatttgtgaaatgacttctggagaaatcagaaggcttgttcaagtatatgcagcaaaggaacgtcaaagctaggactaggattctttccacaggggtcacagactcaaattcagtgtacatcacaatcacccagagagacttaaaatttagattttggtgttctctgtcagaggtctggggatgggctcagaaataagccaggcagagagagacaaatatcatctgatctcactcatatatggaatctaaaaaaagttgatttcatagaatcaactcatagaagtagagtgtagaatggaggttaccagaggctgagtcagggaggggcaggaagggaaaggggacaggtgggtcaaagggtgagaagtgacctttagacaggaggaataagttctgggattcatttggacagtagagggattatactcaatgataatgtattgtatatttcaaaggagctggaagagaagattttgaatgctctcaccacagacaaatgatagatttttgaggtaatgaatatgctcattactctgatttgatcattacaaaatgcatacatgtatgaaaacatcacattactccctataaatatgtgcaatcattatttgtcaattaaaaataaataaaactcaaaaaaaaagaaacacattctttcagcaaatataccatgtaattctaaagcacagcctaattttgaaaaacaccaacaggcacaagcgcgcacacatgcacacacacacacaaacacacacatattacggaaggacagccaacaaacacagcccacaaccattattctttttttgtttttgtttttgagacagtcttgctctgtcagccaggttggagttcagtgatgcaattttgactcactgcaacctctgtctcccagactcaagcaattctcctgcctcagcctcccgagtagctgggattacaggcgtgtgccactatgcccggctaatttttgtatttttttaatagagactgggtttcaccatgctggccaggctggtcttgaactcccgacctcaggtaatcagcctgcctcggccttccaaagtgctgggattacaggcgtgaaccaccgcacctagcccagccattattcttgacacaggactgaactacttaaaagtgaaggatgtttcccaacaaagggtcgagattttagttcacatccattatgttttctggaactaatatgatattaattcagatgctaaaagcaatcatttaaaacacatttcctaggttgcatcataggaagacacttgtcagtatgcaattctatcagaaatgtgtgcatgacaatcatttgaattcattaatactgtttctccattgatttagacatattaattaggacaaagcccacaccaggagttgaacccctgatctatatgtacagtttaataatcattgtaccgtagtgatcagaatgattatggggatactgtgaaaaattcatttgctgccgctaagccaacaactttgaatttgtgttgaaaaacaattactgagcttaattaggagcatgtaatgatgacagcggttatttcagtgattgattccaaaattaaaaggagctggcaaactaaatatggtatatcctatgctttgaaaacgatagggaacatggaagtctaaagagcaaattatcaaaaactatattagagtgctggcaaggagaatattggtgtcttgagacaggcctaaagaaagaaaagttttgaagggttttattattgttttttttttttttcacttttttcttaccctaatattgaaaacgagcagtctctacaaattcctctagaaaaaaatgatcgcagaaaatctaggcaaatgaaatgtactctttaactgctgtctttcaacttccaggtgtgcaggaaatggctaaataatttcaaagttaacagagttggttcaaaacctttgattgatttgacatctgatccatcacatctcatctttaacatggtagaggattacctaaattcatatttcttttctactttggtaggcatttgtcagattctccccatgggatgtttgaagacgcgcccgaagaagtcaatgacatttgaattaattctgtatttttagtagaggcggggttttgccatgttgcccaggctcgtctcaaactcctggcctcaagctatctgcccaccacggcctcccaaagtgctgggattacaggcatgagtttctgcacccaacctctttgaattaattatgtaaaatgtcattttttaaaaaattaaccactcccaccaaaatatttttaatatgattttggtataaaggggagaatcatagcaaagctggcataaaccctaaaaaacacagtttggaaactggctatattccataggaaaagatcattcacttgttttcctagatgactgtgatggggttcaggacataccacctcaaaatatggcaccttggcatttgagaaaatagcagaagcaggaagatcattctcaccttcccctcactcttcttctctgaagcaggtcataaaacctttattccagaggtatcatttctatatccagaggaaagaaacacccttttcctcctcaaagacacagagaaatcaagaagaattggaacaaaaggccttgctaacttcccgccagtttcttaccattagatcataccctctttttacaatcatacttctgcaggactgtctactcttcatcaaaactagcattaaaaacacacaggttttcctgttttttaggattttttttctgaaggctttcatgtcatggaatatttatattaaataaaattatatgtttttctgttattaatcttcctttccttttagagacctcagccatgaacttagcaatgagtgagaaaagatatttttctacatgcacaactgtttgtcattattcaatagttttaagtgtttattttaaaaaatggtctatgtgactatacacagcctgtgccctaggaatgtatctcattagatatatacgattcatgcttcaaaatatttggggattttgatggagttgggagtttcaaggtaggaaaagtgagtctggttagagataataatcaggtattcatttgtcttaaaaatgaccaaataaaatttctaaaactagttatgaatctttgaaagtaaatataactctaagactcttcagctagttaattcatgtactaaagaattgttgactaatagctaagccaagagaatttttgcttctcaaaataaaaacctctcaaacagcatttgctttgctaaagtataattttagtttggcatttctaagtaccattgaaatattttcaacatgattaattttccaagtaacatactaacagaggtaatcatgttctaaagtagtcaggttattattgttttgttatcagccctgaattggcgttgtaaaattatgcttgccgctttcaatatacgcttcttgaattcctatctttaaatcattttgacattcaattttgtgctaccagttgtggatgttcaggtaaggtatatgttatttgaaaagtcactaaaggaataggttggccagtattattgactgactgtctaatttttatttctcatgttgagagttctgtttcctctttgtatacatttgggtgaatgtaacttataaagagtacatctttcaaataatctagttactgatctcaccaaacccaccaagacagctacctttggtaaaactggtaggattacctccacatgtaatcatgttttttggtgttttttatagttgcaggaattagaactacatgttttttaagacaaagattgattgactctgtatattataagcactttattttttttttccttgaaggtggaagcaaaatggcacagacattgattttactatgagttatcactacaggttggatggaggcagtcttgcaatcaatagcccccacacagatcaagatattggcatgtaccagtgcctggccaccaatcttctggggacaattctgagtcggaaggcaaagctccaatttgcatgtgagtttggggtaaattttgtaatctttgtctctgaaaatataatattcttctgatacacacattttaaaaatctagctttgccaatgatatatttgagaatgaatatgactttatgggcttttgacaatgttcattttgtgaatctagattcttgggtataatagaaacctgcttctaaaaaaagaataaaaaaaacagggaaaagatcaatgttattatattttgtgaattatttttagaaacatttctaaaagtttcagacataaatattaagataaagatgtatgatatagcattctttttctttttcttttgcattggatattaatgcaatgtggagagcacaggaagaaaaagctgagggcagagaggtcatctgggggaggtgggcgttctcccaagaaaagcgatcatgcacccgtagtttgatgtaggtggaaataaagtggttgccaaaggcaggctttatattaactgtaacaatgtccagctgcatcacataaatgtcatccaagtaattaccctggtgacatttggggacattagcagatgaacaatagacatactgcgtctaatatcctttatatatagtgtttccagggactgaaatgtttcatactggattcagcaaaagccttgcttgagagtaattatatctgttgatgtggataaagtagaaggcttgcatttctccctttgcaccaaccattatgtcccagaggatctagccaaggaaccaaaaagtgagctgctatacctgcagggctcatagaaatgtctatactgtctgttactttgaaaaagtaattgttctgaaattttattaacaaatacatgaccaaaactcaccttgtgaaactacttcagtcatcagtagatacatgaattaataactgggtctgtttctcattgcaagtcttgtgttccaaagattattctacaccagagatcccttgatctacacagagttctctttatgttgaccattttggggatggccttgcttctgattttacatacaccacatacacatacacacatgcacacacatatacatatatacagatatacacacataaatatgttgctaactgtatccaaatgtatttgtatctatggaagtaagaagtgaacgtggaagtttattaacctaaatagaaggtgggaaagggccagtggctactttcgaacataggataaaaatatttataacacttgatttcttcatttcagctaagactatcacctggaaaaataatagggaacaaaataacataaaaacttatgttatagaaataaagaattgttccagactttgaacgattctgccacagtaattgtttatttctcctgcttggataggagatgaccctacaacatacacatgatatgaatcagattccataatcataaatttgactctttggtaaaggaaactccatacagcatatttatttgctataccctcgagtttctctacagttatgattctatctactctcgaaaacagttgaatgtctacatctcaaatcaatgcactctttgatataaccatagatttcttctcctttgttctgtactttttaacaaaaatatgttttaaaatgtcctacattattatatcataccttctttctgctttaaaaatttcttgcaacgagaagtttctctagttaaaacttattttgtttatgccatatcagaataaaagtctcaattaagaagaaattatatgctttcatctggctaaatgggacaaatcaatttttctgtccttattgactttcccatcttatcataaaattttccattttggggcagaaggtgtatgactgttgatcttgaaaagcatttctattacctttaatgcagaaagtaagatggcctatatccattaactaatctttcttctgcaaagttaaaggatcttaggctctaagagcttgcaaaagcaaggaccacaacatggtggtggtgtcatgtctgaaatatttctcattgtatccggggagacatgtgcgagagtgtggaaacagagagtaaagggtataaatgccagtccccaaccaaatggaaagttcctaaagtgcatgaactgtaccttcatcttaattataattcctcacaacctccttcataaatttttaacaatatcaattgtgatagaaaaggcctttggtaggataaccacagcagataaatgctgagattttgggaaacagagaggtgtgagttcaaattctttttgtcaaatatctagtggtatgaaattaggtcttttcttaacaacgttaagcttctgttaagaaatctatacgatgaggatacagcagtagccaccacataggacagtgacatggagtcactgagaaaatgaaggtcaagtccctgatccattatggaccctagggaaatgacagctctaattctttctttcactattattacctatctcaacttagacagacatctatatatttcaaaccacttgagtttcttatggaaactctcctagtttagtttacatttgaaaacttcctaaaggctagtttcttgttcttttcttttcatgtcaaatataatacatgtgctttgacatatattatttcacttgaattggacaacagctgtaggaggcagttgctatcattgcccccattttacagattagaagcctgaggctcactgatattggggctttcttaaagtatgttgttagagaaaagttggaacttgtgtatagacaaagaagacttcagactctaaaactcatgcacttcatgtcacagtattgagtccttctcaaacactgaccacacagttcatgtgggccttctttctttgtttcacttgctggcacagtaattgtctaaataataaactgtatcttcaggacagaatgggtcaaataagcctggtagtagaggctggtgattccttgtccacatccgcttttgcaagtgatgtgccaacccccagctatgaatacccacagatatccctttttgcatttcatgccccaaacctctccatgggatcaggctgaaaccagacaacagctgcaacaccttaattagcttcttcacttgctgtttccttcttccctccctgcctttctcctaagaggatatcctcaataaatcatatgcacttgaatccttgcctcaggctctgcttctaaggaatccaaagcgagacagagattaaacatttaatatgagattgccgatctacttactgacagaaaaaagcgggtgcagaagccccactcccatgaactcccatagataagaacaagctatgcatcagaataaaaatggatcaactcccttgcttcctgtccgttggcagtccattgtaaaatgtcactttgaccttcagaatgaatggccttatgaacaacctttcagaatctaccctgtccatggcagaaacgctgcagggacatacctctagataattgatggcttttgtttgtcacttttatcctggtattcagtaatccaaaagcacactttgagtttattttagacacagactgtaacactctgcttcattatgaatcgtctcatcatgaaaccatcctgaaatgtggcctgtatataaaaactacctgttgtgaaacatactcctaaatcaaatctgtctttaaccaactatgtaacttagacaagtcattcagttctctggatttagctaaagtatattttgaattatttgattacaaaagtctctttcagctattgtcatataatctgtccttccaaatactcaggtagatcctattttaagtatctctttcttccccaacccaaactctaccctaaaacaaattcagcaggagtctagtcaccaaaggcttctgttatcatcctggcattcttgaatgataaaactagtttgacttccaaaatcacttgtagctgctttcaatttcttttatttatcaaagcttttggtggtaaaggttgaacttagacctcttccttttgtatgtatgtatgttaatgaattactctgtacttgtgtgagagaacattgcatctgtcattgctgtttaaaatgtcatccttgagaaaatgagataggtgttttgaaagaaacccatgatatcactcagatgtaatttttaaatgcccttataatatataactctaccaatgaaaagataaacatttatgataaaaggtagtcatgaatggggctttttgatcctacattatttaatgtgtaatcacagctagcatttcaaataagtttgctccattattgcaaaaggaaaggcagctgggctggagcctcctaattgacccttcatttattcatcctccaagcaaccggagaacacctaatttatacccatcaagtactacactaggtcctaaagattaaatggtagataagaaacagctacttcctgtctcaacagaacagacaggggaaacctttaataaaattaaaaataagaaaaggaaaataaaggaaagtgctaacgcctacaaagtattatgtggcaggcattgttccaaactctttatgtaaattagctccattgatcctcacaataaccctctgagagtatcatgatcttcactttcagataagcagattgaggcacagaagaatgaactagcctgcctaaaatcacacaccgtatgtgggagagtctgttttcaaatccagacagagtgaagagtcctaccacctactgcactgtcccaaaacatcaagtgaagtgagaaaggtgaaattgacctataacagagtggagctcaaagtgagaagtagtgaagtttgtctgaattggagaaaaggcaagggaagcctttcaaaggaaatggggcttgcattgaaccttgacatgttagtttgtattctggacagagaaagtggtagagaaagtacaggtcggaagaacagtaagaggaaatgcagatgtgtgaacaatcttcaagtatcgaagaaagtgtggggaggtgggcaaaagacctgagaactgaaatgcagaaagctagggatcagaaatgactggttttctaggttgagactgaaaactaatttggagccacttataagtagtcctttatatccgggcctaatctgcaaacaataggataatttagagatattatgagatgccaaagaaacatgcaaaaatccatcatagtacaatattccacactcagtatgacactgtgtacggtgttaatttatggttaaatgccagtattgcccatttcatatagggttactatgaggaccaaatatattatgtggaaagcagagggcaagggcaactgatagactggtatgagttgaagatggtgagctaggcaggggtctggccatacaaatactaagaggccaagttttgtattttactgcttatcctaagagcaatggaaccgttctgaataatgttaaggatgttgaagttgtttataaaatgtagtttgaagccaggcgcggtggctcacgcctgtaatcccagcactttgggaggccgaggcgggcggatcacaaggtcaggagtttgagaccagcctggccaacatagtgaaaccacgtctctataaaaaatacaaaaaattagccgggtgtggtggtgtgcacctgtaatcccagctactcgggaggctgaggcaggagaatcgcgtgaacccgggaggcagaggttgcagtgagctgagatcgtgccagtacactccagtctgggcaacagaacgagactctgtctcaaaaaaaaaaaaaaaaaaaaaaaagtagtttgaaataccacatactatttccttaaatatgttagtctgacatattaatgatattattaatattatcaaaaccatagcacacatacttagggggcatcccaaacctcagtttttatcatatacaatggagtgaacgaattcttgcaccacatcacaggattgattttaaatggttcaaggttaaaatgcagtaagaatgcattttaaagggctataaacatgtaggcatttacaatcatcatagttttttccagaggaatgcaaagggttttacacctgccatgccattcatctttattctatacctgtaagctattcttaaccatgttttacaggtgaagacattaaaaggcaggacaactatgttacttgcccaaggtcaactaacctacagcagacccagaatttctaacatttccttcttgaaacaactttttaaatttatatttattttgtagacagaggaagtaaatcagaattctcatgaatttaatgccatattcaaagaaaaacaaaaaaggtaaagtcgtaacataaaggtctttgactccttgcagaaggattctaagatatttgtgtatttaaaggtgataaatatttttatttctatcttttgaccagggtcttataagcaagaacaaaaaccctcacatttagaaataaattttaagagtttccaaatttctttaaaattctttcatatataagaaatataaaagcagttatatgtgctcccgatgatatggtgataaagtgcatttatatcagaaaaagaaattaagacccagcagaagaagctttaaaaataacacttaaaaatgcttttggaaattgtaaagtctccgataattgcgaagtgcgtattaagtgggtaatgcatacctaattataaatgaaaatgctaaatggcttttaaccttttttctacatcagaaaagaactaactgaacaaaagccatgaagaaatattttttctttaatttcttaaattaaaaaagttggtaaattagtattgattttttcagtatcatttgcaaatagcataagcaatgttacaatggatttaatattctcaatttgtcttaatgaaataacagcataaccaccaattgttatcatatcaaggagaaaactttgtctttgcttttaaaaataattcagatcttaaacaaatagactgtaagcagttgcgtggttaaattatagcaagccactgttatatttatatttaaaatcaacagggaagtagattattcaatgctttagcctcattttttcccacactatcgctgctggaaatctatttatgtgtcttatcagaaatggtactttttcaaaattcaggccttctcccactgcctacttctacttatattcagcaggagctagtctttttagttcatttgaataaaattgtgcaggctaagagttgggatgggagaggaaaatataagaaagtaggggatccattctatcaaaactgggagtttctgatttacaaaactgagacagatgcacaagctgaaatgcttgtttattactcatgttatttgacaaactgtttcaaggaatttatgaacatagcacatagagattttgcttctaagatttataaaattggttcaaattacagtgacattttttgcattaaaggatcaaatatttctattgtttatttatatataaataaatatataatacatataaagagcatttataagtaataatgtgtatataattatctgaatttatatccaatattgtctaaaaagtaaatcagattcaggtgtttaaatagcaaatacaggagagaagatggcggataagcagcaagactagcttgcagctcctgctgggagggatagagcagcatgtggagactcacatcatactttgccccagaaactaccccaggaacataccaggaaagccgagagaatccacaaaccctttgaaagaactggatcaccgctgcaggctccctgagatgcagaaaaactgtgagtcggcttgctttctcaatagggaggctggtggtctggggcaggttctcagccctggtcactagctgtctggaaatagactcagtgctgctgggggcgggtggggcatggtgggagtgagactggcctttaggactcacgctgtgtgggggtggggtgaggcctgtgactgcgttttccctcacttccctggtgaactgtatgactcagcagaggcagccataatccccctgggaatataactccatcggactgggaactgtacccccatccctcacagcagctgcagcaagccccacccaaggagaggctgagctcagacacaccttatccctatcccagtctggtggtctttctctatgtgtcctggtagccaaagacaaaagtcataatgtcttgaaagctctatcgccctgcccaccacctgagaaacctgaatacttttgcatcctccgtataggaccacagctgatgcactcccgaagcgccatctcctgactggaggccaaccaacacaaaaccagcgctaaacaaaaacgcaaccaaggaccctcacagagttcacttcactcccctactacctccaccagagcaggtggtggtatccacagctgcaagacctaaagatggatcacattacaggactctgcagacactcctcagtatcaatcagagcctggtagctccactgggtgccagatccagaaaagcaaagcaatcactacagttcagttctcaggaagccccattcctaggggaagcgggagaacaccgaaacaagggagcaccccatgggacaaaagactctgaagagcagcccttgaatcccagatattccctctgacataatgtacccgaatgagaagaaaccagagagacaataatgataatatgacaaaataaggttcttcaactcccccaaaagattatgccagctcacctgcaatggatccaagccaagatgaaacttctgaattgccaggaaaataattcagaaggttaattattaagctaatcaagaaggcaccagagaccaggcgcggtggctcacgcctgtaatcccagcactttgggaggctgaggcgggtggatcacaaggtcaggagatcaagaccatcctggctaacatggtgaaaccctgtctctactaaaaaatacataaaattagccaagcgtggtggtgggcgcctgtagtgccagctacttggaaggctgaggtaggagaatggcgtgaacctgggaggcagagcttgcagtgagctgtgatcacgccactgcactccagcctgggcaacagtgcgagactctgtttcaaaaagaaaaaaaaagaagccaccaaaaaaaggtgaagtccagcttaaagaaattaaaaacattatacagaaaattaaaggaaaattcttcagtgaaatagatagtataaataaaaaacaatcacaagttctggaaatctaggacacagagtaatgtaaaatgcattggaaagtctaagcaatagaatcaaacaagcagaagaaagaacttcagagctctaagacaaggctttcaaattaacccagtccatcaaagacaaacaataataataataataattcttaaaaaatgagcaaagcttccaagaagtttgagactacattaaatacccaaacctaagaataattggtgttcccgaggaagaagagaaatctaacaatttggaaaatatgtctgagagaataatccaggaaaacttcctcagctttgctagagatctagacatccaaatacaagaagctcaaagaacatatgggaaattcatcacaaaaagataatcacctaggcatatagtcattaggttatctaaagttgagacaaaggaaagactcttaatagctatgagacaaaagcatcaggtaacctataaaggaaaacctatcagattaacagaagatttcttagcaggaaccctacaagctaaaagggattgggattctatttttagcctccttaaacaaaacaactattagtcaagaattttgtatccagttaaagtaagcttcataaatgaaggaaagacacagtcttttccagacaaataaatgctgggagaatttgccactaccaagccaacacaagaacagctaaaaagagctctaaatctgaaacaaatcttcaaaatacacaaaaatagaacctccttgaagcacacatctcacagaacctatataacaataacacaatgtttaaaaaaaaagaaaagaaaacagaaaacaaaacaaaaaaaaaccacaaggtattcaggcaacaaaatagcacggtgaatagaatagtacctcacatctcaatactaacatagaaagtgaatggcctaaatgcttcacttaaaaaatacggaatggcagaataaacgagaattctccaataaagtctctgctgtcttcacgagactcaactaacacagaagaactcaaatttacttatagtaaaggggtggaaaaagatattccgtgcaaatggacaccaaaagcaagcaggagtagctattcttctatcagacaaaacatacttcaaagcaacagcagtttaaacaaacaaagagggacattatataatgataaaaggattagtccaacaggaaaatatcacagttctaaatatatatgcacctaacactggtgctcccaaatttataaaacaattactactatacctaagaaatgagatagatggcaacacaataatagtggaggactttaacactccactgacagcactagacaagtcatcaagacagaaagtcaacaaagaaacaatggacttaaactatattctagaacaaatgaacttaacagatatttacagaaaattctatccaacaactgcagaatacacattctattcatcagcacatggaacattctccaacatagaccatacgataggccacaaaataagtctcaggaaatttaagaaaatcgaaattatatcaagtactctctcagaccacagtgaaataaaattggaaatcaactccaaaaggatccttcaaaaccaggcaaatacatggaaattaaataatctgctcctgaatgatcaaacaaaaagctgcctctttgaaaagataaataaaattgatagactgttagtgagattaaccaagaaaagaagagagaagatccaaataaactctattagaaatgaagcgggagatattacaactgatatcacagaaatacaaaagattattgaaggctactatgaacaccttcacatgcataaactagaaaacctagaggagatggataaattcctggaaatatacaactctcctagattaaaccagtaagatatagaactggaacaagatagggatgcccactttcactccttctattcaacatagtactggaagtcctagccagagcattcagaaaagagaaagaaataaagcgtgtccaaattgataaaaaagaagtcaaactgtctctgtttgctgacgttacgattgtatacctaaaaagccctaaagattcatccaaaaatcttctggaactggtaaatgaattcaccaaagtttccagatacaaaattaaagtacacaaatcggtagctctgctgcctaccaacagtgaccaagctgaaaatcaaatcaagaactccacccctttcacaatatctgcaaaaacaaacaaacaaacacttaggaatatatctaatcaaggatgtgaaagacctctacaaggaaaactatgaaacactgctgaaagaaatcatagatgacacaaacaaatagaaacacatcccatgctcatggttggggagaatcaatattgtgaaaatgaccacactgccaaaagcaatctacaaagtcagtgcaattcccatcaagatagcaccatcattcttctcagaactagcaaaaacaatcctaaaatttacatggaaccaaaaaagagcccacacagccaaagcaagactaagcaaaaagaacacactgggaggcatcacgttacctgacttcacctttttctctgaggccatagtcaccaaagcaacatggtactgttacaaaaataggcacatagaccaatggaacagaatagagaacccagaaataaagccaaaaacttgcagtcaactgatcctcaacaaagcaaacaaaaatatgcagtgtggaaaggacatcctattcaacaaatggtgctgggatcattgaaaagcccagtgtagaagaatgaaactggatcctcatctctcaccttaaaaaaaatcaactcaagatatatcaaagactaaatataagacctgaaaccataaagataatggaaaataacattggaacaacacttccagacattggcttaggcaaagatttcatgaccaagaacacaaagcaaacacaacaaaaacaaagataaatacatgggacttaattaaactaaaaagcttctgcacagccaaagaaataatcatgagagtttacagacaacccacagagtgggaaaagatcttcacaatctatttatccaacgaatgactgatatcgagaatctacaaggaactcaaacaaatcagcaagaaaaaaacaaacaatcccattaaaaagtgggctaaggacatgaatagacaattctcaaagaagatatacaaatggcaagcaagcacaaatgggaaaatgcttaacattgccaattatcagaaaaatgtaaatcaaaaccacaatgcaatacgacctccctcctgcaagaattgccataatcaaaaactcaaaaaataatagacattggcatggatgtggtgaaaagggaacagttttacactgttggtgggaatgtaaactagtacaatcactatggaaaacagtgttggagattccttaaaggactaaaagtagatctaccgtttgatccagcaatcccactacttggtgtctacccagaggaaaagaagttattatactaaaaaaaaaaaaagaaaaaaaagaaaaaaatttcatgtgtgtccgtgtgaagagaccaccaaacagactttgtgtgagcaacatggctgtttatttcacatgggtgaaataaacccatgcaccttcacgtgggtgcaggcgggctgagtctgaaaagagagtcagtgaagggagataggggtggggctgttttataggatttgggaaggtgatggaaaattacagtcaaagggggttgttctctggtgggcatgggtggatctcacaaagtacattctcaagggtggggagaattacaaagaaccttcttaagggtgggggagactacaaagtaccttcttaagggtgggggagattacaaagtacattgatcagttaggatggggcaggaacaaatcacaatggtggaatgtcatcagttaaggctgtttttacttcttttgtggatcttcagttacttcaggccatctggatgtatacgtgcaagttacaggggatgcgatggcctggcctgggctcagaggcctgacattcctgccttcttatattaataagacaaataaaacaaaatagtgttgaagtgttggggtggtgaaaatttttgggggtggtatggagagagaacgggcgatgtttctcagggctgcttcaagcgggattaggggcagtgtgggaacctagagtgggagagactaagctgaagggaggtcttgtggtgaggggtgatattgtgcggatgttagaagaaacatttgtcgtatagaatgattggtgatggcctggatatggttttggatgaattgagaagctaaacggaagatacaaggtccgaattaaaaggaggagaaaaatgggtattaaaggactaagaattgggaggacccaggacatccaattagagagtgcccaagggggttcagcataattacttgcttggttggcaagtttttgggctctatccttgagtttttttatgttgtcatacaccaggccagattgatttaggtaaaaacaacactcctcatttaagaatatgcagagtcctcctttttcagcagtaagtcagtcaaggcctcggcggttttggaggacaactgcagctaaagagtcaacttgggcctggaggactgataaagtttgtgattttgaaggcctctaaaagtattaaagcagcagcagccgctgcacgcagacatgagggctaggctaaaacagtaaggtcaagttgtttggacagaaaggctacagggtgtggtcctggctcttgtgtaagaattccgaccatgctaaccatgcctaggaaggaaaggagttgttgttttgtagaaggtgctggggtttgagagatcagtcggacacgattggcagggaaagcacgtgtgtttttatgagaattatgctgagataggtaacagatgaggaagaaatttgggcttgattgaagtaatgggggctgtctgtgaagctttgcagcagtacagccttggtaatttgctgagcctaatgggtgtcagggtcagtctaagtgaaagcaaagagaggctgggacgaggggtgcaggggaatagtgaaaaaagcatctttaagatggagaacagaatagtgagttgtggaggaatggattgaggacaaaagagtgtaggggttgggcaccacagggtggatggcaaaacaatttggttgataaggcgcagatcctgaactaatctgtaagacttgtccggtttttggacaggtaaaatgggggaattgtaaggagagtttataggttttagaagcccatgctgtagcaggcaagtgataacaggctttaatcctttgaaagcgtgctgtgggatgggatatgggcgttgagcggggtaagggtgattagattttaacgggatggtaatgggcatgtgatcagttgccagggaaggagtagagatgtcccatacttgtgggttaaggtggggggatatgagaggaagacgcgaaggaggctttgggttggggagaagggcggcaatgagacacagctgtaatccaggaatagtcagggaagcagataatttggttaaaatatctcggcctaataagggaactgggcaggtggggataactaaaaaagagtccataaaagagtgctgtccaagttggtaccagagtgggggagttttcaggggttttgaagcctggccgtcaatacccacaacagttatggaggcaagggaaacaggcccttgaaaagaaggtaatgtggagtgggtagcctccgtattgattaagaaggggacggacttaccttccactgtgagagttacccaaagctcggcgtccgtgatggtctacggggcttccaaggcaatcaggcagcgtcagtcttcagctgctaagccgagaagatctgggaaggagtcagtcagagagccttgggccagagttccaggggctctgggagtggctgccaggtgagttgaacagtccgattttcagtgggttcctgcacagatgggacgcggcttacgaggaatcctgagctgcgggcattccttggcctggtggccagatttctggcacttgtagcaagctcctggggaaggaggttctgggggaacgcctggctgctgcggttcaggtgtttggaagttcttgtgtgctggagatgtggctggggtttgtgtcacagtggaggcaaggaattgcaacttttttctattattgtacaccttgaagacgaggttaattaaatcctgttgtggggtttgagggccggaatttaatttttggagttttatttaatgtcgggagcagattgcgtaataaaatgtattttgagaataagacggccttttgaccttttagggtctagggctgtaaagtggctcagggttgctgccgagcgagccatgaactgggctggatttttatatttgatgaaaaagagcctaaacgctatctgatttgggataaagaaaaagaagcattaaccttgactatgcctttggctccagccaccttttaaagagtaaattgctcggcaggtggggaagagctagtcacagaacgaaactgtaagccagaccgggtgtgaggaggggaggctgaggaagtattgggacttagctgggtctggcaatgagcagcttggggaggacgggaaaggtcagatgggtctgtagaaaaggaagactgggaagactcagcgatgcttggggttgggaccaaggggacaggcgggagggaaagaaggaggatctgggaggaatcgcattgggaacagaggctagggagggaacgaagtgtgaaaaatgcctggacgtaaggcacctcagaccatttgcccatttttcgacaaaaattatttaggtcttgtaggatggagaaatcgaacgtgccgttttctggccatttagagccattgtcaagtttgtactggggccaagcggtgttgcagaagaaaataaggtgtttaggttttaggtcaggtgtgtgttgaagaggttttaagttcttgagcacacaggctaagggagaagaaggaggaatggagggtggaaggtggcccatagtgaaggaagcaaacccagagaaaagagagcgtagagacacggagggaaggggtttgggggttcttgcctcctagaaaagtgggacttgccgctgagggtgaaggagaaggggttgaggggtacttggccctgccccaggaaagcgggacttgccgctgagggtgaaggagaaggggttgaggggtacttggccctgccccaggaaagcgggacttgccgctgagggtgaaggagaaggggttgaggggtacttggccctgccccaggaaagtggagaagaggtagagaggtaggaacaaagagcaggaggacgggggattgatctcccaagggatgtcccccgatccgagtcacagcaccaaatttcatgcgtgtctgtgtgaagagaccgccaaacaggctttgtgtgagcaataaagctgtttatttcacctgggtgcaggtgggctgagtccgaaaagagagtcagcgaagggagataggggtggggctgttttataggatttgggaaggtgatggaaaattacagtcaaagggggttgttctctggtgggcaggggtggatctcacaaagtacattctcaagggtggggagaattacaaagaaccttcttaagggtgggggagactacaaagtaccttcttaagggtgggggagattacaaagtacattgatcagttaggatggggcaggaacaaatcacaatggtggaatgtcatcagttaaggctgtttttacttcttttgtggatcttcagttacttcaggccatctggatgtatacgtgcaagttacaggggatgcgatggcctggtctgggctcagaggcctgacaaaaaatctttgcacacacgtgtttatattagcacaatttgcaatagcaaaatatggaaaccaacccaaatgcccatcaatcaacaagtagggtaaagaaaatgtgatatatatatatatatatatatatatatatatatatatacacacacacatatatatataacatatatatatatatatacacacacatatatatataacatatatatatatatatatatatatatatatatatatatatagcatggaatactactcagccataaaaaggaatgaaataatggcattcacagcaacctagatggaattggagactattattgtaagtgaagtaactcaggaatggaaaatcaaacatcatacgttcttattcatatgtgggagctaagctatgtgtacacaaagcataagaatgatacaatggattttggggattgggggaaagggtgggggttggtgagggataaaagattacatattgggtacagtgtacgtggctcaggtgacgggtacgccaaaatctcagaaatcaccactaaaaagcttattcatgtaaccaaacaccacctgtttcccaaaaacctattgaaataaaaaaaggaatataaataaataaataacattattggaacaataagaaagccaaaaacaaacaaataaacagcaaatacaaataataaagagttttgatggaaatccattgaaatgttaattatgttttaaagcaggagtgtccaatcttttggcttccctgggctacagtggaagaagaattgtcttgggccacatataaaatacacaaatttttagctgatgagctaaaaaaaaaattgcaaaaaaatctcataacgttttaagaaaatgtatgaatttttgttgggccacattcaaagccatcctgggttgcatgcagcctgagggctgtaggttggacaagcttgttttaaggtattaatttatgctcttcttttccctagaagtataatatatacagaaaagtacaaaaaacatgagcagatagatcaatgaagtattgttaagccagatccaggaatagatatttccaacacccccagaaggtccgcccattatatccccttctagttatgacatcctccttctgcctcaaagatgagccatatcttgacttgtgaatttgtaattattattgctttttaattttatatgaataaaatcatgcaatatataatatattgcttcaagtctggcttattagccaactatgtttctgagatccttttatattgttgtaggtagctgtagttcatttttctgatcacatataatattttattgtatgaatataatgcagtttatgtggaacttttactgttattggaaaattgtattatttctaagtgcattcttctatgattattcttgcacatatcttttgggagatctgtgtaaatatttctctgttgtatataccagaaatcagaattatcgggaaattgggcatgcatatgacaattttaaaagataacaccaaattgttgtctatagtgattttattaatttgtactctttccagtaatgtttttttctatattcttgacaatatttgatatgatcagtctttttaaaaattttagccttttgcagggggatagtaaaaagtatctcattttggtttagcttctgtttcctgatcactaatgaaattgggcactttttaaaattattattggctatttggaaacctccctccctccccttggtttctaggaataacttaattcatttttccatattttaattgtgttgtctttgttttcattagtgattgattctagagaagagcacaatgttgcttttttgtgtaggaaaccgcttctactgtgtcgcttgccttttcactctcttaatcatgtcttttgataaacagaaaaatttaaatttaacatagttcaatctattggtctttttctttttgagatgttttttgtaaaaagtttaagaactgttttccttccttgcgatcatattttcctgttatcttctatagtgtattttgtccttcgtatttaaattataatgcacctgcattttatttatttattcatttattttcatggtgtaaaattggttcaatatacaatttttttctatagggatccaattgagccagaacatatatgaaagatgcagtcctttctttgctgttctacagtgccattcctaaagggaattaaatctgcatgcctgcttgagcctgctattgacctcttttttctctcttcctttgttgtatttgtaaatgccatattctagtaattactgcagtcttacaataagtcttaatatctgatagctattaaaatagactatatggtttaaaaaaaaaagaggcttgaattgtaagtgaaaccaaaggagaataaaatccaaagagaaccagaggagaataaaaattcatgccatgagatccaatccattatgaaaattgagctttaaaaagctttagaattagtgaccaaggcaaagagcggtacatatctttcattggataaaaatataacaactgtttctgtgagtataatcaccctgagtataaaaagcccgagggaagcttctcctgtgaacctgcatcaagagcagtgggtgattccgtggattatagtcccctcacagacatgcaatgctggcttttttatggtagcttcctatagcatatctcaaaaataatagctaccatgtattaggtatctattaagccttttacataacatttgttaaaaaaaaaattcccaaactatgtgcctggtttgctaccactatagccaatgtcactgggcatctcactattctctgactgtagctgttacaagagcatcaatagattctctaaaatgcagacaatagaaaggagttgctaaatttgtcaaattttaagtgaatctactgcttattttgttggtatgttgggtggctcttcttggtggaaggctcacaacctgtaactgactccagagcttctgcttaccaatttcagaaaactaggtttcgagtatttcctttgagcattccttcatgtgcttttatgaggctaactctccttccctatttccaagatggatactttgggaaggtaacatattctagttctcaaattgatgtaagtacatttatgttactttcttctctatttttgtagcagtgagggaataatgggaatttatacaaataaaccacatgagtatttcaagttctgtgatgttgatcacattctctgtgatgtatgctttagttgtatcttcctcaaagtaagtaccaaccttcctacagttatttctaattaaacaggataatctagtttaatcctcaaaactaccatgtaaaatagaagctactattataatttcaattttatatataaggaaaattaagttcagagaagtgaagtaatgtgcccaaggacatcaagaaatagtgaagttgggcctgtaatctcagcactttaggaggccaaggtgggtggattgcgtgagttcaggagtttgagactaggttggccaacatggtgaaactctgtctccactaaaaatacaaaaattagccaggtgtggtggtgggcgcctgtaatcccagctacttgggaggctgatgcaggaggatcgcttgaacccgagaggcggaggttgcagtgagctgagatcgtgccattgcactccagcctgggcgacatgagtgaaactccattgcactccagcctggacaacaagagagaaactccatctcaaaaaaaaaagaataaataaatagtgaagctaggatttgatgccagacattctgacatcttaaccgcttccttaatcattcaactaatgcttgtcaaatttaatgtgcacaggaatcacttggagatcttattaaatgcaaattctgattcagtaggtctaaagtgaggcccaagattctacatgtttaacaagatcacaggtaacactgatggtgctgccctggacagatatcagacggtgggtagcaaacagtctcaaaatgaaccttaggttaatgtctaaagacaatcaaatagcattaccataggggtcaacacaaggtgatagaaggaatagctctattatgatgtaaagaaatcttagggaaaaacaaatggtaattggtatttcccaccactaagatggtcattcaactatccatttatgcatccaaacaatgcatatttattaagcacctaccatatgtgtcaaacataagtgcaagcagtaagtaaaataaggtctattttctgtatttatacatctgccaaagtataaatgcagactcactttttaaaaaaggaattatatgaatgccattggaataaagcaccaggaaaaaaatgtgcttgagcattaaccaaagtaataggttttcaaactgtatttccttgccagaaatactatcctcctaggcagtgtttctactcatgacagaaaatgcaaataaggaagagtctccatctatagacgtgatttaacaagtcaattgcaggtgtttttcctcctttttgagaattgtgcggttgagagatctactttcacatacatattaatgagttgttttgcataaatcaattctatttttatgaatggagattatataaccctcctgtaattcttccagaaatcccatccaaacaagctactagagttcttagtagggtatgtcccttgagcacaaaggattttattttaattatttcatccatttttaagcaaaagtaatcaaatataaacaactgtgctggaggctgcaccctctgccagctgcctctcagccttctgaaaggctctgtttttgtgttgtttctgttttgtttttttgttgttttttgttttttgtttttgtacttttctcagtactcatttagaaagcaatcctattgtttttatttaaaaaggtgtaaaatgtagctgattcaaactttaaaatttatgatattcctctttggcaagtctagctgactatgggccctgaatattattattgctataaatattaaaattaataaaagcttatatgtgtccagtaagccaaaatatgggaaaacatttcctgagcttgcttaaattttcacagcaagtgaatggcagagccaggactttaaacctcggtctaatggacaacagaaatcaggcttcaaacacaacactggcatttcaaagcatgtcccaggtggcagatgtcctaaagaagcatctcacttctacctgtggttccagttagctcactctatcctccaccttctttccatagttaacaggggaaaatgtcagagtctgtgatgcactggataaaattgtcctcccctgagctccacgttttcacagctggagtgaagaaggtgtcttggcaagattcccacaaacacacactcaaaacacacatcctcactcccatatttgccttgacatcaccatctctgcttttacgaggtcttgactcctgtgtacataaggcagcaagcctggaattcttaggtcacccctcattgcccaaaccttcatctacatagagctctgaatgttcccgtatctgaacccacttcccaatcctccgcagcttgtgaaattcttccttgggcctcctaaaaccaaaatcaataattagcaaaatctttgcacacttaaagttttccctgaaagtccccctgactgtgttgcttcaactgacatttggcttccatctgaagatgcttctcctctctggctgaactgctgattcttttctccaatacccctcttaccacaggtctgtcagtagggatagagtcgtcccatctcctccgtgccatttccagatgatccctcctccctcatatctaattcctttgccattaaaatcatgccattagcccgcactactcataacttctctttgttgcaatcatattctcatcccctaaactccaacatttcttgaagattttacctattagctcactgtcattctctgcataatactcctgtcgaatatcttggccatttcagcctttggtgaatttggtattcagtactcaatatcctgatttgccagtttcttgacttctttcgttctgttgcccttgtttatcgacccatcttagccaatagccacgctgctaagatgactcttttaagactttgtcaatgtctaaagttgccagttccacccataatctgattttcaaccttcccaaatttgactgtctgactcactctctccagtccatggactccagcaatactttgactctgctagatcctataattcacgaatcctaacaactactcctgtccttctcctgcttcgtcttgtcattccctctatactgagacaaaggcaaaaaacacttcttctcattaacttttaactcacttgctcatcacttgcacatcaatgattcactttcactttcccccttatttcattcatctggtgaaatctaagccatgatgaaatccaaaccaaaattttaatctagtgaaaaatccaactatgacacctgctttcactttccaattaatgaccaccgacatcagtggtccattcagtgggccattaatgttgcctgacattaagtcaccatgaagctcaaagatgttactgtattgccggcatcttcagtctagaaaggccctctgtaggtggaaaaaagtatgagctagtatttttctcctataaaagtcaactaaatcatcctcacatacctcaaacaacattttcctgaccctttaatataatttatgttataaactgcttgatacttagttctgattcaggtctgactcattgcctagtccctgagccaggatggactttggctgtacttgagatgtcaaggtaatctggcactctgactaactagatgtgtttcagttgcttacctctagagttatttccccaaaataattccaatgaaacgttaaaacacacaacaaaggcagcctctttctttttccaatcccatctatcacataccattggatttctgttttgctacaaagtcctgaaggttttggccttttatttttatctcacaacctaggcccacttcttaaacattgcctagcttgcctttcccttttaaaatctgccaacaatcactttctctgttgaaattatctcttcctacatccaactgtgggaagaacagccttttcattgtgctgttctctgaggacaagaatagaagcacattttttaattcttatttttgtgtgacttttttctgcttagtagttaccagtttttactacaattgtgattcctgacaatatataacatttagaaaataaggaaaagctattaataatatcacctgagccagagacaaccactgttaacattagtagattcttctaaaattttttcttatacaaatcataaacacagatggatgaatatttgttaattgtggataactatttcactttacggaaataatacaacaaacactttaaaacattttccctactagtcattttagaggatattttaacaaaaataataaaatacggagaacaattaagatttcagaattttcaaagtttgcatattcatgatctgttttttaaaattcaggtctcctgactaagatgcttattttactgcagagaaataagcttttgtggataccacactcaaggggaaagacaggcttattctcgaagcaaatagagggtccttcctgccaatatgacctagagaaacagacaaatagtgagaagatgcatctccgagaaccttcaggctgggccactgtaaatccggttggatttgactcaacccagggcataagtaatgttctcagggcatttccttaacgaagactccctattgaaagaaggtatagcatgaacaatgtcgggaagtcagaatgcttaatttctgcattttcttcctctgaactgctaagattgtatttagagacaggtagagtcctatgtgcgtgttctaatctagttaatttacttcaatcatcctcttttattttgccagcaggcaaagccccttcagaatacctaattattattccagactcctgtcttagttttcatcagaggacttgtatatttcattagcttcagtccttgtaccacctctccttaccaagcccagcattgtgacaccatgtcctttacccttgtgtttttgaaagcaaaagaagaaacgcatacatttttattattcattcttttatctcactagtcttgttctgcgaaaatttgagatctcaatagatagtgaaacagtctttcacccttttccatggaataaatagttattggtgtttatatactctataattattatatgttgataaatggttatgtaatagctgcatacagggaggaaaagtccttgcaggtaattttgtctgctaattacatataaattggttaagcagtcatgcgtattgatgacatcgttttcaactgatttgacttctcaaaattactaaacttctacctggtcatctaaggcaggacaatttttccccaggatgaggggttggagggcagtggtttcagcaggtattagattctcataaggagtgcacaacctagatccctcgtatgcgcagttcacaatagggttcacactcctataaggatctaacaccgctgttgatctgacaggaggcagaattcaggcggtaacactctctcacctgccactcacctcacctcctgctgtgcagtcagatttctaactgtctatggcccagcactgcagcccagtggttggggactgctgatctaaggaataatctcagtctttgtctctctttatccaaaacaaccataagtctattatataaaaataatgtatgtatgtatacattttgcatgtgcttacatgtctctgcgcacacacataaatttatataaatgggattgttctagtaaccgacatttttctttaaaatttttaagttataaaaaatttcaaacatacagaaatgtctataaaaatattataaacagatttttatttaaatgtgtgttaatgtttttgcatttttgcttcagatcttttttaaagacataaaatataccaatactgccaattttcatctcgtgctttctttccctcccttcccagaagtaaccgctttcctgaagttggtgataattttttgaagtatggcttgaaatttttattgtctttgtttataatatttatataaatgtcatcagagtacaatttctttggcacctttttcactctacattcagtttttgaaattcagccatatttctacgtgtttacttattttaaatgttgtgtagtatttcattggattaatgaaagaagtttacttcgtttcaacgaaggaatgagaataaaatttaatcctgttttttcaggaacaatacactataaaggtatttttatttatatccatcaatttcacttatttttattgagctattatcatgtgtcagactctatcatgtgtggaagttacagtgctgataaaacaaacacatccttgcctgccatgagtctacgaaagcagtaggagagggatcacataaatatgtacagcataaaaaatgtaataaatagtctgaggagactctgagagactaaaatgaaaaagttatttattggaggctcaagaaagcaggattcaagatggatgaaatttccaatgaaggaaaattaaggttcatcaaaattagttatctgttagagttttttgtatctaatgccacagtaatgtgctgaaacaaagcatgaaaaaaacccatgatgtccagcagtaaacatttatttttggtcacgaatttttggtttactcggtggttcctctggtcttcttggggttcagttttacattggtggtcacatatgcagttacgttaatcttgctgggctaattcattacgtattgttggcccaggctggggcaactgcagtgatttatttcttctgcacatggcctctcatgctccagcctgctactccaggcttttaccatggtagctgggtggggatccaagagcaaggggatagaaggctacacagctacttgaggcatatgctcagaaccaatatattgtcacttctgctgcattttgtttgcaaagtcagaccagattgaggaatggtgaaagagactatgcctctgatggaagatgctgcaaagtcattgcaatagggtacaggaaggtgaaaaattaggactaagttgtaatcactctcccatggtgatatgaggaatggggtaagaatattccatagacggaaacaccacgtttaaagcctatgaaattggaaggggctacgtaagacatttgaaaatggaaaaaaaaaaagaaagaaagaaagaaagaaaggaattgtggagcctattgaggaaaaaagggaatggtgtcagtaaaagctggagaaattggcagggaccatattatgctggcattattgctaacactcaggattttgaattgtatcctaggaacagtagagctccatacaattttaagaaatgtattatttaattgatgacgttacctaatttattacatgatttaatcgattatatataatctaagtttaaaattatttttattatttcttagagtcaaggtctcactctattgcccagcttgagtgcagtggcaccatcacaacctactgcagcttcaaactcctgggctcaagcaatcgttttgcttcagcctcctgagtagtagctgggtccacaagcttgcaccaccatgactggctaattttttattttattttattttagttttagttttattgttttttgagacagagtctcgctctgtcatccaggcttgagtacagtggagagatcaagactaaccacaatggggatccacctaagctcaagaaatccactcagctcagtctcccaagcagctgggaatacaggcgtgtgccaccatatccggctaatttttaagatttttttgtagagacaaggtctccctatgttgcccacgctagttttgaactcctgggttcaaatgatccttctgtcgtggtctcctaaagtgctgcgattacaggcatgagccaccaagcctattatagaatgtaatttttaattaaagttatttgctttatctgtattaaaatatcttaagaattataattttctaagttatgaaataatctgggagcctattgagtcattaagatgttagacgtgaaagtgtgggtgagaggtagcaatggagactaagaaaactgagatatgattgagaaattttggatgttaaaccaataatatttgctatgaggtgggatgtgggttttgagaaagaggatagtatcaaatatcgccaaatggataattgatatttattatttactttgatgaggaagacttgaagaactactttgaataaagaattaagagttcaatttcagagatgtcctgaggttggatataagggtctggattgccaacagaaagtctgtgctaaccatatgaatttgagaattatctacatataaatgttacttgaagccttgggagtagttgaagtcaccaggagtaaatttttcaatcaagaagaaaagaagacaaaaaataaatcccaaataattccaattattagacatcagggaatataaatagatatgttcatggttttaaatggctacatatcatctgattatatgtctttaccataattattctaaataaatgtctcttattggactttgttaggcttcattagacagtaataaaataactatctattatatacttctttactcatttgccaattatatccgaacagtagatactgggaagttgaattgctgggaaaagtaggttatacattttaaatgtgaatgcatcttgattaacaacctttgaaaaatggttatgccaaatgatactttcaacagcaccacccgaatatgctattacatcaatccctcttgatattatgtattgcttaatatgtacccttagcaatctgatgggtgacaaattcttgttgttttcatttggatgtctaggtttatttgtaaaatcaaacttttcttatctgtttattggcaatttaaaattattttgtaaatttcctaaattgggtctttgcctagttttctgttgaaggattcaaattcatttccaggaattattttaaatatgttaatatttttcttttacaaattatgtgaaatgttcctatttttattttaacttggctagttgtgtttttatgatacagaaattttagcaaagaaattgttttgtaattcaatttctctctcattttctttataatgctttttgtggcacatgcagaaacattatttaagccctatgattgtaaaaactatttttggtcagcactcttataatttcattaattccttcgaggccttcgattcaccttgaattttttgtaatgagcctgaggtaaacacccaaccttgcttccccacccctgccctatgaaatttccccaattccatttaataagtagttcagtgttgacagagcccattttctacttcaaatccaagaggttttctgctgtggaggcagtacaatatagtagttaagagtaaagttcccaattactctaaataattttcccttcacacccctcccggcagggtagaacactagctggtgagagcgagctattctacaaagctcaaagctacaccgaagggtcatatttctcctctagagaaagcccatttaacaacaaaagacaaacttttaaaatggcagcactgcctagatactaatggtttctgatgccttattcttcctgtaaataggtcagatataaaggtttagaagtcagcattaagaccaaatgcagcatctaaactagagaaagtgagtgaggaactgccttgaagtccattctatcaatttcattttaacctgatttatttggctatatgtttgccccctctgcatttcctatatcagctccatcacaaatcagtcccctccaagttgtattggaaaagcaatatatgtgattgagatattgttaacaacaaagccaattctggtcccagagctgttagattgtgattgataaaacttaatattttgaagggaggaagaaaaaaaacctattattccagttcttttatttgtagtgtgggtgaagttccttttatctcctctactttcattgtagcagtatgactgaaattccaataaattattgaatgcaatatccagatgtccagatgattttttggtgctgctgctacttcttagtgagcaagacaaaagatagttgaggttctgcaaaaagtgtcaaagcttagcaataaaataagatttcattgaacagaaactaatggaatcactcaatttatttccctttcactgttgtaatgcagggaaatcttgcttcatacgagtcacaaagcttgagtgtgcagtggcctggctctggcattgcatggtttgtgtgtgagggattggaatacctttaataaaaaagcgtggggtgaagcagcttagtctttcaaataaaagaagtttcagtgtctgggcatcatggctgtttaaaagtcaactttttcaactttttctcctcgtgtcacctttttaatattcttggggtccctgaagacctatatctccagttcatcttggcatacttaggttcaggttttatctgctccatggggacagctacctttttcttagagtgcttccattttcttttctcagatgcactttgtagctgtgtcatagattagccaagcatgcctgattgagatattaatctgaaggagtgttggttaagagacagaccagtggtcagcaaaccttttctgtaaagagccagatagtaaatatgtttgattttccggccaatgtctctgctgttattgggtgaaagcagccacccataaacccattaatgtggctgtgttccaataaaactttattcacaaaacagacagtgagtaggatttagctcatgggttgcagtctgcagagcactggagttcactcagaatactttatagatgtgtcctaccaatgatgactgttaacatttattaagcatttgctaaaaattctccttagataatctcatttctcatattatttactaaaactaaagtgtgggtactatttataaccatgtttatagataaataactgaagaagacagaacaagtaatttactagtacatggtagaagggcatttgaactcaggctcactctagggcccaagcttctaaccactctgccataatgcttttctcattaattaatagaaatgcaaatgctgtgaaaatccattttgttaagatatttttgtctaagtaagttttttttgtttttaattaatgacgtgtcacatatgtttcagcttactattcacaggacactagattactattattatttaaatgtaattatttaatttctattttgggaagattaaccatgaatttactggcagtggaaaaacacaaaggactaaatacaagatgcataaagtcagcatgaagagatgaaaacagacagggatgtgaacttacatgagttgagtctttaaattctggctctgtcctttacaatgtatgactttgcatgttacattctgagccttaattttctcattcatgaaactagaaaaacactagctctatatctacatcaaaattattttgagaatctattaaattacctaatgtagacatgcttgtatagatgtatccatgtataataatatttgcagtatactatatgtaattatatacatacacacacatacatacaaacacacaatagtatatattagtcatttttatttagaggaataaagaaattctgtgtttaaatgatatgttaaaactgctttgaatttggatcaaaatttagagtagattttcacaggttctgaggcataaagagttcttaagggtcatgtaggccatgcctctgtcttcaggaagagatatccttaagccaatgcagatgagatcctgtctatttcttttagagaaacaatttagtgaaagtgcctataaaccatttgctgatagaaagacaacctcttgaatacaaattgactccctgattgcaagtgactttgtgatgacaagcaagagaacttttcacaaacacagaatatcaaaaacattttttgtttgtttgttttcgggagtcaattgcctgtgtgcctgtggcttccggatgggggttccgattcaaaacatccagaggctccatcagtacttactatgcaacataacacctcttagtgtctagaggtgagtcttaatattttataccattaactgtgtagtcccaaagatagattcagggcagatgtttgatgtttggtttgctgagtaccatagcgagtttctctgcctatctttgacatttttgtagcagtaaccacatcacccttcttaatcactggtgctttagataataattccctcaaataaaacaaaaactgaggtgattttataacacattatgatatggtttggctgtgtccctgcccaaatctcatcttgaattgcagttctcataatctccacctgttgggggagggatcctgtgggaggtaattgaatcatgggggcggttaccctcatgctgttctcttgataatgagttctcacgagatctgataatttaaaggggcttttctccttttgcttggtacctctacctgatgccgccgtgtaaagaaggacgtgtatgcttccccttctgccatgactgtaagtttcctgaggcctccccagacatgctgaactgtgagccaattaaacctctttcctttataaattacccagtgtcaggtatgtctgtattagcagtgtgtgaacaaagtaatacacattatattctctcctttttgaagaaaaaattaagaaactggctgttcaaacttaatgtgaagtatcagagaactctatgtgcgatggggaaaaaaaaattagagaaacattggtttgccaccagtggaaactaaccagtcttgtctgtttagttcattgttgcattttcagctgctagagcagtacggggcacattttagttacttaataaatttggcagatgagacttcctttaaatgtctacagcacaatctctttggctttctgtgaaagcagatctcatggcgaagacatggactatgtagtgtatttaggtggtattctcagaagtatggtgaaggagtaggtaaatagatagcaaaaggagaaaacccaaaaactgatgaagaataaggtaattaattggttgtcattgtgggcaattgtggctcagtacagctgagtgccccctacagctatcaagcacatctcattattagcccagcataggccaaggaaactgggacatttactcattaccttctgtacctcattggttaaggatcagtcctcaggacttcaatttctggtaacctggcctgctttctatgtagacaagtatgtgtctgtggaataaaaaataatttctcagagcattctcaggcagagcaacccaaatggaggcagcaaaccctctaacgtaactgtcccccaatgtgacaggtaacttcctaaatgggttgaacagatatatgggatatggggcacctacagtggctgctacaatcatactttaaaagaactataacacttttggtttcccatgtgacagtcataatgtgagaaaattcaagaaattagcttgatatttacattttatcacataattttaatttaaaaggtcacatgtaataagacaagaggaggtgtaaaagttcagagatagcagttccggaatttcacattttttcccgtatacttggccctagtatttctatgagtaaataggttagtttttagttgttcttggtaaattactggatatgcgactggactgcacttatgctatccttcaaataaatgaaaaacccaattgagacaactggacagtgatctcctggattaattattatactgaagatgataattacagtttctgcctgtcttataaataagcagtcctcagttgccaaatgggcaacctcttttctgcagttacagatgtgcggcattaaacatctcaaaaatccgaagtaagagtcacaagaggacttcatggtaggctcaggggcagagaagcttatgcagtgttgtggctaggataagccaaagcaatatgcagtctgagatgttatgggggcatgaactataagtaaaaacaaggagactgatcagctgggaagacagtggagcagatattcatgcaaagcagagttaacagagactgggacacctgtagataaaggaacctagagagggaggaagagaataattggcaggtgtggcaagtgtccttcctgttcccagatatgcctcctgcactttgttggtctaagatttctcttgatcctttttaactccacccccgctttagtttatactactttaagtgaatttcatttcctggcatgtaaagagacctggcgcaaacaatgaacacacaataatcattgtagcagaaattgaaatgaactagaaaatcaaccagttggtcgtttaggccttatggcattgtgctaaagactataggtcatactttttgggatttgaatctttgttctattaattagtaaccagttcagtgaccttttggcaagttttttgaacatttctgggatttagcatttcatgtgtaaaatatatgtaataataataaatatttactgtacaatatgcttgtatagtacccacatatatagtataaattttatgaagattaaatgtaaatataaataaatccaagaagataattggtataataaaaagaaaaataactaaaaaataaataaatgtaataattaaatctacatatcgtttaaatcaactccaagtctttgtaagagttataagttatttagggccatttgacatgtagtttttaaacaagttacttatttcatttaagtctcacaacagtcaaataatatacctattttcagaacattttatagatccattcacccattcctcttttcagcaaatgttcttgagtgccctttgtgtattagacactgagcatattcagagaaattgaaaaaaaatgaaaagtaccattttaaatgtctcacagcttataaatccaagcacttcattcaagcacagatttatctgactccaaagcccaaacattttccttcaactatgtgaacactctttttatgtgaaataagcaagctttccatctgtttgagggtttttctgtctcccctgggccccagtctcttataacctaattttggaagtgacaagccataatttgaccagactcagttggttgtgcagactaatgctgacacaatgcggcaatacacaaagtggtggatattggaagcgagttcattcggggccgttttgcagcctagctaccacatgtttccaggtcgatcctagcctcttctctaagaaacctttaatcagacaaatttggtcttttgctctcttcaattcctaaaggaaatattgtagactatgtttgtagtattttgtatgcattcactcgctttagaggtataattatttcttaatttattaaacatgttcttgttgaatacctgctttttgcaaacactgaactcgcgggaaaacaaggtccctgttttcgtgaagcttatggtctatttagagcacactgaaataaagtaaatcaataatcattgctgacagtgactgggcctttggggaaaaatacagagtgatagggaactgctacgttagattggttagccaagggagggttcactatgtggtagtagcaagtaggctgagatctaaatgtcaaaaagaatctagaatgcaaagatctgggggtaagttttcaagcagaagaaacaagaagaccaagggccatcgggggaagaaactcattatgttccgaaaaacaggaaaataaaatggcagctgtatttggaatgttctgaacacaggtgaaaggatggggtaaacagggccatatcatatggggctttaagtaatttagtaaactatttaaagtcatctttatttctctgggttgactgatcattaatcaaatattttttgagtacctactgtgggccagcacttactggtactgcaaaggtaaacctgtacacattttgtggaaaggcgctgatacaaacaaacggtggcagccaagtagggttattttttgaaaagattttataaatacatgagttagtgaacaaactctacatttaaattactgttatagcaaattataatgcaatgcaagcagttcacctctttgtaaacttattgaatcagccaacatgtcctgaaccacctgtctttgaggagcagccacatagagagaggttgagtggttgatgtcatttgggactaaaagttccagtttcagctttgactgtaacctataacttaaaccagcttcatctgtatttttaaaattatttttaaattttatttttaattaactaataataattgtatagatttatagggtaaaatgtggtattttgatgtatctttagattatggaatggttaaatcaagctaattaaatttgtcaccccacatacttgtcattttttgtggtaaaaacatttaaaatctactcttctagaaattttggagtatacaatacattattatttattatttttaccactctgtgcaatagatcactaaagctttttcttcctgtttcactgaaacttcgcactgtttgactaacatttccccatttcctatgcacccctctcccccagcctctggtaaccaccattctactctctacttacatgaatttaacttttttgattccttgtatgagtgagatcatttggtatttgtcattctgttgctggcttattttacttagcataatgtcctccaggttcatccatgttgccacaaatgaccgaatttcctttttttttttttttttttggctggatagggatagtattttattgtgtatatatgccacatttttgttatctattcacctgatgatggacacttaacttgcttccatgtcattgcattcaccagaatgcagatatctctttggcatactgatttcaatttctttggatatatacaagaagtgggattgctagatcatgtggtaattctatcattagttgtctcagctagcactctctgcctcttcacctctaaatgaaacctagtcactgttctctggaaaaatcagtgtccaggtaattccagtgtaacccaatgaacagacatttccatgactacttctggctccaacttttgctgaagtcccattctctgctctgggtcttacagttttccctccttctccatcctggttcttactcaagagtagaaatgttttcttaattctgtccctcacacaacacacttgataaacacatgtctatagatttttgtttgtaacaaaatgtttgtagacatttaggggaggagtattggcaaaagaaaacacaaattactataagcagaaaagactatttctaagagtccttcagcattctatatcttgattttctttttgtttctgttctctcccctccaccaaatccttcatcatggcaaatgcagtcagaccactttggttgtctcaaagatgtcttgtctcctgatatgccatgtcctctggagctcagatggcccgttttcctcaacaaggtttttcagctttagcctgaaacacaaaaaacctttgtgttttttgaaatatcaatgtactgtctgtactatgttttatttttcccaaattgctttgattttttaatgagtaaatttgtttgaaaaaacatatttattaccactgtatctagaaagccagtgtcattcatcacaaatagaacaaaactttaaaaggcaatacatagttatataaagttaaaggtgtttttttttttgcataacacctaagtgcgtcacccatacaaccagtgatatctctcccacacattggtaatgtctcttctgcttatctctcagggttactatcaacattaaaaatgatgacagaaatgaaaatgctttggaaaaaagtgagattttatttaatagtctctctttccctccctccctttatctaaaccataatgcatgcaagggtccttatcactgaacctaattctccttagtgctgagctggagaaagctacaaagaaaatgccgattgcagctgtgattccaaagaccttgcttggactaagaaaattcaacggaaaaatgtcagtatttaccatcaaccctgcagtcactctcccgaattccagttgtggaagttcttgcaaaccgaaaccagtaggataaaaatctctggtaaactcagagcttatgtccatgggaagtctttaaaaaaatgttcttgcttcacgcttcttgtataaacaggagcattaagacctttacccaggagctctgtcccattacctccaaaactcggccttttgtattttacataggttgcaaattttgcaatctaactttctgattaaaccatcacaatgaataaaagggcttattaagggctctgtctatgaaggaccatagcaggtataatggttcgcataaaccactctttccaagtgacctcgggcctcactccattgaaatcactctcctttactctaatgagagtcacacatgtgaatcaagagggagctataaatgcagttgttcttggaagggcacaggtgcacctaatttgccaccaaaaccaacaccttcagccccctttgctgatgacctggcccaggagtgaattacaagtgagcttctggccagactccctcagacctctgggaagccagtggtcagcctggcccttttttttttttttttttttttttggagacagagtctctctctgtaacctgcgacccccaggttcaagcaattcttctgcctcagcctcccaggtagctgggactacaggcacacactgccacgccccactaattttttggatagcctgaactttcttgttacctaccacctgctaagacttaagtacaaggtcaggatgtacttcccccagtgacagggcagactctgtttgcttgctcttggataaaaagaaactgtttgcagccctctttttcctctccttcctcactttttttccctctcccaccattgagcagggaaagtggtatcctgaatagctgaaaatgaatcagagctgggtagtagtccctattcaataaaaggcctccttttatttttttagttatgtggtcttgagcacattgcttaacctttctgagcactggtgtgtatatttatgaaatgggagtcatatggggtacctacaactcattttgtttataaagttcaggaattgggaaggtctcagtaattaagaggtccccggctcctgtaccaggaagcccctctcacggtacacctctatagctcttagctgttgccatcaaatatttaaccaaaatctaataaacacttgatattggagaaaaattggaatgctgatatccaagtaggaagtaagaaggtcttttaagagtttatagtgtcgaatccatttacggtccaagttaaaatttctctttgggaaagataaaataatatttataaaaattaacaagtggagagaaagtgagttgttttttggcgtcctgggaataatgaattcaacaagctgatctttggatgagtcactttagtgtctgcaatggcaatggaatatacacgtttcttttgccattcagggcttcctcagcagaaacctcacatttctttctgaaaaaaaaaacacgtcccttgatgacaccactgatgacaccttgatgactttcccacatgaggatgatttacctgaagatttggccttttctggatactcccctttttgcctttgaacaatatttatatcacatattaatcccaagaagcacaaattgccccaaagaaatctctttagagattattgactacaaaggttttggcactgtcctccctgcagaacaaaaggtgagaaaatgaacatttgccaaaaggcaaagcccaagactatgagaagcagggcagcctaggatttttctggctattgtatgtccacccaagaggtcactgctgcctccagctgggctgtgtagcttcctaggcagtgagggtcactaaccatcagtctaacaacttgtgtcaagttggagaaacattctctggcataaaatagagagtgggctgggcgcggtggctcacgcttgtaatcccagcactttgggaggccgaggcgggcggatcacgaggtcaggagatcgagaccatcctggttaatgtggtgaaaccccgtctctactaaaaatataaaaaattagccaggcgcggtggcaggtgcctgtagtcccagctacttgggaggctgaggcaggagaatggcgtgaacccgggaggaggagcttgcagtgagccgagattgagccactgcactccagcctgggcgacagagcgagactccgtctcaaaaaaaaaaaaaaaaaatacagtgtgatgtggcagttcttggaataaaattcacatatttttgactttaggtctcctttttgtttttttccattcattcatgagcatttaagctgccaccgaataggcacagaagtaagtcctgactcagtcttcaagaaaatatgtctcgttacatcatccgacactgagatgaaagctgaaaaaaaagccagtttaaaagttcaagctgggattggtggcacacacctgtaatcctagctactcagaaggctaaggcaggaggattgcatgagcccagagatttgaggttacagtgagctatgatcaagccactgcactccagccgaggcaagagagtgagaccctgtctcaaaagttataaaataaataaaataaaaataaaaattcaaaacatcctaattttgttgatgtgccctcgtatcatcagtaatgtgattaaagtccctcacatcatatattttgtacttaacatcttctacacactttaattgtattatgtcattttttttcctctgaggcaggtactattgttagctagcttattttaaaagtgaagaaaactgaggtagaaagatactaaataatctgccctaaatcaatagctagtgcatgcacggccaagctagcatttgaatatagatagtctgaccctaaacttgcatttttgatcattttgttccatcactaagccttttaaggaattcgttagtgggttatttaatctattttgcatgctacctacatcaccttcctttcaggaacaccaaaggccagttgccttttactagttaagtaatctggcatctcaatgtatcctatgcagttccataattgtgttctgtttctctcatctacttttaaatgtagggaatatgccagcttagtaagaagcgagtttgagtctagcccacatctagcacttgtatatttatttttgtcataagtgtcactgttcttaccaccatttgtcaggcaaatgtgtctattatagaaaatcaaatccagtctgacatgtatattatcatagaccaattacctaattgatatttcatattggtttacttgtttaatttatgaaatgtttacctccctgaaaacttaagtgctgggctgttagggaaaaacatgcattatgtgctccttactattatcctatctattttttcataaaaaaaaatgcttctcagtgaattcattatattcccagaaaaacaagaaacaacgcatttttttctctacttatatataaatttttacgaaaattcttttacacccccaaaagtgaggaattttaacttggactgtaaatggatttgacaccaggagctcttaaaataacttcttacttcctacttggatattagcattccaaatgtatgaccagttctaagatttagctattgcctcttttacagcgtttgacaataacattgtgcttgattaggttatgtcgtgttgtgttactgagttatgctaggaaacataataatatcatgaacaccatgactgagtatatagcatccagaaaacgatggtggaaaatgaaactggtttcagtagagatatttctctgtgccaattaataaaggcatgggaaaattagttactatagaactaaaacaaaatcactcaagaaataggaaatagcaacatgaacaattttggtattattcataactggtcctcttcaaagaagagaagcatggagagatacaaatttagaataacctcactataatgttttgagattcttaagagtattttaatactgaaagttgcatatatcatatctgggagttctgtgagacttatgcagatttggggatttgttttcttggtgtctttcaccatttctcttttgctgggcagagtactggcatttctttgccccgcaaaatgtttttgccgtaggccaaaacaaaatacataccttcaacatgggaaccgcatcgtgaaggtgaacaagtgctccaacatcttgtttactccagaaccagctttcagtgctaaaacttcttcagaaggattctcaaaggggggaaatagtatttggttgacggaaaccagaaagcagggtaaaataaatcatagagtttaaaattagacctaacgtctttgaagtgaccaataattgaaattgcttctgaggtgtgaaaagagagaaaaggtctgtctgggtgactttctagatagagaggcagtatggtctggtggttaagcgaatgcactctcgagccacaatatttgtttctttactttgtctttgtttgtttgtttgttcttgctttttgagacaaagtctgactctgtcacccaggctagagtgtggagtgcagttgtgcgatcttggctcactgcaacctctgcttcctgaatagctgggaccacaggtacatgccaccacattagactattttttatatttttagtagagacagggtttcaccatgttgcccgggctggtgtccaactcctggtctcatgtgatccgcccaccttggtgtcccaaattgctgggattacaggctggagccatggcgccttgtctagaaacacagcatctggaattaaattttatttcctttacttattacctgtttgaacccatacagatcaatcaatttctggtgtgacagcaggagcagagagagctgaacatcttggcagatgaaagcagcgggacattttcctcctgctcctgaaagagaggattgtagtagggaagttatagaagagagaaggcagacgcaagtaagaggagtaactaaagggcctttaggagccatatacccaatatttcattctaaggtgttcgagctgcatatgaatatatcagtaaggctgacacaggctcaaaatctggtagtggtgatgcaccacacctctgttgtatgtgctggtgggcggtgcatagctctctatgttggtcaaaataaggggctacattctatgttcacatgcagatacagggagagatgtaagggtggagataaatcgagaaatataaagagaggtacaaataaggattcagaggattcaggacatcagaaacagagccacttctagaaactacaaattcttgggggagagaaagcacctttacccctccgctagcaatttgtacaactttttggaaaagcattaggcttttgatggtttgaccatggagtattagtttatgttaattttgtaaattataagtggcaaggagaccccaggtaacatctggagagcagtgttttagtgtgaaccgtggaaccagagggatatggttttaatgtatccccacccaaatcccacattaaattgtagttgccataatccccacatgtcatgggagggacccagtgggaggtaattgaatcatgggggcaggttttacccatgctgttctcctgttagtgaataagtctcacaagatctaatggttttataaagggcagttcccctgcatacactgtcttgcctgccgccatgtaagacatgcctttgctcctccttcaccttccaccatgattatagggcctcctgagccatgtggagctgtgagtccattaaaactctttttctttatgaattatccagtctcaggtatttcttcatagcagtatgaaaattgactaatactcaaactctctttttcaaccttatctggacacatagaaattgggtcaactttggtcagtggccagtcatctgtgaacctcaatttcctccttcgctaaatgaaagtgacaatggtacaggtgattgtgaggattacaggtggttctgaggattcaatgagtgtacttatcagagcatctgacatataatggctattctccatatattaaaaaatgaaagaacaaagaaaaaatttaaaacattgcaatgaaataattcatacatagtaaatgggaaaaaatatatatcattattcagatttttaacaactcagctgagtgtactatgtcctactgtaagcatgcccatttttctggtgaatattttccctatctccagcttttcaggtgctgtcttcttggtcctgatcaatggaccctgggtacccatagccttccttcaagcttatgagacttggcaaaccactggcctccttctgtgtcaggggctggcactgtcaagtgcatcgtctgattgtgatcctcaggccttggcagcaaatgtacagttttcttgctttaattaggctgagattcattcctacacgtggcagctgcaaagatatattctcttacaattagatgttacaatacttgtattgcctgaaccttaattttaagtacattttggtggcccttgtccctcccttgcaccttggttgctccaagagagagcatatggcccagtaattctttaaagctcattttatgggccattctcaggcacttcctgctggcctttggaacagagccttattcgtgactgcatttttgcttatactcctgccaaatgcttcctccaaaaccagcaatcaaaccacaggacatgataagccatggccatcagaatggcttaatgagagcaacctcaacaatcaaggtcattaacagcaaccagcactgcaggatttgtatcccgtgcacaagggcagcctgggcaggtcacctttgtggtctatgagaatatctccaaatattatagaatttgagaccatctcagagaacgatctcattctaagcaattttcttttaagcaaaaatggataggacaaaaatagaaactggtggttctctctggcctctccttgtagaagaataaatctagagtttttaaaggtcttacagagcaaagaaaatattcgctggatgcttgtatggctacctaattcagtcacccttgcctcagaaaatgatctgaattaaatcttgtttccagctagcagaagggtatttgaaatacagattggatctgtacaatagaccttgttcaaagcatatccacatgagatggtacatagtttaaataaggcagacttatatcttgtctatgatctgtgtgctattaaacagttttaaaacgtgaattattaattaaaacctgtgaactactaacattttggaatgactgttttgatagctaacaggacttgtgtgacttttgagaggcgttgatttcctttcatgtcagctaatagaaatcccattgtaatcataaaaggcacagagaaattatgtcacaagcggatgctatttaagtggaagtgaacacagaatatattaaagtatcagtgttcttatcagcagtgtcttataatgacttctgattaacactgaaaagatgattgatgttcctaggattgtggagcactgacaatgtgacactgagagaattcaatccaaagcttgttaatttcatagaatcattcaatttctcattactcctttttgacagtgtttgtttttgtgaccattacaatatagtcacaatttaatggggcctttcaaaaacaatagtaagaaaaaaaccttaaaattgtcacctatgatgattattactagaaacagaaacaatgatttcaatatattaattttttttgttttaaaataaagcttattaggctgatttttattcaggagtcatatttaaactgatacaagccaaagtcatagaggactcccaagtcaaggcaatagttcacatcaacagcgccaacatatgtaggctgatttagttttttcatggccaaagaagaaaggaagcatatttgatgtaaattcctgtatgagaaacatggtaggcatgccaggtcctaaattagtataaagctaatgactgctgattgagagcaggtggagaacgggaagggggtgtagttgaggatcagtagagtttatcttaatacttttgttattaaatacttttgttattaaaagtatagaaaatataagactttctcaatttacatatcagatctggtgaatctatcttattgaactcatactttacatggattgaaaagcaatgtttacaaaaagaacactgatatgggaagtaatgtagttagcagagataaactgcggatgtttcaaataaaatcatctacctccaaaaattttactggaactagcatgtgatatttaacttgtatttttagattagtgtatctgaactttgtatcagtcagaggaaaatgtatggttggccctaaccactcagaatgtcataatcatagtaattaccactacccagtagtagtaattaccaatattctaggcttcagtcaagacactttaaattcatcattttatttaatccccataacaaccctgctaaacataggtgtgtttattggatcttttatcttcccaaatgaccacccaacgcccccacccaaatcagtttgattgaaaaatttgaaaccagcaccaaaaactttctcatctaacccagcaaaaactctgcagtccatcttttacaagcacatataagttttgttttaatttctctttccttacaaaggccgatccttccatgtgggttctcattatcacccttcaggctttacaaggaccttattttatctgtgtcctgaatcgtcagtctctttccttacttgatcattgatttcagcatagtggcctcaccctccaaaccttttggtattcttcctaaatctcatctcttactcatagccaactctaaagagttctcatgactgtgatctccatgtccttatctgctatctactatccacttctcgattcatattggctttttccccaaactctactgaaacttttcttggcaagatcacatatgaccaacattgttttgtcttttatgttcacgtattattcacctctagctttttacacacaccctctctctcatatctgtggttctctacctctaaatatggagattttcaaggttaactcctagacaactgtccaccaatttgctcgtgccaaaagtttaagagtcaccccatcaggtttacattcatacctatgacttcaaatatggtgtatatgcttataaatcccattcttagccctaagcttgttttcctgccactagatggtgccatttgggggtgatgggagacagtgacagatcatcaggcattaggttatcacaaggagtgtgcaacttggatccctcacatgcgcggttcacaatagggtttgtgttcctatgagaatctaatgccactgctgatctaacagggggcagagctcaggaggtaatgtgattgacagggagtggctgtaaataaaatgaagctttgttcgcttgcctgccactcatctcctgctgcgtggttttgggattggagatccctgttttatagtatttgtaatattgtcgcttagatagctcatggataatacaaatttaatagatccaaaatgaaattcttgaattcctctaaacaataccaataatttgttccaattagaccatagtaaggttgttaaaaaataagcaaaactaaaaaaactacaatgtgtaatctttagaagactttaaaagataaagacagatgtaagtaaagatgggtaatctctactttcacatctcccatccattcctctaagataaccaatgtgtatttttttaaaaattcattctgtaactttatgccaatctaacaggatgcttatattagttttttactgttgttttcttccacagtaggataatggtgtatcaatatttagtgactttttaaagaacatgacactaagaatgttccgagtcaaaccatttagatttgacgtattctttctaattttcaatgacatgactttctatgcatgttccaggtatgattcaacgatgtgcgctgctgtattattagattatttccaatccattttatttgtattttaaatttaaaccaaatgtattgtacgtacatagctcacgatatgctgcttgctactgtgcttgctctgaaaccttgcccattatgcactaacaacactggcttctattcagtacaacaaaacgtccctacattttttatatccagaaatttagtacggttttttcattctggaagcagttctttccctctgccttaccatcattgcatggctgtctctttctcatctgtcagatcagtgctctcttcttatcttttacagggtatcttagggtaaaaagttaaactgatgcgacagagaccccaaaacaaatgcctcaaacaagatagaaatttacttatatgtaatataatgatctaaagttgacgttccagattagctatgtttctgctccagctagtcactcaaatacccgggtgaatggtggctcttttgcattcagcaagtggctttcaagacctcccatatcattggcaatttggcaatttaggtgggtgtggtggtaggtggatcaggaacatcaaaatttgtggagatttcctctcaaacatagtaagtgaaagtttcattcatcatttttgcttgccatatttagctgcaaagaaatctgggaaatgtgatctctggttagacaagcatgtttgataacaagtctattattatgggagaaggaagaatagatcttggtagacaatttcagtctacactcaaggacacttaccacaatttgtaaatgatgtattcattttaaaaacaatcttctggtcttcccattagatagtaagcacaataaaggtaaaatacctgcctgttttattgttttattcacaaataaaccttctcccctgaatactacttctgtcttttagtaggttttctttttttttttttttttttttttttttttttgagaccgattctggctctgtctctcaggctggagtacagtggcgcaatctcggctcattgcaacctctgcctcctgggttcaagcaattctcatgcctcagcctcctgacatagctggaattacaggcgtgtgccaccatgcctggctaatttttgtaattttagtagagatggggttttgccatattggccaagctggtctcaaactcctggccacaagcaacttgcctgactcagcctcccaaagtgctgggattacaggagtgagccaccacacccagattagtaggttaattcattaaataactaattgaatgaatgaaaggattttacaggtaaagaaactgaggctcaaagaagttaaacaatttaggagaatgggtgaccattcttcaggaaggtggaaagatttatacctcagatggcttaacaagatagctagtaagcactctttcaactctgaatttctgtgattctgttatgcaggaaatcaccacattccaaataagatcatgagcctgctttgtaaaggaataaatcaagagaaaattgaaaatacactttttgtctcattggttctgtcacacagaactctttccctcacaccattacatcctaaattctcatagatgccagtcacactttaaaatggcaaccattaatctaagatgttggaagactgcagcaaacttgtgacatacctttctaaaatcacaccttccttggacagacaaagtaaatatgtgttgggcttcacagatttcctgctaggctacactgtctggaagaataaaagcaaacagatagtgagtattgtctttatcacatactgtgtttaattaaaaagaaagaaagaaacacaagattttgcaagataataataagtgcagttaaattgattgtcaactaagtcttctggtcagcaaagtatgagattaattccccttaataataaaaacattcttgagattcttctttaaaatatttattctgcaaagtaactaattataaatctgcttttctttgttttccaagatattgaagactttgaaactaaaacaagaagcacagtatctgtccgagaaggtcaaggtgtggtgcttctctgtggcccaccgccacattttggaggtatgatggggtgatttgggtcatatcatcaatgcggtcacttggagagtgatgtgagcacatcaggtcttaggctcagtgatcaccttttatcaaatcaaagaaattgtgactctcgtcaagtgcatctactgcatacaaatagttctatatctaaacattttcttttaaaaatattcgttcaagcagccacacagcaaatatgtttttaaggagatacatcatggcattgtacgtagtgtgagtgccagggctttttagagaaactgaccgcagctgtaattcggtgctgtgacaggcaaacttcatgacaaggggacaatttatttaccccactttgaggcttggttttctcatctataaaatagagacattaactgtttgtttgtttgtttgttcagttttgttgtaaatgttaaatgagctaataaatgtaaattgagtagtgtaataactaatactttagtaagtaaagaaagttaagattgttactacgtttttatttttgggctctatggagaagcaaattccaactaacactcctcttggcaatgtcacattaattaccggaagggatagatcaccattaactggaagcaaattctgtatagcaccaaatcagaatgtctcctggcaatggtaaaaatcaagcaataaatgccagcctctactttggaagactctggcttggtcagtggactggcccgttgtcagggatccaaactacttactgattctcatcctcttgggaatggattttctcaaatttcacatgatgtggtaaatttagtcgtgattctcaactcacagtgaacctgaaggaggcagtgtgaaaacatccatggagtcatttggtacaaaccaatatcacactatattatagaaagcttaataacagcaaggacttacacagcacagacccaaggactttaacatgtattagattcttaaattttcacaaaaacttataagagatatatgagtataattattgttttacaggctcagtacactatagagaaatagaaagatgttaattaactggtccaaggtcacgcagctggcaggcaatgaagccaatattcaaatccaggaagtctggttcccagaccctcagctcttaactatcactgcagttgttataattgatttccactctggaatgggagaacttttaaaatacaaaggacagatgtttaaaaataaaatttaagcaatttacttttaatgttaaaccaaatcttatttatgagccttgagaaacttgaaagcgtttttccattattatttttacacaacctcatgaattgccatgaccaaaagaaaagaaagctaattcaaagttaacaatatcttattcggtattattagagagtattatggcattatattcacctgatatgatagggaagagttgcaatgcttttaatgctatattgagataaaataatattgtttcagaacacacaataattgctgaggctcttttggtgcttattttttaacggtatagaagattattttccggcaccataatctaagatgacaaaatatgcaaaatggtatcagtttgtcctgtcagtctatgtcattttatgctcttacgatgttattcaaatattcttgacactactgaaaattgttttcaactttgtttaatcgggaataaaagaaatgtaaaatatttgtaaatgaatcagttccatatgtaaaaaaatttaaaaaattaaaaggcagccagacaggagacgcttgtccttgttaccttgtcacctatcaccattaaaggatatgtggatcttttagtgtgtgaggccctcattgtaacagcgcccgtggggtcgatgccataaaattaagtcacacatttacaaaaactgccttaaattaagacctttgtaactgaataatcttgctgcatgggagtaatggcaaacttgtgtaataccaatttttttttttttttttttttttgtgatagcatctcgctctgtctcccaggctggagtgcagtggctcgatcttggctcactgcaacctctgcctcctgggttcaagcgattctcctacctcagcctactgagtagctgggattacatttgcacacaaccacacccagctaatttctgtatttttagtagagacgggttttcgccatgttggccaggctggtctcaaactcctaacctcaggtgatctgcccacctcggcctcccaaagtgctgggattacaggcatgagtcaccgcacctggtccgagatttaatttatgttacaagtagcatctcatcatgattccaagcatatttgtcggctgaatcatgtttcttgctgttaaggtccctgtttccttgataactggctgttaagggacactctcaacttgtagaggctgctgaatttcttgccatgagcatttgtccaatgtcaaagccaggaacagagaatctgtctcacatttagtccctcgaacatttcaaatttctttagtcaggaagagccccatctcttgtgagggctcacctgatacagatcatgcccacaaaagctgaagtcagtttctttaaatcaacctgtgccatctaatcttatctaatcatggatatgatctctcatcctgctacaagtcgcactcacactcagatgaagagaattatacaagggcacgggtcgttgaaggtcatcttgggattttgccctacaatatgtttctcaaatattatttcttctatttccaatctccctaaaggctccatatttcctaccacacatggctctcacagagaaacgtcctagaaatatattcatgggggcagacggagttaacagagcactgtaaagtaaatgtcggcgtggccaaattattttttaaatctcgtgtgtaagtattaaacaaagcttctcataaagaaaagtagcacagactccacagagatagaaggccataaaagttgacttttttttttttttttttgagacggagtctccttctgttgcctaagctggagtgcagtggccccatctctgctcaccactacctccgcctcccagattcaagggattctcctgcctcagcttcccgagtagctggaaccacaggcacgtgccaccatgaacacctaatttttgtatttttagtagaggcggggtttcacttctgacctcgtgatctgcccgcctcggcctcccaaagtgctgggattacaggcgtgagccatcgggcgcagcaaaggctgaaattttacatcaaatttttgataacttagttctgttgtctttttcaacataaacagtcagcaagaatgagtctcacagggagttcggcagcaagggagaaatcatgttaaacttgatattatcagaatatcctgaattctttatgctttctttttagtgtattcacataaattatacaaaacttttttttaataaggcaggcctatcaaatatattttagtgtgatatatataggtatacacacacacacacacacacacacacataactttataggagagtaagaaaaagtatcgacatggctaaattttataaatttacccagcaaagaatggctccatgttttaaaaacaaaacagaaaagtgtctagatggtttttccatgtaaatgattggtcacaaccccatgaaacagagtaatcaacagaaaccaaataaacaggtacttttatagagctgtcctttcttctgcgtaaacgaaaggagggctgactccagcataggccttctgtggatgctttccacccagttttgaagcacagatgcaaatgtcctgctcctctagaaaggaagggttttacacggaaaggttattctagcagagaaggcatcacagtgcaaaagaaaaataacctaagcaataatgccaggacacagttcaagacgctctattttatcatttcaaaatgtggaagcagaataggcaccattctctgtaatctgagtggaggagtatatttctcttttaatcctattccccaatcagagatgggttttgtgattgtaactgaatctctgtccttaggactagactcagtccttgttcccatatttccaaaaaatcttatctgtaaaatatttccgagaaatgtaggtttcacgaagttttgtaaggacagcacagagaggactgcaatgcacatctgattacaaaacttcactaagattcctgttaaacgtctccttcattcctcctaaacgctctctcactggtaggctgtgacttcccacatctttccaacaatctccaacaattccctcgagtatctattataattcttccctatttggacacctatctcagaagaattcagtactcctttagcttctcagtgcttggcagaacgaaatttactagttggccaaacaaaaatattttatttctttcactatgtccctgcagggttctaaggtcatccctcagttcatgcaacagaaagagacaacacaaaactctttttttttgagagggagtctcgccctgttgcccaggctggagtgcagaggtgccatattggctcactgcaatctccacctccctggttcaagcgattctcctgcctcagcctcctgtgtagctgggactacaggtgcatgccaccacacccagctaattttttatatttttagtagagacagggtgggtctccaactcctggcctcatgtgatccgcctgcctcggcttcccaaagtcctgggatcaccggtgtgagccactgctcccagcccacaaaacttatttagtatttattttatttatttttggggagcaggatgttaccgtgcctttggctgaactttgagctgtatgcagagaggtctttccaccatggattctcactcacctccaaagtgagcttttgttaaatttcagtcactcgtcacaaaaaatgtcggcacaaactatctgcaacagagctgaaggcagaatttcctttaaattttggaacagatataacgcccttgaaaccaaaactgaagaaggaatatgaaaacaagcaatcaataaacttccatggacccagtgagttagtccagcctcataggaaatcttatttaaaaatgacagaatgaagcaacgatacatgttatctacaataattaaacccccccttcactatgtagtaatagtttcactttatccaaagtaaagaacactctttcccttcattggttggatatgaaactctcggcggggctcagtggctcacacctgtaatcccagcactttgggaggccaaggtgggcagatcacctgaggtcaggagttcgagaccagcctggccaacatggtgaaaccccgtctgtcctaaaaatacaaaaattagccgggtgtggtggcaggcgcctgtaatcccagctactctggggctgaggcaggagaatcacttgactctgggaggcggaggttgcagtgagccaagatcatgcctttgcactccagcctgggggacaagagtgagatttcatctcaaaaagcaaacaaacaaacaaacaaaaaagaaactaagtcccgagctcataaaaattataggtttaaaatttgatttagaggaaatgttccattctctcctcagatgcaactttcaggttggtagaacagttgaattgatgccaaaagtttggatcatctgtgtctgtagcaggaagatagcacgactgtctgagcccactgtttgtatttgcatcagtaaagatgttgacaattccacttaaattaaaagtcattccaagcaaaggctcacaattgtgttatcaaataaagaggaaaattatgtagagaaaaaagtgctaaaacttaacatccccttcctccagttggtgtgcttgctgtttctggcgtaaatgaaagtgcttttgtcttagtgggtaggtcaaattggcagtggatatgttactctgaggctctctgaaagtgtaaaaggcagacaggcccaatagttgcctcttggtataataataatagtaacgataataaccgtattattgaacttgtacactgggtattcactcaacaaatatttattatgtagttactaagtgccactcgtttttctgcattttagtgataaagtggaaaagagagacaaagtttttagctccatgaatcttataataaagaaatataaagcatgacaggtggtaataaaagccagaagaaaaataaaaggagataggaaatagtagatgttgctattgtatattctaaggtaaaagaaggtttcactgctatttgagcagagaactaaagaagtgagggagtgagacacattaagtaaaggcagttcaggtggaggaaatagcatgtcaaagaacctgtggggaaaccacgtctagcatgttgggagaacggcactgaggtcagcataggtgaattaaaatgaacagacaggagagtaaatgaggacacacagccttactttcagacattttagggactttgccttctcctgggagtaagatgaaaattcactggtttatattcagaagagtgacatgctttctctgactttcatttgtaaaaatttactctggatagtagaccacagaggggcaagaacataagcagttaaaaagtgattgtgttaattcaggtgagagagaatggtgacttggaccaggtggattgctgtagacagatagataattaccagtcttcagtatgtatttataaggtataagtaaaataatttcctgaaagattgaatgtgggttataagagaaggagaaaagtaaaagataactccaaggatttgggaccgagcaactggaaaatggagtatcatttattggggtggagttgatgaagggatagcaggtttaaggatggagtaaatcaggaatttgttttaggagatgttaatgttcagatgccagttagatacaagggtgaaagtttctagcaggcagctggattatatgtttagggcaaaagctctggtttgaagagctaaatttggaactcaccttatataagtaatatttaatactacataattggataagataatgaatacttactatgtactaggcactaaacttagcatttgcaatacttcaacgcatttaacattttccgggaagatatctcaattttacaaattgagtattgtgttaaaattgttagtgttagctaacaactatagttaactaaactcaactaactataacatagcttggccaagatcttgtctctggaattcgaaagatcctgtctaaacatcagtgcatttattccactccctaattttctctggcataatctggtccagaagagacacttaaaagtttttaaataatacaaggagataacaagagttctttactctactggagactatgtaaacaacacacagagaggtctactgatttgcctaaaattagtgtacagtgttagaaccaggaagctcatggctcttcccactcttcatagctggccaaagtcagctctctagaaagtttatttctttaagtcccatgctgcacattccttccctccactttcagactccattcactcttagaaagactattttccttgctttccagcacatcaaacagaactctcctgttgcagcctgttaccatgtgtagaagtcaggattttccaacactggtacactttgtggcagtagggccagatgttggggagataggaagtaattctttttttctctttttattatcatactttaagttctgggccacatgtgaagaaagtgcaggtttgttacataggtgtacacgtgccatggtggtttgctgcacccatcaaccggccatctacattaggtttttctcctaatgctatccctcccttagccccccaacccccagtaggccccagtgtgtgatgggcccctccctgtgtccatgtgttctcattgttcaactctcacttatgagtgaaaacctgcggtgtttggttttctgttcttgtgttagtttgctgaaaatgatggtttcgagcttcatccatgtccctgcaaaggacatgaactcatccttttttatggctgcatagtattccatggtgtatatgtgccacattttaaagaaaatgtgacagtctatcattgatagatagatagacataatatccagtctatcattgatgggcatttgtggtggttccaagtctttgctatttcaatattaaccttaaatgtaaacaggctaaatgtcccaattaaaagacacagactggcaaattggataaagagtcaaggctcctccgtgtgctgtattcagtatctcacatggagacccatctcacatgcaaagacacataggagacccacctcatgtgcaaagacacacataggctcaaaataaagggaaggaggaatatttaccaagcaaaaggaaagcagaaaaaagcaggggttgcaatcctagtcactgataaaacagactttaaaccaacaaagatcaaaagagacaaagaaggtcattacataatggtaaagggatcaatgcaacaggaagagctaactatcctaaatatatatgcacccaatacaggagcacccagattcataaagcacgttcttagagtcttacaaagaaacttagactcccacacaataatagtgggagactttaacaccccactgtcaatattagatcaacaagacagaaaattaacaacgatattcaggacttgaactcagctctgcaccaagcagatctaatagacatctacgggagtaattctttattggaagaactgctctgcacgttgttaagatgtttagtaatatccctggcttttacttactagatgccaatcgcactgcctcctccaattgtgggaaaatttgtctccagatattgccagataacttctagagggcaaaactatccttagttgaaaaccactggtacagcccatctcttacattcactgtattaagttcacccataaaagatggaaattgggaagaaaaagagaagtctagtcctcatatatttgtatcctatgacttgcttggtctccctaagaattggaggtttcctagcaattcactcagaagctggctatgagataagagtcggtaggactggctttgcaaagtacaagtcaaaaagagcccactgacaaaataagatgtggtaaagaagccagccaaaacccaccaaaaccaagatggtgaaaaaagctatctctaatcatccacactgctcattatatgctaattataatgcattaaggtgctaaaagacactcccaccagcgccatgacagtttacaaatgccatggcaacttctagaagctacccaatatggtctaaaagtgtgaggaaccttcagtcctgggaattctcctcctctttcccagaaaactaatgaatgttcctccccatgtttagcatatgagcaaggaataaccacgaaaatagccagctctgaagtagccactgttacttattcctctactttcctcataaacttgctttcactttacagtgttggctcggtcttgaatcccttcctgtgagaagccagtaactcatgtggcctcccaggctgaaccccagttttggggtttgccttgagacagctgtgttttcgttccttctccaagtaggtttggccaatgtacaaccagttctatagttatttggaacttagcaatattaggaacccatgagacctttatttaactgtcattcataggccgtaaagaaccaccatctccttgattccaaacagtagatgtgtaaatcagaagggatccaataaaatccaggtgatcaagcagtaattgtggaacgaatgggaattcaaataggagtggattttaaagtgttaggcacgtttctggattacatcgtaaacttcctcagcctaatatcaatgacttcagtccagaaaaggaattattcttcttggattaggtttttgccactgagctagcataaccatgattgaccacccaagagtcagtcacatttaaccctggagcactacacaaggtttgcagtaaagtacacacattctggaatattccaaaggggggatttacccagtaaatctgaacactatacttcaagttctttattctactcatttattttctgcctcaggaaacatgctatcaattttgagatctgttctaaagtgccaatagaagttgtcagtatcaatgtttatcatgatgcttctctttcacatgagatatttttcctctaataaaaattacatgctatataatgggtataattgcatatatctttcttgtttgtattttaaatattacagtacaagatatagggctgtaaaagatgtcaaaacataatcacactctggggaaaagaggatttgttgtatgcttgagagagcagcagatagagtcttcaattgcttactgcagatctgccatttctaataataataaaattgtagaggacgaagtcattgtgaaactacaaaaaaatgcttcaggaaggaccaattatcattcagctctaatgctactgctgactcatcacagggaaaatgcatcacaaccgttaataaccgataaatgtcatagatggtggagaaaatatttaaaaattcaatggtttcaacctaaatggctcatgaattatacatttaattaagaaaagccaaatgggaaggtttttaaacttccagtttggaaggttttttttttctttccccattgaaagatacacagattaagcacagcagtggctgatgctggaacaaaatagataaaagcccccagtgcaggctggctcttcagatgactgggaggagccagcccatggggagaagggagcagggcagggtgagaaatactatgacagcaaagacttgcagctttacatcttcaccaattcagagggcacaaaagggcacctggattgtactcccagagctgctgctagctctattcccctctgcttcttcacttgtaaaaatgaagtggttgggctggcaagtctcgcaaatccttgccatcccagacgttttatgaatgtataaactaagagacagccttttctccagactccaacacaccactcaaacgcaaatatacaaggtggtccaccattcaaaatccaggcgtttcccttcccagtgtgatgatgcagaggagactgagttttatcttttgttttgttttgtttttttgggttttttttttttttttgagacagagtctcgctctgtggcccaggctggagggcaggggcgcgatctcagctcactgcaaactccaactcccgggttcccgccattctcctgcctcagtctccccagcagctgggactacaggtgcccaacaccacgcccagctaatgttttgtgtttttggtagagacggggtttcaccgtgttagccaggatggtctcgatctcctgacctcgtgatccgcccgcctcggcctcccaaagtgctgggattgcaggcgtgagccaatgcgcccggcgagttttatcatttttatcaatgatttccaaagggtagctccagaccccccagtgtcattgtcacctaggagcttgttagcaatgcagatttcctggctcctccccagacttactgaatcacagagtctgagggtggagcccagcggcttgtggtttagcaagtctaccaaggggttctgatgcatggtgaagttttagaacctctgcttcagagaggcccatttaagagggaaaattcaagtttttatatctgttctactccctgctaatattagcaataagtactttacagtaatttcacatggcagtttaacttatttatctatgaagttcttaagaaattggacgcaggacaggaaatgttaatgggggagggaatggacagtgaggaacatttgtcttagaatgtgagtaaggttggttacttgtggagcttgggagttttgaaggaaggctaaaggtgaggaggacgagctaaggagaggacatgaacatagaaaaagaggatcaattgtaaagacattgaaaagtagaaagctattgttatgggaaaggggttcagatccggactccatgagagggttcttggatcttgtacaagaaagaattcagggcgtgcccatagattaaaatgaaagcaagtttattaggaaagtaaaggaataacagaatggctactccatagacatagcagccctgagggctgctggttttccatttttatggttatttcttaattatgtgcaaaataatcattatatacctcctggttttagaccatatagggtaactttctgatgctaccatggcatttataaattgtcgtggcgctaatgggagtgtagcagtgaggacagccagaggtcactctcattgttatcttggtgttggtgggttttagctggcttctttactgaatctgttttatcagtaaggtctttacgatctgtatcttgtgctgacctcctatctcatcctgtgacttaaaatgccttaactttctgcaaatacagcccagtaggtttcagcctcattttacacagcccgtattcaagatggagttgctctggttcaaaggcctctgacagtattattagggaaagagcaaagatctggcatctgaaggatctaggttcaagccctgctcctcccacatgttatgaatacaattttgggaaattacctttatactgttagttcttgcacccttagcctcataaagcagttgctggcatgatgaaataagtttttttctgaatttattattaatctttatgtaatcttccctatttctggattagattcttccagcagcttctaaatatctcactattaaagaaggacacaccacatgtaggaatagattggcaagttctagcagctaaggtaaaaatgaattcaccaggggagagaggaaaattacagtctcaggtcccaagattacaggttgaagaatacaaagatttcttgggcactagtggcaaactgtaatttttgttaagtgaaaggggtgacattggatttcagagagctaaagcgtatttctctccacaaataggcattgaataaggatccgtaagctgagacatggccctgggaatttgctcaagattgtctttgtttcacaaaaaggttcaaaagatgaggagtcaatgacaacaggggaatctgaactacattctttccttcctctttatattgaagaaaaatttactctctagatgactctgatttcaaacaaaaacctttgagcatctctttggtggagacagcaacaggcttagaagtgaggcagcaaaggacgtcagtaaagaaactgaagcaagagaccacatggtatgatgaaagactccaatagagacttgcaaaagaaaataaagactcaatacatgagaacagcacgagcatctcaaagcatttttcaaaaattaaaagcaaattgcatttatgcatacttgatccaaaagtatagactcttagggagatcaaaggaatgttgaggctgaaggaaaccattcgtagaagcttaggtttaacccccatccatcgtcaaaacaatttttttttgctacatcccgagtagtgttcatccatactctgcttgatcatgtctaatgataaagaactcactacctagtagatcatccactgctatccttctcaaatttagactgttcttcattatattaaatctaacagcattctgtcacctccagcagccacgagtcctacttttgccttctggacattgatagagagggttttatttaactttttatgcgtgtggcagctcttcaatgtaaacagacagctgtaatatgcttccagaatctttttttccagaggcaaaatcaaagttttatcactatgttttgtgactggcttttgctacattttattttttatctcttgataaacttgatatttttaattcctctttcaataatgggtgctccgaacaaaatatttcagtcaattgcatgcgtcatttggagggtgtcgaaaacacagatcccatgatacctggctcagatagaataaataaaactaaattgctaagaattgagttagctatttgtattttaacaagcttctttagtgattctaatgtacatcaggtgtgggaatcagtgcctgcataaaacataaaacatccatttgaacggttcagagtaagaataagaaatgttatccaccctgtttttacaagttgcagctcattctagtgtttagcctttctgacactcttcttatcctgttgattctttcttccatttacacaaaaaatgcatagcaatttaaaattataatacgacagaaacacattacaaagagagtaaaagccttttgtatttccctccactcactctgagaaaaccactgtatacatctccaggtttttaaatgtaagaatttgcataaacatatcacacacacacacacacaaagttcccacactcataacatgctttttacctaacaatgctgcttaggttttttttcccacatgacactacttttatggtttaatgacactttttgcattttctcacttcatgcgcaagtagcatttactgtgctcctgctgttcctggtctcatctttactttatttcttctccattcctgggaacgatatcagggttctgtctgcagagacaaatttctttttactgacatcatttataaattgttgtgagaaattaattattttgctcctccccactattaatagattaactttttccttctttctctttccttccttccacattttctttctccttttttcctttatttcttccttcctaaaatctcattcctttaagtatggttcatgcttcatgcattttttttttctcgatggaagggatgacaaaatgacaatattccctcattcccattttcaagagtttgtctctatagatcagatttaagtccaaaatagctgtcagtttgttttgccaccttttacttttgggaatttaaatttagtaaggttagtgaagaatgtttcaggtggtctcttcccagctgaggaagcctaccggaacatatcagaaataattagcttcttttgtctctgccatgtcttgcttccgtgccagtttttaatgtaagtacagttggcaaatagcaactcagctctctgtttggacaagaggctccaagatgcataaactactcccctgtgaactataattcaaaagtgtatgagggtccatccaactgaagactttttttgagttagttgcagtatattccccttctccaccctgagtacctatatactccacctattttggggatctcctttggaccagctatattcttctacttccctagacatagttctactctacctagtttccgcagtacacctaatgtcttagcttcaggaagaattatattcaccaagctttaatacatatgaatatttgcttttgctcaaagatttctggctaaaacgaaagaaattgacagcacatgatttttgtgaggttatgggacaactggaactctcaaatattgctggtggaagtataaactgatacaaccactttaaaaaattcttttgtcatttcttataaagttacacttacatctacattatggcttactcctaggaatctaaccaagaaaaataaaaatgtatacagacagtcttagacaaggatgcttatttccacctaatacataatgacctcaatctggaaataatccaaatgctcatcaacaggaaggtgtccaatcaaattatggtatattcataaaatgaaatactatccacaatataatggaagaaagggcttatagtcatgaaaacaataggtgaaccttaaaattatgttaaatgaaagaattcagacataaaatagtacattctgtttgttttatgatgacatacaaatgacagcagaaataatctatgatgatagaaatccagtagtggttgcagcagtagaaaaaaacaggggaggatttctgaagacctggaaatcttcctcattttacttggggaaggatggttacagggggtatataatggtcacaagtgattaaacggaacacaagttctgtgcattttaacatatgctcattatgtcatttatacagttacccacaagatttccagagatggactgattgatgttcagtaaaaacaatgtgtgccctgtttcatgtttatgctcttgatagttactcggagaaatgcttgtcgactcctccgtcacttggatagctctagtttatcgtgccggtttcaaaatggaattccttcttagaagtcttttctgatgacacatcattctaggctccttctctgggctccctataatgcctttgtcaaagcatatgttatccttcattgagattactcacattattggcaattagcagtaactggtgtgacctttatagggcacaggttttgtttggttttacactaagacctaaaactgtcacagaatagctgcttaaaattatgtaataatcaggccagtgcagtggctcatgcctgtaatcctagcactttgggaggctaaggcaggagaatgacttgagctcaggagttggagaccagctggggcaacatagtgagaccccatctctttaaaaataaaaaagaaattatgtaatgatcaaatgagtgaacttcaaggtctgtggtagacttcttgaactgaaatttttaagttaaatttttaacaagtacctgtaagtatgtttaattcttctgataatgcactgagaaacactgctttgaagcagcataagtttttcctaaggaattcagtgtacatttggaacagttattattttatacgtcttatggtatttcttaataaactcatccacttatttccataacatcctattgttatatccttaatcccaaaaagtcaatgatggggaaagtgcccacataatttatcgtccaatctgagctatatttcaatataagggaatattacaattacaccagatgacagctatcaactgagcaaatagaggcacaattttctcctaattatggggaagtaagacaaagaattttcagatatgaatgaatgcagtaaggacagtatggttttgttttgttttgttttgtttcttgtttttcagatttatcttatgcatggaccttcaatgataaccccttatacgtccaagaggacaataggcgatttgtatctcaagagacgggaaacttgtacattgccaaagtggaaccatcagatgtgggcaactacacttgctttataactaacaaagaggcccagagaagtgttcaaggtccacccactccattagtgcagcgcactgatggtaagataatgagttatcttgggaatgtactttatctttggcccttaaagcctgggaagattcgtaaagctttctgcttccttcttgtttggtggagccaaattacgagtttaggttcaattcacaaatatgtaaaccagaaatataacagaaaattatctaattcacccacatggtgcagtagacatggttctgggtataccaagccatctcctttctggcattgaaacagcttgtcttttttttgcttaaagactgttttgtaaaaacaaaaacgatgttccggggagttggcgtgtgtgtatgtgtgcacgtgtgggtgctgccaaacatataactgaatcaatatatttttaatgaacatatgttgcagctactttttaatggccccttttttccatatttgccctttttttgttgttcaccctttatttacgtggctggcaaaatggagggaaaagttcatatccaaggaaagcaaagcaaaccaacattaattatgagcattccagagaagaatgaaacacaagatttatactaattatattcctccaaggaacataattcacactagtctctgacgagctttgtagcttagtcaagtcatggctggtacaagatttagagagccagaaagtttaaggaagtcattgaagtggagaaattctctagttgtttttttaattaaatgttcacagtgggattcatacaggtagaaaatttgttggtgcattttatgattgtattcaggacttgaaatgcaatacctcgtggagtttttctcccctctgaagagttgaagaaaagcaagaatataatgctaatgaagcataacagaattgtggaacaagtcccatagaaggagttcttataatagagcttttataatcactaaccacccaaatgtatttgcaaggtcttcactaagatttcagcaaccattagacttattcctaagtccaatttatctccttcaatgaatactactatttatgaccagaagaattcatgagccaacaatatacttggagattctaccatgtttttcctttttttgtttcctgtctactctgagtttctgcttcttgccttcttaattccttccttcttctatcccctctattcccttgaatacatttacaggaaaaatagagcagaagtattatatataatataaaaatcaaacctattttaaaagtgagcaggtaggaaatatcagatgtcaagaaagtgaaaaagaataaaacctaccaacttagttgaatgaagtagtactcactaccttctcaccataacctctttgaatgtttataatgatcaagtcttaaaaattaagtatttttatttcatatatattttgtaatttttactttttctgcaattatattgaccaccaacaatgtatttattttagaaatgtattactctgtcgtttggtacatagattaaaaatgatcaaagtatttaaataatcttgagatgtcactgattaaattaattaagttaatgagaatagcctacagatatatttctgttacaactcctctggtaggcagtgtatttacaataggttataccatcatcttatcttggcacatatccccaattccttggattgaaagttttaaaacttaaaacaaattcgtataggtatacagcaaacttagcggcaaaaccttattgtactaatatgtgaatatttacatttttatctcaattaatgtgatgcctttatatgttctgctgcagaactactgttattttggactaagacctactgcagtggacttctaccagtgttagctgaaaacatcccgttgttgttgtttttttctttttttttttttttattaatcagatctggctctctgagttccctgaaaggtagataaatgtggatgtcactagaaaagtgtcttttttgaaaacacagaagcattttagaatctatatgtatccaattcttaactgaaaaccctaactcttattaagaagaaataatcaggttttggttaatgaagcatttacttcatagaaaacttctattctccagaaatgctgctagctcttttgatatttaacaggtgtgatgggggaatatgaaccaaagattgaagtgcgttttcctgaaactatacaagctgcaaaggattcatctgtaaaactggaatgttttgcccttggaaagtaaggtttttgtttttgtttttgttttcctggttgcattaatttttttttattaaaaacctttttgttattcatatattgctctaaggtaaattaccaagtagatttcaaatgctgggcaacagtggaactttctgatttgaatttaaacaaacatgtctaatactgagacaatgaccaggcctgtaactgaaaatgatcagggctgcaattcttccctacaggtgctgatatttccttagtttaagcataatgagacccatttaggcagcacattgcaagggaataagtgcactcgtataagatgatgggcaagtcactaaaccttccacatatccttcactccatcttgtcctacatccagaaatacattgcctggagtatttccttgcttaattaaccaacaattctgataaataaaaaaccactgcttgtttccaaaataagactaattaaagtccattgttcatagtgggtaattagaattgagcccaaccttccctgatagtggaggcattttgttttactcagataagtatttattaggaacaggtttggaatacttttaagccaggaaaatacctacatttttgcatgggatatctagaacccctctttgctttttggaggtatacaaatttcatttttgtgcctataaacaccagaaaaaaagaaggagacagatagactagactgtcattttcaaatgttaatatgcatgtgagttacctggggacatggttaaattcatattctgactctagaggtctagggtgatgtttgattcctccatttctaaaaagctcccatatattagtcatgcttcttgtaaacagaacatactttgaatagtaaaagacttgactgactcagaggtaagctcggagggcttacctctaaatccaaagtctattcctaatgtggccctcacatttagaaatagtgacttagtctccaaattctagaaaacatccttaaatgtctcagtcatattattaagttaaacatactcagcaatccaaataatggtggttactaaatcttagtttgttttctatagatggagttttgcatatctttgaatgaaatttctcagaatagtcatttctcatggatttaagagaccgtattttattttcatagagtatgggtctcatagcatttatcaaataaataattattgattgattaaatgattcttaagaaagtgacaaataggggctttacatcagtttttaattgtctgccttttaagacataatgaactttcaccattttcaggctttttcagaagttaaggtttataaaaatattaaatgtcatcaaattctttgataattagataattaattttaaaagaaaaccaatgaaagagagtatctgaaaagaatattaatagcttatttaatcatatttggcatcaggaaatatagattcctgaaattaaaaaatggtcttccacaataaaataattgaaaatgttgaggctatttctcaagaatctaatgaaaataatttcatttgctaagcacctataactaagcatttatgatacaatatatataattgtcataatcttgcagggcaagttacgttttcattacatatgagaaactgaagctcagattggagaagtaacctgttcaatcttatgtttctattcagaggaagcaagcaattcaaacccaggcccacctgattttaaattctgaatttaggaacttctaagtaaatagtaagagaactgcttttgaaatcctgggagacagattcaattcccaattttctgaagagttatttgattgttagcaaacgtgcttataatctctatgaattaccatattttcatctgaaaggagttatgatgattccaccttgtatgtttgttgtgaagattagaatggataatacatgttaaaacattaagacttggcatttatgtaataaatgctcactgaattattctaaaaccaaaatccaaatttcattctacttttttttttgagacggagtcttgctctgttgctcaggctggagtgcagtggcttgatctcagctcactgcaagctctgccacccgggttcccgccattctcctgcctcagcctcccaagtagctgggactacaggtgcccgccaccacgctaagctaattgtaatttttttttggtatttttagtagagatggggtttcagcacgttagccaggatggtctcgatctgctgacctcgtgatccgcccgactcagccttcctaagtgctgggatgacaggcgtgagccactgcgccgaccgcattctgcttttatataagcaatgtttgaattagtgaggatgcccaagggagagtaggtgtctcagagggggtatgaattctcatctttcccagcccagtcctgttctctctgtctcaggattgatgacagtataagagagaaaggagcaattagggtcagttcaggaaggaaggaaggaaggaaggaaggaaggaaggaaggaaggaaaaagaaaagaaagagaaagaaagaaagaaagataaagaaagagagagaaagaaagagaaagaaaaagaaagaaagaaagaaagaaagaaagaaagaaagaaagaaagaaagagagaaagaaaggaagaaaaggagagataacatgatcaatatagtctttgaactgctcacataccagtttcttaaatttatttatttttatattattcaaacctatagaaaagttgaaagagtaacacacggacatcatatactctatctgaattgaccaagtgtaaacctgtgctacattccctttctctctctctctccccctctctctctttctttctccacacacaaatatatttaaccagatacatggtaagatctaatcaggaaaaatgaagcttgggatatatgaggtatgtggaataatttaaaaataaataaagcagtgtcttattttctattaactccatggtgatggaaataatcaacgtattattaaattgcaaaaggtaaaatttataatacaggagtccctaaacttttttttttttttttttttttttttttttgagacggagtctaactctgtcgcccaggctggagtgcaatggcacgatctcggctcactgcaacctccgcgtccccggttcaagtgattctcctgcctcagcctccagagtagctggaattacaggcacctgccaccacacccagctaatttttgtatttatagtagaggcggagtttcactgtgttggccaggcttgtctctaactcctgacctcctgctccacccatcttggcctcccaaagtgctggtattacaagcgtgagccactgtgcccggctcctaaacttttgacaaaaattaaactagcaatatttgacccagaaaaatttgagttggaaaattaatagtttaaaaaactctcaaaatgtaaaatctgatgtgtatgtacaaaagaaaccccctgataaataaatcatgttggttaagtttatgcaggaaataaccgttgaacatgaaataatgttaaatgggaataggaaaataatataaattaccaaaccatacctcatagaaaattgtcaaggaaattcttgatttaatagagtacactccctaaattgttatctaacaaaattaatcaatgttgagattatgtttattaaatgaaggcattaatatagaattgaaataccttgtggtaaaaatggaaagtctgaagcatctgctcggtcaaagcggtagcgttaagatgccctgtataacaatcttacattttgtgtagttggagtgcagatacatttctcatttcttcaaaacaacgaaatgtatgtgaaaatactttgactactttggaaaacttacaaatgtgagttactaccaaaaagaattttatatatgcttgccaatagttttcagaaaacaaattaaattatctttgacacattgcaaacatactgaaaatgcctttgagtccattataaattaaggtatttagcaaatgccatattgtcttctaaatatataaaattaacaagcataaaaggcgacacactcactagaagattaattatgttataggtatataattaacaatctgaaaataaaaagtcaaacgtcttatcttcaaaattataaatctgtatttgtaagtttgttgccaagtgtttttataaagtctattgtttattataaatcatattctctaacatctcttcataaaaatattgctgtgcagcatttggttttagtcatttttttccccaaatgtggggactcccttttactaatccttctaaatcttcctgtctactttgtgatgtactttactcttttgtaagatgttgcataacctcaaaactgagaaaagctagttgacttgaggaataaaatcaaatatttttttcttattacattactattcattgactgctatttaagctatagactacacatttattagactaagatgtatatattttaatagatgggggaaagagagagagaagagggaggaaggaaatcaataggtgggtagaaggaaaaagaaatgaaaatatagaaagaccagctccagtgccagatcttattacattttttatttttaggtcataagagagcttctgatataaaaattggcttttgttaaatgtttgtttaatgtaccccatacatgtgctcacataactaggaaatatcaccccctatcactgggaatattttttctcttgaggttgtagattatttttgttatttatttatcttgctttgttttctctgaaattcctgagtctatggtttggtgtttgtcattatttttgaaaactattcaggcatgattacttcaaacatttatttgtttgtttttttctccttttagtatttgttttacattatcttttatgccatttgtaatctcccttctgtccaagttcttaatctttttaaaatttttatttttatctttgcatctcagtttgggaggttctattgatactgcttgtcattcatttacttccccccttagctatgttcagtctactggtgagcccatcaaagccatccctcatttgtgttataacttattttatttccagcatttccttttgatcctttcttagagttttcttctctgtgcttacattatccatttgttcttgtatgctgttcacttttttattatagcacttaatatattaattatagtaattcaaaattacagtctgataactgttcaattttaaatcctcagcctgatagtcctaaaagtttcattgtatttgagtctagttatcatggttgttttgtctcttcagactgttttttagcaggctttgcacttttttttgaatcctggtcattattatatcagattaaaggaacttcaataactaaacttttagcgtgaggttttatgtttttctagctagggttagactgtaattactgttggctctagctgtggtatcagaggttaaattttagctagtacctttgcttttatctccactcttgcccttgggtttccctagagactctttcctaaatagcatctaaagcttgccgttatttcagctgtaattctctgcactgtaattatataggagccctaaataagtcctcgcttgctaattctatcatctcagttatttgtgggtctgtttctattggctgctttttctcctagtcacagttctcatttttttgcttgtttggatatctagtaatttaagattgaatagtagacaccataaatgtcttgttgttgaatgctaaattgtggtgtatttattaaaaagctttttgaactttattttgataggcagttgttatactactgtgaatcctcgagttttctgtggttattaaggctggtttactactaaaatgaaatccccaactgaatgcttcaaatgttcaccaagtttttcttctctggcatagtggagctctcatgtcttccaggcctatttgagctctgaaaattattctttgcccagcctcatgtgacactcctatgcagatcttcagagcacattatttgagtaatgccattctttctaacactgtgctctgcaattccagccacttcagcctctccaaatcttatctttgtcttctcagcttagtgacacagtactttactacttatgtctcccctacctactccctgatctggatggaaagcatctctacacagaaaataagggctaccaaaaccttacttcatttatttcccctctttcaggatcatacttttgtgttgccaattgttcaagttccagaaagaggttttttttttccatatatttgtctagtttttcactgtttttgaaatactaattacggaggtaaatacagtgaggcttagataaattaagtgacttaaccaatgtaagttgcataagttgcatatctgggattcaaatctacatctcatagattctgacttcaaaactcatgcttataacactttcatatttatattgaattaacttctaagtatctgacttacttaatcctccatgtgcagatgtagtatgaccctcaattatgtaaatattttacaagaaaaaggcttgaaagaattcagcaaaatgttaaaaaatgctttatctagggaatggaattatagatatatttcccatttatattatctataataactaatattccagcaacaagtaagttttaattttatatattaaaaataacccttggccgggcgcagtggctcacgcctgtaatcccagcactttgggaggccgaggtgggtggatcacgaggtcaggagttcaagaccagcctggccaagaaggtgaaacccccttatctacaaaaaatacaaaaaattagccgggtgcagtggcagacacctgtaatcccagctcgggaggctgaggcaggagaattgcttgaactcagagggtggaagttgcagtgagctgagatcgtgctgctgcactccagcctaaagacagaatgagactctgtcaaaaaaaaaaaaaaaaacaaaattcaaaagataaacttgtaaaaattcaagctgtgttttaatgagaagaaaaaagtgttttcaaaaacatcaaaaatcaggtttatacaccttattattttatagatgatgatggcaatgtacaccatttctaaaagtctggtatacctgattaggtagcactcagaaaacatagcttctgtcacggataccatcatgcagacagaatgtataaaaagtgaggtctagagaagaacaggtgaagtgtttactcatataatctaacaatcttaaaccactataagctagtgtgagtatagaataattaagacaaagcttcaagtaattgtcttaactttaattgctatgactttggggatatgtaactgacttcctttgttggagtttcagagctgacatgatcacagctttcaactctcagctttgtctcatttgtttaacatggtggactcttaattatgaaagctgcaaattaattgtattgtgaaataccctgagaagctccttgtataggtgctatgcaaatgtagtatgattgactgatagatatgtacgtctcctttgaaaaaaatatgggctcttgctgagtgaagaaattaaactgatatcccccataactctattctactgcttttataaacaaccaaacatattttcctttttttaaaaaaatcttaatttagtaccttttctgtcagtgttctggaatgtaaataacattagtagcagcactgaacgttcctgtgtgttctgaagccttcacacagaggactatatttatgtgtacatgtataacttatttttttttctaatttatgaagctaaagatacccagcttggctattaatgtcaagcaacaaatctgaagtctcaccatgatgttgttaggtgttccagaattttcaggtgacagaggagctatttcttatagtgtttgcttttcgtcttactaatgtggacatcattgcagattatactgcagaaagatttttcaagtcacttaagatgaaaataacatttttaaatcaagctaggcacactgaaatttttcagttccttagcgattatttttggtttattgaattaatcactcaggtatcttaatgattttgaaactggatgtctaaaaaattgtttaccttttgtttcccctcattgagttgagcagatagagaacagaatctcttcctaggcatagtttaccccattcactccagaaatgtatactgaaacctaatctttagattcttgctaatggctttttctataacacgatattatcaataacttttttttaacatgacgtggtattgcttggcataaaataatcaagtaaactctatagaacactcacctctgttgaccatgctcacaaatctgagaactaaaaaatcttcaagccaattattcagaaattgaaagataacattaaacccactacactctcacataaacaagcgctcaacctagcaataaataatttatcagtgaatttactagcatttgaaggcaaatggtatgctgaaaagtgtggactttaagttcaaatagagcaggattggagtcttaacttcacttgtcaatagctggatgactttggtcagttttcttatctgtataaggaaggcaaaaatgatagagagagaataaatagatacagcagaatgtttgtaaggactggaaatactattaagctcacttactaaatttcctgacccataataggcattaaatagtaactactttattaatcctgggaattgtcaaagctgctttgactgaggaggtaaaaaggaacatgtaagaaggagcgaagtggtttctgtattatatttttgtgttaagggacttccccagaagaatagatttatcattttaaattctgttcaatctttctaagagttactgacgtttcctcactcactcatttgacaaattgagcacaaattattcattcacttagcaaatatgtattgaatacctcattccatcattaattccttcatttcttcatttaggtagtcagtcaggagggattctccaaaggacagacacttggccctgggagataaagaagattacataaaggccccggggaggttgcaggctaatgaaaataagattgatgtaacaatgtgcaatcacacattctcttgggatcagctctttccttccagactttcagtgaaggaagagtcaaggatcctcactttgggagctttactgattatctttttcccacgctgccctttatcaaatagagactggagagggtcactgtcatttctttagcagagctaattttaggctattatttaagggtttcttgtatttctgagaaatggaaaattatttcttccttttttcccctctgttcataaatacattttttaactaatggattttaaagaatagttttagaacagaaatattgaacggatagtacagagaggtccaatataacccccccacacacaatttcccttgttactaacatcttacgttattatgatgcatttgttacaattaaccagccaatactgatgtctgattattataaagtccatattttattcaaatttatttggtatttatgcccttctattccaagattccatccagaataccatattacatcgagttttcttgtctcattagtcttctcttgtctgtagcagaatctcagacatttcttgtgtttgatgtccctgacagttttgaggggtggtggtcagtttattgtaggctgcccctctgttagaatgtgtctgtatttgtcataattagactggggttacaagttttggagaggaagaacataaaggtaaggaacaattttcattacatatcaaggttaactttatcataatgatttatgacagatgatgctggccttgattacctggctgaaatactttttatcagggttctccactgtaaaattactcttttctcccactccatactgactctttggaaatgggtgactatgtgtagtccacatttgatgaatagagtgttgtgcttcaccttctgcagaataatgagactatagaattcttctacctgtgaaatgtgtcacttcttcctcatttattaatatttaataatttacttctgtcagtactgactcacatataattattttagactttgggttgtaattctgtgctactttgtttattttgctgctcaaattgttttagcttttgccattgggagacttttaagttggatcttgtgccctttgttatgcactcatcaatgtatggggtgttttgtgtgtgtgtgtgtgtgtgtgtgtgtgtgtgtgtgcacctgttagcactttcttatttactggcattaaagatgttccaggttcatcttgtatgtttcatgccctagtcatagaagcagtcatgtctccaaggatagggtcttgttattgaagaatgacatcagaaaccaatatctgggtactaggtgtgcttgttgctgctggagtgtcatttatttaggcgctctcagatgacagagaaaagaagtatgtgtgtctatactaattattatgtacatatatctataagtatttctacatacagctatttgtattatgttaaattaaacatatgatcttgttgttgtctccgactctaatccattaccacatggatcactctgctctcctccacttactgatcagtacctttccactccacacagtgctgtcccattttgcaataccaccagtaataaattagaattttgatttctcttaatctacaccagcatttgatattgtgtgtgtttttgttttgttttgttttttagccattcttacaggtgtatagtggtatttccttgttgttttaattggtaattctctaacggcaaaggatgtgaacatcttttaatgtgattatttgctatctatttatcttctttagtaagacgtctgcttatatcttttctacatttttaattggtatgtttattttcttattgatgagctttaagaattctttgcatattttgaacataagccttttatcagatatgcgttttgccaatattttctcccagtctgtgacttgtctttgcatttccttaacaatgtccttaacaaagcacaaggtttttattttaatgatgtgcaggttatcaattttttttccaataaacggtgtttttggcattaaatacaaaaactcatcactatatccaaggttacctagatattctcctctgtcatcttctagagctattatagctttatgttttgcattttcattgatggtccattttgcattaatttttgtgaaagatatgacttctgggtctattcattttataacatatggacttccaatcgttccagtatctgttaaaaagacaaatttttctccactgtattgcgtttgctcctttgtcaaagatatgctgactgtatttgtataggtctattaccgggatctcttttgttccattgctctgtctattcttttgccattaccacattgcctcaattactgtagctttacggtaaatcctgaagtcaggtaatgtcagtactccaactttattcttcttcttcagcattgtgttggctattttgttttgttttgctttccttgtctttccatacaaacttagaatcattttgtctatatccatgaaatagcaattggggttttgattgggattgacttaaatctattgatcaagttgggaagacttgacacactgacagtgttgagtcttttcatccatgaacacagactatttctccgcttatttcgatctcttttaattgattttatgagattgtatagttttctgcatgtaaattctgaaatactattttatataaaccctagaatttcatgttttagtgctaatataaatggcattgtatgttaattgtggaattcaaattccatttgttaactactggtataaacaaaagttaactgactttgatatattaacattgtatcttgttgccttgctataagcacttattagtgctggagttattttttgttaattcttggggatttttcattgctgcctgggaacaagtattatttccttcttttcaatctatatacattttttttgccttttcttgtattattgcaccagctaggatttccaatacaatgatgacagtgagtgataagagtaaacatgcttgcctttttccgctatccaaaatgaaagcatccaatttctcaccattaagtaggatgctagtgctacattttttggcagacatttttatcaagttggggagcttcctctccattcctagttcattgagaatttttattttggataggtgttgcatttttccaaatgctttttttggcaccagttgatatgatcatgtgatttttcttctattcattagtggatttcatgaattaattttctaatattgaaccatcagtcctgcatacccaagacaagtcctattttgttgtggtgcataagtctttttaattgttgctggacacaatttgctaatatttgttgaggatttttccatttgtattaatgaaagatactggtctgcagttttactttcttgaaatgtctttatcttattttggcattatggtaatttggcctcatagagtgaatttaaaaatattctctctgcttccattttctagaagagattatgtacataaagaagaaatgtatgtacatcaagaaaaaatagaggccaggcgcagtggctcatgcctgtaatcccaggactttgggaggctgaggcgggcagatcgcctgaggtcaggagtttgagactagcctgcccaatatggagaaaccccatctctactaaaaatacaaaatcagctgggtgtggtggtgcacacctgtaatcccagctactcaggtggctgaagcaggagaatcgcttgaacccgggaggcagaagttgctgtgagctgagattgtgccattgcagttcccaaaggacaaaaacgagcaggagaaccagagttctagaagtgaatttgaaatgagagctgagggcaggcaaggaaacaagcaaggagattaggaagagttacttcctttgcttaaagcaaaacaaatacatacttaggtttttatatatacataggtgtatgtatatataaaatgtctttatatatacataggtgtatatataaaatgtctttatatatataggtgttgtatatataaaatgtctttatatgtacatatatgtgtatatatacacatatatatttgtatatgtgtatatatacatacatatttatatatacatatacgtatatgtacatataaaatgtatatatacatatatgtacatataaaatgtctttatatgtacatatatgtacatataaaatgtctttatatgtacatatatgtacatataaaatgtctttatatgtacatatatgtacatataaaatgtctttatatgtacatatatgtacatataaaatgtctttatatgtacatatatgtacatataaaatgtctttatatgtacatatatgtacatataaatgtctatgtgtatataaaatatctttatatacacatatatgtatatataaagtttgaaaaagtcagatatactcatttaagaaaattctgaaaatataggcaagaaaaaaggagacaataaaatcctttttatacttaatttctcccccaaaggataactactcttatttcagtatacatatatccttcctgtctttattctacttttaacataattagtataatacactgcatatttgtttgtaaatttttttaattcttaaaaatataccatgaacatatatgcaagtcattaaacagtcctctgcaccctcatttgtaatgacaatgagatatttcaatatatatttatagccaatctcctattggtggacatttagtttccatcaattttgtttccaattttttgtaatcatgaataataatgtaatgaatattcttgtggctgtattttgcttacgttcatgtaaacttcctaagtatatttttagaaaattaggattattggtaaatggaacactatgtaaaatactacgatttctaaatatcttgccagtttctcaagaaagattatagaggggccactgtcaaagaccagggacctgccctaaaagttggcctcttttaatcttaaagacacactccgaatctaatgtcaaacattcctttccatatagtttttgaaaatttttttttcaaggagcatagagtggattgttacagtgctgtttctaaaattaaactaatttaaaggttcttaaaaatcatccaagaagaatatatatatatgtatatgtatatttctggaagcaactcatcatcctttccatcccagtctatcaccacctctctcaggagacccacagttcttacttttaagtaattggcagtttacagtagagaaggatttcaaatctaagttggaactgggctcaggaaaaataataagttgtttgtttcctattttccagctgaccttggagcccatctctaagcttctactcaaatttggaggcatctcaatatgttttaaaaagatagtctccgtgatttcaccttttgcctcttatacaaaaaaaaaaaaaaaagcatctattgactggttgcaagacacattagttccttaggtgaagaatgtattgctaagcacatgttatacaccctaataaggtttgctctcattttgtacctggttaattcatgcagggggagcaaagcatggtgatttagagctccatgtctgtggaaagacagactttggttcaaatccttttttttttttttttaatttactgtatgatgttgggcatattacccaaactatcctaatcccaatttgttcatctacaaaatgtgaacaactgtaatcgtatgtttgatagtgctatagcatgatttaaagaaaatacttagcatggagctaacatataatatgtgctcaattcatgttaaataatgataaaatgataaactgttaatatgccatttcagtctctttacttctttatatgaaaatttatgattccaaactgagacaagatcaaacggaataaatttgaggtaacacaaggcccacctacctataccaaattatcattttctctcctaagagcagcagaggtatttatcgaggcttagtattatttattaataaaaaattatagacaagctgttagtgaactgctaagtgcagtatcatattcagctctaccacatcttgaaatagtgggcttcaattcatgtttcatgtgcagattagtattcatattatttacattaaaaggagtagaaattggtagtaaaattcttagagaatctttggacaatggtcctttcatgtctctgttcataatcttggtattaaggcaatttactaagccttatttatgcttcaaacattgtattttagaatgtactctcatggatatttcctcatttgctcttcctgtgtactcattcttatttctagttaatgtaaagagaacactgagtctcagagaggttaggtaacttgtattcagctctataaaatttgcctgcgtccttttttttcccccaactgcaggtgccattctgttaccactgctattataaacaaaccatttgtggcttttcaaagatgtcctccccaagggaaagctgatataggcatcatcttattcccattgggctgccatcacaaaatactgtagacttgtaaacaacaggaattggcttgtgaacaacagaaatttgttgttcacaagttctggaggctgggaagtccatgatcaaggcaacagcagacttagtgtttggtgagatgtctggtgagggctgatctctggttcatctagctgtgtcctcgcatggtggaagagaaaaacaagctccctccgatctattttataagaacactaatcccactatgaaggctctatcttcatgtcatagtcccacctcctaatactatcaccttaggggttaggtttccaacctataaatttggggaggacacaaacattcatttcctagtagggactgactgcaaggacagaatcatgactccatttacaccactcagagtaaaataaaaatgttttctctttttccgtaacagtgagattgcttttctacagaactcatgaatttatccatattgtattgccataggacaatcttacattccaagctctttgtatgaatatttcaaattggggaaatgaaagcagctagctgaacagtctgaaaatgtagcaaaggcattctttgctggttttgttattctgcttcactctctttgattaaaactggcccactgacaggatttcctgaaatgaggttcaagttaataatcccaaatacaagcatcttaagaaactcattctctgtaccagtctttagttaaaaacttagtatggcttggatttaagctgtagataatgaggtttaagaaatccaggggagaaatacaagctttctcaaatagcactagtaataaaaattctatttatgggctaaaggtatagaattgaggcacagtgtgcttctactagtgtatgtagagctttaatttaactcgaaatcaggatgaactaggtcagatggttaagaagtgtattctctgtcttcagataaaattaataggatgctccctttgtaaaagcataaagacatgacaggatgaagtaaaagtccatatttatggcaatgcgtattccagaagcacgaaaccacagcagaggaaaagaaaaaagaaaaactttgcttttatcatctagtagtatttcacaattgtgaagaatcacatttcaggcaaccttcatttagaaaataggaacaaaataagaaaaggcttttgcaatgctccttttgaaatacaaggttcaagaatccctcatctatggtctgaggaatctttgaataagagaattgcttcatattggttttctttattgagatttgcatccaagctcaatttttgtaaaaagagagaggggagaagtgtaaaattggagtttaaagggaaatgttgccagaaacgactgatatctgtagttaaaatgataatggcaccatttgttttgactctgtaacatcagtttcaagagatttaacgataatctccattctgaagaccccttcaaagatccaccttcctccatggtgttctttatctgattaatatattaacttttcattttaaagagatcatttatcttgaagcaaaacgaactcctagtaaatactgcattgctagtatcaacatggacaaactacacagagtctaaaaagaatgctgaagccacagtaggagaaacagtctattagtgcttttaatttagtgggtggcaactcaaaggaattagaaggtagatcacaataaattagcgtgctctggaactctaagtggaggagaactggcaggtaataatttagttgaaattacccatctaaaggtgagtatcattccaaaaagttaattagcattgttagcagctgcaagctgggtatttagctcagatggcatatggaagccatctgtcacaatgcctggtacatagtaagcactcagttaatgattattaatattattttaaaatatctaattttcctataccatttccttcagtttggagagcactgtctgattgctttcttccctactgaaatggtactagatgattaaccacgttaaagaaaaaggtcctccacacccacacatccatgtctcacctgaaagattcctgcccttgtcatgatgaagtgaacatgactactatgatcaaggttgtatctccatagcagctaggacattaaatggtgagatgcaggaaatttacacacactcatgcttgtgtagccgtttcattcatagtgtggagatctgatttcagtgtataaatgattcgtaaatcagtttgtatcaaatgcgtagtcatatggatcccttaacagagagtaaaagacaaatacatgtgaattaggattcctggttttgaaatgatagtaatcacattataataatcttaaaatatttttattaattgaacactcaaacatattgtttaataggtgctaggcagtatggtaagcatgtgacatgaattatcttaatcctcaaaataagcctatgaattgtgtactattactaattaccatgctataaatgagaggcgtattaatctattcttgcactgctataaagaaataacagggactgggcaatttataaagaaaagaggtttaattggctcacagttctgcaggctgtacaggaagcataacagcttctgcttctggggaggcctcaggaaacttacaatcatggtagaaagtgaaggggaagcaggcatgtcctacatggctggagcagaaggaagagagagagagggaaggtgctacacacctttaaacaaccatatctcacaataactcactcactatcatgagaacagcaccacggagatagtgctaaaccattaatgaatgatccacccccataatccagtcacctcccaccagatccccaccttcaatactggggattacatttttacatgagatttgggcagggacacagatccaaactatgtaaagaagattcttgcttataaatgtgcaacaaaatttagctaaggatgagagccacatttctctctttactacatacatagtattatactagtaaaccttattgtaattgttattattattattaacacagaatggtatctcttggaaaaatacgcttacattaaaacattaaagctcgctactaaaataattttgtttttcattgattccagtttttcccacccactgtccatttaggatggcttcagaaaagagaaatggtgtcaaatctgaagcagtttatttagtgtcttcataaaaaattctgggatgaagtgggaattgctcattaaaatgcatacatatttttaaataacctgtgttttgcatttattctttctgcctctgtaccttacattaccaatgataagcaagaggaacatggcattcagatttagcagttatataactgagctgaaaaaaatctcaacatttaattaggaactgtgaaattgtataaacctgcttcacttttctcccattaaaaactttgttaacacagactattgccgcaaaatgcatttgattagacttttcttatttaaaaggtttttatcattattttttgataatttgttgttttttcttgctgtgaggattctaaaatatctagagcacacactataatagccaggaggaatccaccatatcatgtaattcaatcacacagatagaaactaacctagctagcatttgaactgaggcattcagaatctatttgtcaggtctgttctggatgaatacagcaggaaaatgactcaaaatgggcttaagaaaaaaataatatattggctaactgaaacgttcaaaaaggttgatgcttgtttgtttttcggggggtgggcatcaagcatgccttgagttaggtgtgtgaacaattccaagtttctttcctctgtgttagtttcggatttcagagatgctttctctatttggtggaaaattattgactagaatcttggcgtttatacctcactgtctcaaaaaacctcagtggaaagagatctcctcttcaagagccattctgcaagcagtcctggaactgaatctaattgtctctggttggtttgtcttcatccccgtgtttgtctagtcaaggtggctatgccctacaagcctcttatggcaagacctgaattatgtgctctcacctaatgccagaggtgtggtcagcccaactgaaatgagatggggaggattgggctttgtaaggaaaataaaaatgcaggttaaaaaaaaaaaaaaaagcaaacacatgtcctctgcagatttagaatccaggacattaattcttgtaaccatcttcaaaatggaacaatataacttttaaagcccagtactgtaccctgaatcttataaccttctccttaattgaatgttttatcagacttacaactccaaacacaattgagaaagaagaaaaaaaggaaagaaagagagaaggaaagaaagaaagaaagaagagagagaaagaaagaaaaagaaagaaaattctagaggagtttctttcttagtgagattttcttgtctcttttaagtctcatgtctcttgcgtttcttgccttttgctatcattctggtgtgattgtagctctgcagagcaataagttctcaacatatgttcacaattcatggtttttcacaatggttctactactaatttttttttttgtcttatatgccattcatgttcaattctctagacttccatttggatgtgtgtctaaagcctatataaaaatactataataagaaatacttaaggtttcctacagttggtattttaactaaagtagcacatgattagagcccgctgggaattctaattaattgaatttttaagaggcagaacctgaaagtataattttttgcaagtgatttattagatgagtttttagaaagaacccaaaggaaaagagggaagtggggcagggaagagatagtagccaagctcggtatactgtcaagcaaagttccacagaaggtaaatttgattcaatcctatagctctggagagaatacaggtcatacctagagttgtctcacaactaggagcacgggagctggagaagttataccctagaagccagtcatttattggttaatggctgctcctgggggtatgtaaattcctaggtactttcagttctctctttgtgaagataaattagctataacagcttgaggacagtgtccaaaaagagataacatgtactggctcttaagggtacaaagtacataggaatctggggcggaagagggattagaagggacgtgagtccagcactgacattttctgctacattactcgtctaagaaaggtgtatctaaataggagactccatttcttgtatcaaagggaaaaaatgcttgtccagtaagactttaatgttgtcactgagttatttttctttggacaaggtggaattctctttacacccacacaattgggccacttaaaatggagatccacttttgtaaagtaacaaatacctaggcttcaagggaatgatctaattaggtttgtgcaaaagtaatcctacttttgccatgacttttaatggcaaaagccgcgattacttttgcaccaacctaacacaacagctgtgaagtcagtattcctttgaattatactcatagcttctacttcaagaaaacctgaaaatgaatcccagctccgcctctttagctttagaaaagtaagtgaaattatatgtacgtattgtacagatacatagtacttggtactctgtattgtacaggtactgtgagtctgcataatatatgcatataaggtagctatttgttgtaatattattacaattatcataattgtcaaaatgttcagttacttaggtatttagttatgttaaaaaatgacttctgtcttcacaatcaatataaataactaagagcagagggaaaaatacacaatttttacttatattttgtctgaatgttttagattaaaagccttttcaattggatactttgcatgtatttgttataaatctcagagatttgctgtcataaaaagataaaggatcatgaattcagacaaatattagagctctatttttcctttgtaaaacaattttctcagaaaatttttattacactggtaatgcatgctcattgcaggaaaataatgaaaaccagaaataaacagagagcagaaaataaaataaaataaaataaaataaaataaaataaaataaaagacatttatatcacaactacccatagataaaaacttcacatgcaatacatacaacatatgcatttttaattgaataatacctcatatcctataaaattcactagacattgtgaatatctatgtgaataaagttccttctagaatttcgttcttattggttagtatgccataaaatgaatgaaaaagaacatcagttatctgaggttaattgttgccatgaatataccaatttactgaaatgtcaacttaaatttgtggcaagtggcaaggctttttaaaaggacaaaaacttagtatatgataataattattttttacttaaggcaattcaaaattcaagttttcactgtaattgtatgttaattctgagaataattgaatcaaacattgatttagggcacattttctgacaaatatgtttgagtgcatatgatttttatccttgtgctttatccttgatgtacataggaggataataattttttccaataaaaatgtctaaggcttcataagtgttcttgcttgaagcttctactgagacatcccaactttctgcagttgtttactgctcaaactctccaaatctttatttgccaagcactttgcatgtagttggatgagcctcccacattccttctgctgacttgaagaaattctgcctcttcttcaaggtttaccaattgactttgcaaaatgacttactaccattattattaatttgaaatataattagaatagaattattcaaatcatctaaaaatctataagggaatgaagaatgacttgacaagaggaaaggagagatattaatgtgaacagactggggattcattttacaattcattagtttagtagtgaatattttccttctggaactttgcttgcagcctgcccgttcttattttatgccttctaaaccattaatttctaaattcatcccttattgttaaacacttagtttcatttattataacatgtatttttgctcctttgaaagatacccatattagactaaaaataatagatatgagaaagtagacgaaattaatattaataaagtaactttatttacaagttctttataacaggggacaggctgcggtgtaaatccatctttgttttacttttttttaaatcgtatataaatgagtactttttttgaggatcatagagcctatttaccagttcatatgggtctgttttatagtgctgttttccctggataatttacctcacccatcccatgtcttcagttacctattagtaccagtttagatctggaatactttatatttttgccttagaaactataaatatatatataaagcctgcctagtcttaaatgtcatgttctcacaaagaatttccttgaccactataataaattgacataatcttgttactatctctgcactctatttcttttgtttcggttattgcagtttgcaagtgtacttgtttttattatttgtttatggtatgttttcccactagtctgtaagcaacataagggcagaggacatgtctattttattcaccactattttccctgaacatagcacagtgacttgcatacggcaggcacttaataaagtgttaaataaatgactgattgagtgaatggcgaatgattgcatgatctgaaaactagtcataatacaacagattgatagaatatttttcttgagagttatttgtatggatgctcttcttttattttgctgtcataaagattaaaccgtcttctattctaatgaggtgtaactgtttagtccagtccccgatattagttggagaaggttggacgggagcccgttgccagggaaagtcaagtacagcaaatcccaagctatccttgaaatcccgaacttccaacaagaagatgaaggcttttatgagtgcattgcaagcaaccttcgaggaagaaaccttgcaaagggtcaactcattttttatggtgagctaattggatttcaaatatatataaaatatttggtaatgcccttcataataaattgtggaagtcattagcatgttgtgaaaaagtgtcacgggagaaataaggaaggcatatttccgggtttagatgcttaacacaatgattagcagatgggaatgaccacctttaaaatatggttttaattttagcatggtctatgaatgctattgtttattatatttgccttcaaaatatcagcagtgtcatgttaaagccataaaagtttataataaaaggaagcatgaactccatatatttcccattaaacgttctgcagcagattatagcaatcttgattctaattctaagtagaattaataaatgaaaaaaattgataggaaaaatataatactgcatggtggtttataatatttgttcctagttttcatattttgtctactcataagtaggtaatataaaaagaaggcaattacattatttaaaattatgtttgtctcagttacaaaaatctctcgtaaacttaagagagacgatgaatgcatatattatctaaaagctgtctttgtgtcttctttaatccaggattgaaattttctcttacttaacattaagtaaacaatacaatatatctcagaatttgcaaaatgctgtatactattaaaagatccttaacttctttgataaacttaatgtatctgtattagataatttttaaaaagtattgatatatggccaaaatactttcctatgtgacatgtttataatcaatgataaagtaattagagaaaatatgtgtgtatgtgtgtgtgtatgtgtgtgtgtgtgtaataactagaaaaatccaggatactgtaattatcccataggaatgttgattgagtgcccgtggggagaacatattgtgtgtctgtaatattattttccattttctttagaatttccaactttaacctgcaatgaatactactattttatatatagaatataattttctactcattattctcctacagttttagcaaacctagccaagaaaaacaatattttttttcagtagtacctacactttaaaggaaagtctttggaatttagtatcctttgtaaataaaataggatacaaatgggagttttagtagaatgaagatattgaatgctttggctagttttaaagaaatattttccattttatatataatagacaaagatataatcaagggatgaaccagaacacaaaggtatctgtaaactggaaatcaataataaagtacctttctgtatactgataaagcaaatgttagcttacatagcaattttacaaacattcacttatagaattcttaatcttaagaagtagaaatcttaagattaatattaagaggtagaaacaatgttcagtgatactataggcaaaaatatcttaagttaattgtgcaggatctcacagatagtgattgtcagattcaagatcagaaccttgaaatgtcttctgaaactgccatagcatttcaacatggtggtctaagctcattgtactatatctcaccacaaccaaattagccatttaattagcctgaaatggtccttgtaggggaataatggatacttagtcaataacataatcattatgtttcttagtcacatattaattcactttctgaagtgctttcaaaagaaaagaggattactgactcagttacctcagagttgaataataactgagaaattcaagaaaagaatctctcagtctgttatattgctgtgtttaagttataattcagaaccaagtaatattgtatatccatctatatcgtaattttataatctctaaaagaaatctctaaagtattattcatcatagaaaatagaacatgttcagaggagttaagtggcttttcataaccagtcaatatggcagaaaaaaatctaaaactcaaacctgtatggtagacccaaaatcctaagcctcttctcccatgaatttcctacctagttttaaatttaaaactttgctctccagaattttaatcatccaaagaatgttcacgttgaataaataaatgtgttctgtagccgcaattattgcattaagcataaaatcagatatatctgaaacctttgtaagttatgtgaaattacatatgagcatgcatttattttcccaggtcagacatatattaggacaatttctaaacaaatacttatgaattatataattttgttaataatacccagaaacatgattcaatttcaccaatagatctagttcttctaagttttgccttgatttgtccctcaaggctgcaggaagcacattctgtaactggaagttgtcctgattcctgcaagaggtaatcctaggcttagttcccaccacccagagacatcatgatttcttttactcgtttgtagtctcattgaagggtcttctgtcttggtgaaggcaggttgtgcagtagaaaaactctagaagtcagacagacttgcgttttatattgtgcacaatttcgaatcctctcggccctgcttcttacttcagccactgctacggtggccagttcagcactgtgcgttgtagatgtaacctgaaggagtgttgtctcaggtgcaaaactaccaagcacatcttgttttctgttctgggttttctttggctccttcgtgagcctactcagcatttaagcatgcccagtttggatgtgccagtagtttacacctgcactacccttagatgaccatggatgggaactaaatgatcccccttcatttccctgggtagacagctctaaagactgcttagaagttgacataagatggagaacaatggatcgtgttggtggtcaactcaataactcagccttgcattgacttttttttccttcccggtgactacctttttttcctgatgcttttcccttgggctaacattctcaaatgaacatgtggaactcaagccctttacttaggttctgcttttagggttcaaattttggcttccctgttttctaccatgtcatcttgaacaggttacctaacatcgctgcgagaatccactgaaagattgtagagggaattaagtgcaattacaaatataaagcatctggcttgccacagcctgagagtccaagggaagcgtcatatacttctgtatatccaaggacagaactaaataaaggagagggattaattggcacctccaggcagtttccagtcagtttatgaaagagatattcatgtgaaaacatttaatttccaacccgcctgtttccatgaatgatggtaaaaataatacaatcttactttcacgtcaattatgccagtttcttgttgtctcactactatgaagaactttctcaaattaaagaaaatttggaaaactcacacccagaattaaagtaagatactgaacctgtataaaactccaaatgttcaccattccttgtcaagaattttatctaggaaaaaagaatactggattatctttctaccaaaatgccaggaagctcatgtttgatttatgcttcaaggtattgagttgtaattgtgtctgaaacagatacagatttattacttttagtttagagcaaatataatcagtgaactttcagatttattccacaggttcagatttgatatacattttctaacttgacctatgttctaatatttagcatggatttattccctggccctgttctacattttgcccttttcccacagctcccaagttgttatacaggtggagcaaaatgacagatgacaaacatttaacttgagccaaatgcccaatgatatttgcaacaggatttctgtcaacccgcattgaagctcctgcatgtcccctccctcaaatcgtgtgtgtgcaatccaactggacccagttagccttgtccttctgatctctacagcccttgtaatgtagcataatgtcttggataactgccttttaccaaacagtggcacttgcctttttgaaacagctcctccagaatgggaacagaaaatccaaaatacacacctctctatctatgacaacttgctctgggaatgtaaagctagtggaaagccaaacccttggtatacatggttaaaaaatggtgaacgactcaacccagaggtaagcaactatgttgatattaaaagtttacctactctactaggtaaattttgttactaacagtactagtaactaacagaaacagctaatgttaatggagtctttggtatgttccaggaaaggatgcatacactgatttatttaatccttaaataaacttacaaagtaacccatctttcaaaagagaaaaataagtgtagacaagacaaataactttcacaaaatcactgttagccagtaatagattcacatttaaatatcatcatcatcatcaccgtcatcatcgacacggataacacttactgaactctcatatgagccaagccctgtgttaaatatttttccgtgcattatcttattgcaccctcatgaaaacattataagagagatacaagtattattcctttatgtaaatgaagaaaatgagtttcaaagaggttaggctacttgtttaaggtcacacagcagctagtaaatgttagaattagcattttaaacttttattttggtctgatatcaggacccaatctcttagtcactacccagtattttgcttttatgaacactgacgactgtctttaaacccctaggaaagtaaataactaaggcagttatccacatttctccatttaaagcatactttcttctacaatacctagaaaatgaaagatttgttttttacctattaaattatccagataattgtgtcaattctccattttactttgcacatgtaggcatagccagagacacaaagaacatctgttgtttggaagctgaatataatgctgttctttgtttcagcatcagtgaaattttcttcctgcatgccttttgcatatagcattctgtttcctccagcctattttccttttccctagaggatggtaatacatgccttgaaatatttagtcttaagttatatttgtactattaattatgtcactatgtgcactcaaaattgtatttctataccccacatggggttctgtaacagattttggctgtttaggcacactttatagtagtttgtagaaaggaaggatttagctactccaactcaagactcaattagaaaattatcacatcatcacatttcaaatgtttttgaaacttttggaaaatggaaagccaaggcagtgttctagtcatgatatacatgtctaacattattgttaaccgtgttttcctggaataattaggacggtggagtattccaaattactatgtataccaaataacagaaagttaacatacattttgtgcaaagtatgtcaattgtcaaagaaatgagataacataaaacacactagtaaccactaaaattatcctaaacatattttcgttttttaaacttaaaaatgctgctcagaatctagtagtgtattaatacaccaaattatcagatctcatagatatacacaaatgttgtttaataacatatcctggttaagagaatgctatattaacgtacaagcatctttatatgccttttcctttattaggagagaattcaaatagaaaatgggacactcatcataacgatgctgaatgtgtcagattctggtgtgtaccaatgtgctgcagaaaacaaatatcagataatttatgcaaatgctgaattgagagttttaggtaagtcgtttatttacaaccaacaaattcaaaatgacgttttaacaagctataattatgcataatcccaacccaattttttttgtaaattagaaattgctgtcccatcaaataatgggaaatgtctaaattaactttttacaaaattcaaggtggtaattattattctgcttgggcaatgcactggggcttcagaaaaaaacccaccattgggtgcatccaaaccggaggaagctcttccaaagctgattctagcatgaatttttgagtataactcaaagaatatctttaggaatattttcagctgcaaattaaaaagtaataaaaaaatcacaattcacagtaactaaaagaaacagtaatttattttatctcttagcaagaggggcattggctgccgggcatggcacctcaacttgacaaaatcctttacaccttcccttcagcatcaaagcctcatggttacaagatggctgctctagttatagaaatcaagtctatgctcaaggcagaagagcgaggttacagaaataatcacatttatctcttttattagaaaagcagaatttcccttagcttccatagtaaactttttatgtcattaactagagttctgtcacatgaccatccagacatcaagaggaggtagaaaaataagtccctatagtgaaaagtgctgagattaaagcaatttgagaatgatattttgggaagtccaaccagtggtgtctgccacaataaatgacgcgttgatagttttcaacccaagggtttcttagtggtaggaagaacagaggagataaaagagaggaaggatcaaacaacaagacacaaagttttatgagcttatgggtgatgagcactcattcatttgctcattctttctatcgctactgtttgattgaacatttattatgtactgagctgtatcaagatgaagtgatctttatcttcactcaacctataatttcaaggagaaaaaagtgtcagatttaaaatatggcaattcttatggctaagaattgaggagttgctatcgttgcacatgacaagttgaacataacctacattgaggacattccctttaatctaagatcagaagtaaaaacatgcatcagtaaggtgaagggtagagaagcaacatctgaaaagcccagaagcaagagagcatggcatacccgaaagaacttcagttcacttgagctttagattagaaatggagactggacacatggattccaacattcatgaagttggaaagattcagaggcaccctgatagcctaataatttcttgtccttctgaactggcatttgttcaacatatatttagtggggaaaaaaccgacatagtgatacagcatttctgatttatttcaatagtattttattgctaatagcaataaaatatttctgatttatttcagttgctaaccacaatacaataccactgaaataaatcagattggtatatatacatatataaatcacatatatatgtatatatgtgtatatacgtatatatgtatatgtgtgtgtgtttcttcaacatcatatgttccattgcttatatacatatataataaatcagaaacacacatacatatatacatgtatgcatatacatgtatatatatggatacacatgtatgtgcatacatgtatatgtgtgtgtgtgtttctgatttatcatatgtatgtatatgacatgtatgatcattgttttggctggaatagactttcctggtcagaattaaaattccttcttcggcctcttttgaaaccatcttcatcctctttgttgtaaatgctattagaaaagtgactttgtctaacttgcctcctctctaccacttgcttttattattgcaatgaccaccaacaaaacaaaaataagttgcatttattgagcctatactttgcgccaggcactatactataattccctgcaactgttacatcatttaatctccacactaactctctaaggtaatatcttttgtcatcttcattttacaaacaaaacataaactctaaaatgttaagtcagtatttggtccaagaacaccttgagcaaagtaacctgaaaagaggatacagctataaatattagattctgtctagcatagcaagtcacccctggagtcactacatgttaactgagtaattaaacaattttgtctttgattttgtttttagcctcagctccagatttctccaaaagtccagttaaaaaaaagtcttttgttcaagttggtggggatattgttatcggatgcaaaccaaatgcttttcccagggcagctatctcttggaaaagaggaacggagacccttagacaaagcaaaaggtaaacaaatctttatttttaaaaatatttttgtttgtaatataacatcttccaaatttttaggttttagtaggcctttcaaaatttcctcttttatgataaagtctcattggcatacctagagacgccagcattcttctcatcatagtaaaattgtaaaaaacaaaaggatcttataaaataaagacctgtttgtataagttagctgcaatattttcagtgcatgcacttgtaatagatttttaaaaatcttttaagacctttttctacattcagtttgaaggcttcctcctgaaccagcctgctgagaaatcagtgcgaataacatttcacaaaggagagagacactcattggcacacacctggtgttgtggtttttaaatagtcacacaggtgttcaccccatgacaaaatgaattcaccacatgaagaaatgtagagaggttcctgtagagaaagaagagaggtttcctaccataatggatacagttgagaaaccctaggtcagcactggcatgttttctaggagactttgacaaaagaaaacaaacaaacaaaaaaaaagacgggtgtttttctctacttgtaatatcttttattctattgtaccgtagagccttgtatacatgaggtgactagaccacagatgctgctctcttttaatgactcacatgtgttactctataatcagatatgcaattaaatcctaatgtgaacgagccattgtgctgaagatatgaaaatagtccctttcgttcaatgagctcttcttcagcatcatatgttccatgacttatatgcataccaggatgggcaggtaaaaggccaggtgaaagaaaggacaactaaagtgtgttaaaaaatgacagttgttactcttggaagaaatgactgtgacggactagaaagtgagttccctacctaaaaaggatagtcacaactccaaattctgtcaactggttgccttgcgggaaatgagaactaggtttgtagaacttccaatgtttcagagaaagctagaagtctgcattctggtattgaatctcccatgccagaaaaaagtagccataggatgaatgaagggacatcattttatcacttctaatcccaagatttcatttgtggccgaggaaaaaagaggtgaaaacaaacaaaagcaggggtctctgtggtttgtgtagagtccctttgtggttataactgctgccttgaagatccattccatttacacaatgaagtgtacatcagagagcccctttctagggcattctttctttccttattctctgcatttctttacatccctggactaaagcttttcccaggacaggaattatgtcacatttatctttgtatgtcctgtgccttggcacagaaccaaaacttaataaatatctgtggaataaatgaatgaatcaaaaagggtgaacatgtaaagcgttaccagctttacagaaaggctgttcttggggaaatccctcaagacataggaacaggtgcttcagaactaaggtgaaagaaaaggtgaaaggaaacctgttgtcctgactcaggttgggtctcttcttctgtgtgcattgcctaggagatttgctcccaacagatttagatgtgaattctttttaaatgtttcctcatgcattcctaaaatctaatcaaggtttgaatacactgctgtggaacagaaaaacataagagatcctgcagtatcaaacacagcaccttgtactgagggtctggacaaattgattaactgtgcctcatttaataaagtaactcacccaaggagcagaatgatggcatttaccttccacaagctttaaaggtccaaacacgaagtatgtgggaacaagaaagaaaattaggaggagaatttgagtaaagctaagataatgagagagagaaaaaaaaaagctaagataataagaaaaaaaagcaggagggaaactgctttttaaaacagctcttcaggtttttgttttattttgttttgtcccatacagaataaatttggggtcattttcacctcaccacagttactaataatcatatcagctcagcattgtctctctgtgattaagggaatgaaccctgtgagttctatttatacattattctttcattctatcttttcattgcttcagggtttcactgcaggtcttaacaaaagaaaacatacatacaaacaagcaaattatctccttactgtgcattcttaaaagttgaaaataattgagctctagcagaatgtagtaattacagtcactacatctccacccggtagagattacactgagcagtaattttcaaaaggtcacacagttaactccatgagtctatgtccctgcacactttctagcttgtcctttcttctgttgccatctgatcgactggctttattaagtgcatggcttcaagctgtttgttgagaaatacagcatctatgcttctgtttgtgtcagactattgccttttttatagtcttatcgtgggacttccaaacagattgaggtaaaaaattagagtagtgataagaaagagagaaagaaaggaaggaaaaaaggaaggaaggaaggaaggaaggaaggaaggaaggagggagggaaggaaggaagagaaagagggggaaagaaagaaagagagagaggaagcaggaagggcaagaagggtcactgctgtttactatagacgtggtgtgatatagtaaaaagatttcagcccccaccctgttgagagcctgactttggcaaagtcatttgtcttctatagaacttcatatgtaaaatgaattagaggtacttcattttcctaaaaaaggagagaaagtcaaatggtttcttcaagcctgttcaggcccaaggttgattatttcttctacatctttggtctgaaccattacgtggtagccaaattcttttttccctgatcagaaccccctcttctttttcaaaagagtattgacagaacagatcctaaatcctagcaaagtagctacatttagctttcaaattgtcatggctttaagaagacaatattaacgaaagctttggagaagacaacatcaaaatagcagttaatttcacaaaatatgttttcttacatttgaatacataaaaaagtttatttgattgagtatgtatgtgtgtatttgtgtgggtggggtgtgggtagatgggtacctaggaattggcatcagatttccaaagcaaacaaaattaaatatattaggagccagggacagagtattgcacataaaggttgactgggcaatttatttttagatttgattacaaatgcaagggttattgcatgtgtacatacactgttcaatgctatatttgaaaggagcactagagataatgtatcccattttccgaatttacagtgccagatcctaaactcaaacacagaacgctgagcccagtacacattttttaatgccacaccagactgattatttcactcaaatagcaatatatacataacttctaccatctcatacctctgttaaaacatgacacagttgtatatatatgaagaataaaaaagtcagatataggaaaaaagttcaaaattttacaatgattccaagtagaaatggtttctagttcttgaccttggaaatacctatgtgaggaaatgtacatttttagtttctgttgtaaaacttctatatggtactgtctactttgaaatttcattgtcactaactcttgcagccaataaagtataactacctagagatggttgagagggctctaaagaaacctattcaaagtaatcagactgaagtgctgacttataaaaaaatggtggcagtatatatattttgacaatttcttctagtcttacatgaattgaaacagcttccatcacacagctaataagtgaagaagcttagacttggtgccaagtcttccatctctgtattcacgtcttttcctctctatggataatggagtacacgctcagctcttcagtttttgaaaggctgttgtcacatgattcaacgtaatttgatgtgttgataattcagattaagttacatttctcaatacagtgaacatgtttcttattagcctatgtgccataattgaagtcttggctgttttaagagttctgttcctaaagcaaggatctgtatttatagcagcctgtcagaggagaaaagtgtttctcgaaccaaaaataggtagatggcattacagagtccgaagactgcctggtttcctgctgggaatgaatggtcatgcaacatctgtctcattctttttagacccaccagtggtttagaaatagcacttatattgaagagaagcaaaaggcatattcctgcaggagaaccaggaagcactgggaattagaaaacacgggttgtggtctcagatctatcactgataagtggcgtgacttgagtagaaatgctagactcctctttttattttttttttttttttgaggccactatttcctggatttatcttaagatgaaataatatgaaaacaactttaggaaatattaaacactatattcatgcagtgtctgcttgcacagagattacattttagaaatcaatagagaaccttagcccaaggggttgaaattgaaagttctatcttagttataactttatatatgttttaatgatttgcttgggtgaccaggtgactgagccaaacacggcaattgctgtgaactgtcaaaacagctaaaatgatttggttggatggattcagagtttacagagagccctatcagctaggctgtaagctccatgaaggcaccgagcaccattctttaattcaccattataggcctagcatccaccacaaacctggaatatagcacacattcagtaaatattttctgtgttgctaaattaataaaagttaaaatttaatttgtttaactaattttagagattttgcagctaagccaaaaattttaataattaatagaccgatggtatgattattcatttattaatttcttcattcattctgcaaatatttgctgaacacctattataacctaactgggtgctggggataaagtgttaagccagatagccacataacatataacattcttcttgccctttcttatgataatgtttttctttaaagtgatttgaagtcaaagatctgggttaaagtcccaactctatttcttagctgataacttctagcaagtcctttaacttcacaggttctcagctggttcatttcagagaaaatggtacttgtctctctgatgaggttataagagactcagattttatgtccggaatgacaggtgagctgtacacacactgctacattggatgtatttgttgctgtcatcgtaacttgtatgcatatcccagttgtgcatgcttttacctctggcagccaaggaacaaccacggaaaatcaggatgaattacagattaagtttatctctgcaaggcattctcaggcaactgagggaatcaattccacatctgctaagtttgattaatcacttctttttttccttgtggatctacttagcaagtgaactgacagaaatcaaagtcctagatttgtccccttatgcccagtgactgctgtctacctattcaggaatcacctcctgaatttaataggaagtgttaacccactggagagacagttcaatgttgttctctgacaggcagcattaaatacaattcctgaattacctggggtttggtcatagcggacatacaagctatcaacaataaaaacaaagagatggagaaaagaaatgttgtcctattattggaagaataccattatacaattgaatctggttgggtgcagtggctcatgcctgtaatcccagcactttgggaggccaaggtagaaggactgcttgagttcaggagttcgagaccagcctgggcaacatagtgagaccctgtctctgcaaaaaaattttaaaaaggaatggggtggaacatggtggcacacccctgtggtgccagctaatggatgggggtgggaacgggtgttgaggtgggagaataacttgagcccaggatgttgaggctgcagtgagccatgattgtgccactgcactccagcctgggtaacagagggagaccctgtttcaaacaaacaaacaaacaacaacaacaaaaaaatccctgaatctttggtaattgacagcattttctctcattttccttaaaaaaaaagcctactgcactttgcccagatttcttaaaatcaaataaataaaataaaataaaatacagctaaatgtcagaaaaagtctcattaataatgatgataaccactttaagcaccttctacatgctagatggtgtaccaggcactttacatatctcaaaacattaaagcacatttttttttcatattcagatatatttctgaggatcacaattgtcaccgattatatgattaaatttgtatcatttttaccctagtaatctcaaaaagttaaacacaaaggcatttttaaatttacagagaatcaaactgactcaattacagagattctaccccttagcaattggtttcagaaagtgattatattccccagaattgaaatgagcggacagctggactctctggaaaccaattccgttacctttatctacttactccaagtatatatatttgcagacaggtgttatcaaatcatggattctgtgtgatttatcctacaataatgctactgttaaaacctgtgtggccctggacacttggcaaatgcatgtaccttgtgggaaagagtgaacccattaggtgaattggagtcttattcaattattgaacaagcggtgcttcttcaatatttttgccttcaaacctcaaatttagagcagacccactgcacttccacctgcctggctccgcaatgcccagacaccttcctcttggacactatattccattgtgggaaaactacacaaggaaggtataaagatcgtagggaaagtggaaagtggaagaaggaagccaaagtaagagagaaggaaatggtagagaaagaaagatgagagaaaggaccagggaattccctgtgacaagatagaagtgctacttattgagcaagtcactggatctttcttttcttcatgggtaaaatggtccccttgggaagacctgtttgaaagccgttagcataatgcctgacacagacaaggaacagaaaaaaattagtttgtctttattcttctcattgctaagttatgtggacaaagcagttcttctagttacacagccattgcccaatacttagctatcattacattttcttcttggaggtttttccaatcatctgatcttgtggaggcaccagctaatgggagtctggctgcctgaatgcaagacagccaattatatgattcttcctccctgtctgacacttctctacatattttacaatatctaccttctaaattattactgttccttttgcttttgcctttacccccaagtgctcagtcttaataaaatatctccgtcgcacatgccttttcaagacaacattaaccattatatagcaactgcaaagcaggcttctctaccccttcctcctctttgcagagcttcctaatggaacaagcaaataaacttaattttattttgtatctccaactacttaatataatagtgcttagtacgtcaggtagcatgagtatcaaacaggcaaatgaaccatatgttcccctgtttaaggaagaatgacagtctgcataatgccaggcttattacaatctcccttctgtgctgcctctttgtaataaaattttaaattgttcatactcaactcctgagagccttgttaaggtgagcctttccaagggaatacatgttggagatgtcaagagccatctgatagtcttgcctgtttcacatgaagatgtaacaagctaaaatcctgtgtgtgcccctgtcagtcttgttttcattttcccctcttgccatccaattcccctttctttatccccactgacctccactgatctggggcactcacctttcacacagtgcctgcagaaccacccagatgccatggtctgaaaaagctccggttcattaaagttataaagcctgcctttaaatccagcctgcctaactcaatgtacgctgttttaccctgctgccttgtgttggcctattactgctgtagtccctctcccatgttttcgtgacaggtaaagccacccttggtggctttcaaccaagggtaaataggagaaaacaaagaagtttcacaaaataaatagcatcttataaattattaaactgtgtcttacaacagaaaatgggtaggcttccttgtagagtggctgtgaattcatgggctgcgatatcagtcagtttcaaatttgatcatgcaccataagaatcttgtgaaaaatgcagatcccagagccatgcccatgattttgatttagtaggtgtggaataggttaaggaacctgaatttgtgtaagttcactccctctgccttcaagagaggctgaagttgttgaataccacctagaggagcactggtttggtgcacacatatctacttagatagaaatgtgcttcattttatctctgttccaccccagaactttgattcctatcctagcagttcagccattcattctatctcactgttgaagagatataaatccttagttctcccctttttgaaaatgtgaatataattggctctagaatggtgtccacttattttacctcttgcttctaatttctgagtgacacttgtatcttcaaaattttacataaatattcaacagcaataattttatagacagaaaaggtcaattattcatgtaatttatacaaatgaccttttgttcttggtttgatttttgagaaaagaagtggttacttgataaattttaaagtataatgtccttttttgtttacttaaaaagaaaatggttgatgacagatctttgtcacacccacaccttctaatgccagtgagtgtatttaaaaaaataaataaaaataaataattagaaaaagcattgctgtctatgacaatccagtagaagaaataaaagctggagtaatagtatagaaatcagtctcattaaaaccttccaaacaagcagtgaagctgtcagagcactcttttttttttaagccactgactagaatttttcaattttttctttttttcatagtagaactttttaaattttttttcaaatgaaatgtatgcaagaaaacctttcattccacagataaaattgaactaatctggctaatgtcccggagggagaaccagaaccccactcaatgccctcctcaatccctctcaccctaaatctccatggtgtgccctagaaatcccctagctctccaaggagcatagtttgaggactactaatttgtagtgacaaatctgattctcaagtgtgacttgccaaacgattcatttatttataagtatagtggcaaaccaatttgacgggcgttgtgaaagattctgggtttataacttgaatgagctcagagtctcctggggaaggcagacaagcccacagctccggtgcagtggggcatgtgtcaccactaacatgtgaagagagtgagggcaattcactaacttggcttacaggagtctagaaaggtttcaacaggttgcaggtaactgaactggcagttgaagagtgagtgggaatttttcctggaagagaaaagtgggaggtacaggcttattacgagactgtcttactgtatatttggtatccagacttggtgtcatttcagaattttgggtacagatttcccttcctcaatacaagacacacttctcccgtgagtcctctaaatgcaagtaaagggtactcaaatcattttgcaaggcatccaagaattgactctttgactactcaaggaatgcttggatatacctaataacatatattttaattctatctccaattaaattaaccaaatacacccataaatctatcctccccatatttaaccatgagtttcattatataagaataataatgatgatgatatatccatttatatgctatccatcaagggcagatagtgtgttaagatgtttgatacatcatttcgttaaatttttacaacatacctatgagaggcatttattcatatttttagatgagtaaaactaaggcttagagaagttcagcatcataccgcgatcagtaagtgatagaaaaacattcagttctgagaagctctgactcaaagccttgtataatcttaaacacaacactgcaggattttaatgagatttctggtgtctatatgtggaattcaaggcagtccttcataatatacacatttttttgtttcttcagagttatactaaaaaaatcttctgaaaatagtgatatgcaaggtaaaactctatctttatgtcactaaaaggtatagaataagtcaacatgttgtccaaatactgatagatggagtcttatttattcacatcaatacaaaaatatcagttctttcagtggcacagcatcgtgaatacacaatgttcggaagactgattggatttttaacgtaacatacaatgtaatttttgatggcatggagaggtagatatgtaaattcagtaagcaggttaaagtcgctaagccccacaaaggaattaaaataggtataagactgtgtattataactaagaagaaagagttaaagttagcagacaaagagtcacacccaggttggtcccctattctcagccacttttgtaaacctaattttgtagactctgaggaatgctataattcagtagccaaagggaatccaggattggaaattccactagcatccatcactttcaaaaccatgttctatcttgatactcaagttttcagatactcatgtcctgaaatcatcagattacagggagctggagtgaaagggttaataatcattagcgttccagccctgttctctcacctttttatatgtgagggaagccgagaaccttaagtttcaagttggtggtttaaggtcatctgacttgaatctcatctgtctatcccaaagctttcagcagaaacaactttacatttataaaacttcaaagccctgaggaaatcacacaataggttcatagtcataaatgtaataatagcataggcagaatgtcctcacaatgttcagacttctccattctgttctgcataactctctcctctattgtattttcaatgtgttctcctctagtaactttgggagcatagtttgttggttttttttttttaatttatttctttaaagtcctgcattcacacatttttgtgtcctttgccaacttcatactttctagtcttttcttttgatttacttgggctataaggcatgttagcatatgaatctatgttaattctcttttgtgttttctcaggcatcccaaaatgctgcagcgaatggagacactttatctttcccttcttctactgaagagctaaatatttctctttggcctatttcactggattaatttagttaggctttccatctgatgctgttttgttaatgttaaattgtatttccttaacattttatgggagtcagcatagcagcacactctggcatgccatcagaataaagacacatcatggcaccaaataattacgctatttagcaactgctcttacctaccatctcctaatttgtgccataattcagtcaccgtgaatctgtgtttgtgttgcgtcagccactacaaagatcacacttaaattttttgtgtatattaaacaaggtgacacattatgataaatttagaggtctgaatatttgatgcttcctttctgctttggagtttaagacagttgaaccaaagacttaagatggaatcatttgttcactccagtaattacgcactagttgtaaatacaattacagacactaagaattctgaaaaagtagaaacgggcaccagtaacgttctcatttaaattaaaatgtatttgagtctatttctaatatctaggtaacccctctgaacaactatttgctaataaaaccctttcagttaactacctaaagaccctgaatcatccttgaaaaatcagttaatgggaagtatatccttagctatttaatagttaaaaatatgtatttctcgattttgttgaagagttgccaaaaaaaagtaacataaaagtactcaggtctatttcttttgtttgtttgtttgtttgtttgtggtggagtctccctctttcacccaggcttgagtgtagtggcacgatctcggctcactgcaacctccgccttccgggttcaagcaattcttattcatcagcctctggaatagctgggattacaggcgagcgccaccacacccggctaatttttgtatttttagtagggaaggggtttcaccatgttgttcaggctggtctcgaactcctgacctagttatctgcccacctcagcctcccaaagcgttgggattaaaggtgtgagccaccctgcctggcctgtctgtttcttttataagcacttgctttccagcaaaacatagcaaattggatttatttgttacctgtttatgatgtcacttcatgtaggttttcatttttgtttcctttcctttccctcttcctacggcccataaatatttaattacactctgcctaatataactcaatacagctgcccaaaggaacactattatttgcctggagctaggacagaggctaaaaaaaatactagagatcttattgcgacaattctgtgaatcagatgaatatttaggaaccaccaaacggggtctatattgttataataattaaaaacattttactctggcttgtattataccctttagtttcatgatcagaactgaaaaaaaataatgattaagatttgttttatacaccaagtcttatcctagtgatttgaatgtagagttgaccgttggacaacggggattgaactgtgcaggtctatttatacttgagtttttttcattaaaagttatactgactgtgcctgcctctcctgcctctcctttcacctcctccacctctttcacctttgccactcctaagagagtgagaccggacacctcctcttcctccttctcctcagcctactcagtgtcaagatgatgaagaactttattatgatcctcttccacataataaatagtaaatatgttttctcttccttatgattttcttagtaacatgatatcttctctagctgactttattgtaaaaatacattgtataatgcatataacatacaaaacttgttcatggactgtttatgttatcagtaaggctgctggtcagttggagactattagtagttaattttaggaagtcaaaagttacaggtggaatttcaactctgtgagaatgttggcaccccaacccctgcattgttcaaaggccaactccatttctttgcatcaacttttgtactgctttaaggggcatcagcaaactaacagaaagtcacttcaatgatcaaataaccacattgtttataagtataaagtttatactccttatttatacttataaataatgtggttgtttgactaaatcgctttctgttaggggactgaattgattgataatattgacaaatatacatctggctctagaaacaaaaggctgaatatttaacagcaaatgcaatcagaaaaatgcatatttattaagtacctgctaactgttgggcttcttggagaatataaacaaataaagaatattagctactaccttgggacacccattatgctctaggctctctctctctatatatatatagcataatgtatttaattctcaaaacaagatgatgatgttattactactcatatccccattctatataaagttggcatagaaatcaagcaactgctcctaaattaacatggccaaaaacagaaactcaggcacatattcaaagtgatctgactttagagtccatggtcttataatccctgtatcacctgcctcaaacaaaccttagcttttacagcatatttggagagcaaaaacttatctaaaaagaaaattaaaagtacaagacagtaaaatgatttagataatgactcagtagaaaaaacactgactccgtatcagaagacctgtatcggggctgcggttaagttagttattgaatctccctgcatctcagttttttgatgtggggagaaagcatatcgtgaactctagtgactggagaaggatgtgatagagaaagctgtatatcttggtggggttccgcaggaaacagtgctcagttctgcttctcagggaggtccacctgcagggcagcaatggatgattgtatcttactgcacacctgctgcctcacttcaagccatagtcacatcattggtagcttgacatcgtaggttgtcagctacataggttgcttccagacaggctgtatagagaaaccacttgggaacagtctgtggaaggaaagaaaaagggattaatttacctgactgcccctttgctggtggagctgctttacctgaacctttgacagtcagtggaactgagagaacctaaaagatttcataaggtgtgtctgaaacactgggaatcaaagaaggttttggagggtgaatgggattcagataagcagattggagagtgaaacctctgctagatacgaggagaagagagtttaggcttttgtctggcaggttctgtgaaggagggtactcaaagaaagatttgcaaattataaacatttgtttcctctttgggactcacacaactcttccctgaaaataaatatttgtgttctttccccaaagtcagacaaaataaaagagatgaatataatatttaacagtcctttctataaattttcctgaattttttgatatgtgtttcctcttgttcagaactgattaacaattgtctgtgcctgtgctttgctgaaagtgtgatctacgttacttggtacagtggccagatttaggtttgtttcctctggtccctcgatcatgtctctcttgagacagtacttcattttcacttcatctctgtctcttttgctttttttcatttttactacattgatgatcttataaggactgataaattaggttttcatcaatccactgattaaatctttgaattttgcctggacaggggtatcagatgttctctgtgtttaactacttatgtacaattactttttttttttttttgagacagggtctcacttagtccaccaggctgtagtgcggtggcacgatcttggcctactgcaacctccacctcccgggctcaagtgattctcccgcctcagcctcctgagtagctgaaattacaggcacgaaccaccatacccgctaatttttgtattttcagtacagacggggtttcaccatattggccagtctggtctcgaactcctgacctcaagtgattcacccaccctggcctcccagtgtgctgggattacaggcatgaaccaccatgcccagccatacaattacttataattaaagttactgacataaaatgatggaaaggacaacctttattttgatttaaatgagcaaactttgtaatttacttgtttgtagattgactttttatgtggtttgttaaaataagaaatttttaaaagatagcttattaaatgacagtgacattagcatagatattacacattaactataataattgggtgcaaaaatcattaaaatgcaatattaatatttaatctaaaacagattccggtgggacattttaccacaatatcagtatttgatctaaaatagattccagtgggagattttacctaaaacttaaattgtgaacaggaagaatttatacccacatttctatttcttatctaactcattttaataaaatcaattttacattttccaaatatcagtaaaattagagaatcaattaaaatttcatggtctacagcattatctttagacagaactggaagcaatactccagttaataatctaactataaaaatagcagtattgctctagtttcagcaataagaaattataattgcccgatgacctgattttttttttttttagtttaagaaatttagctatttctaatcctctttgtcctcaaactttgtacaaagttatggttgataccaaacaaaaaatctggagcatttcttattttccattcacaccttggaatctacatgtacagatctgttttctgtatgtaaataaattaaggattgggtagatattagatttgttatagtgacaaaaaaggatgtgaatgttaatctctattgtattgaaatagtttagttaattatgaacaggtattagttcatacaatgcaggtgctatcgtttggatatggattgtccccactaaaactcatattgaaattttatcttccatgtggcagttttgggaggtggagcctgtttgggccttggggacagatccctccttaatgcattaatgccctccctctgggttgagtgagttcttgctctcttgagaatagatttgttcctgctctcttgggaatagatttgttcctgctagacagcgttttaaaagagtctggcttcctcagtctctctctcttacttcccctcttgccatgtgacctctttgtacacaccagtttctttctgctttttgccatgagttgaagcagcctgagaacctcaccagctgcagctgcccaaccgtgagccttccagccaccagaatcatgagccaaataaaccatttttctttataaattactgagtctcagggagtctgatagagcaacactaaatggactaagacaccggaaaaacgagggtaaaatattccgcattagtctcgatgtagttccttaaagtaacacaaaatctgatgcacatgctgcgggtaaagaagccctccaagtggatgtgatgtgatccttctccttcctggtgttctgttcataatgacccatcaaatagaaggtaataggtacaaagtcaggcaaatgggtaggacatctgttacttttgttttctgtgtaggactacctaccttccctgacagtgggaagattaaaatgtcgcatgttcagctgctctttaaaaatctgccttcaacttatcagttaaacttgaaatatttatacgttattggcttagttttgtacatgctctatattctaaagccactataaaatctacccagtgtcacttaactgtcagacacagcttgttcttctgaattttgactcataatgcattagaggaattgcatggtacaatacaaacgctattaatttttctattagttgaatagtcatactatatctacacatataaatgcctttaaattctaattttacagaacattttaaatgcaaatgctataatcagtgatttaattatctaaacagaatattgaggtttggtaatttggggaaaatttttctatttaattgtgtgaacagttaaaatattctaattaagtggatattagagaataaagacatgagagaaatggcgttatcactaaacttattgaggaaataaggaggaaacataccaacaccgtaagtcaaatgtcagaatttggtgatgccaaaaccaaggagagtctggggactgataaccagagcttagttaaagccacataacatgcttctgagtccagccataggcaagaattttaagaagacattaggcatgagcaacaaacagagtgagaatcagaaatagtaactggagtcttggaagagagaaaatgtcaaatattagtatcagctaagaataagaattagattaatatctagcatttaattaacttttacagcaatcacattattattcctaaaataaaaattagagcattgtagatcaaaaagattaagtagctaagaacacagacaagaggttgcatgaattcacggaagggttttaagcagtgaaacttaatgctgaggacagttttgctggcattagactcctttcgaaaagcccagatatagttctcaggcctctttgttcaaaatgcagtgtgataaaacaatttcttctttccttgtttattcctcatggagttatagatatgcctacattcttaggcaggatgagaaatcagttcattgaaagcctacctattgactgctaatggagtccggtacagtgctaagcattttgaacgatttatatcaattaatcctcatgactctgtgacacaggtaatattagtatttctatgctatagacaaaaaaaaaaaaaaaaaaaggacttgggccattagttaacttggcccagtaacacaaaaatcaaatgttgggattcagattcgatcataagtagtttgtcctcaaagcccaagtttttatccactctgctaattacaccataattgcacaggatggcacaagaaaagaggaaaaacaatccttagtattagcatgaccattattagtacctcacgtgttaagatatctatggttaaaactctcttccagagcaggggaacggatattaagcctgtctttaagatgccacataaactaagaatcttgagaaaatgcacatacatgtacataaatgttgcatcacattttagagagttattagactctgaaggtcagattttaaatcttcaatattaaaggtcattctatgcaaataaaattatacatacatatatacacacatatgtacatgcacatatagcttaaatttatgctgcttttagtaactctgctattagtaaactatattttggaagtgaactaaaacggaacttgctaaaataagtgttttctggtctgaagaaagatatggttagaatctgagccctccgccatctagtgggtaccttgagtcacttattgcttctctttatgcctgtttcctgatttataaaataggggtgcaaacaatacctagcccagaagtttgtcttaagcattcgatgagttgacatttattacacacttactagagggcctgtgcagaaccagctccctataatatgtcatagcctccataaatttataacaatgagttttaatatggaaaagagcacctttaacatctaacactttttattttcgcatccccattgtaacacctaacataccgtttcaaacacagtagacatttagaaagtatttgctgattaagaaggaaaaaatatcttaacattgctccagtttcaatcatgtatttaaactgctgttgaatttttggaagtctcccatcatttcatggtgctcacaaatttccacacatatttttatgactcattatatattagtagtataacttcaaccttaaatcctcatataataatatacatataatatgtaatcatggtattaccttctgcttttttccctgtaactatatgctttgtactaatcattcatgcaaatctctacttttattatcagaatatttttcctgctttttacagatagccaagcttatctattcttctggctgtgtgtgtttttttttaaatgccagagaagcatatatgcaaatgaaggtagaatattttaatgtcgttcattgatatgttattaccaatccttgagataaagtatcttttttgcatattgtaaaagaagaatagaaaaaaatcagtctctctctatgaatgttaccaaaaccatcaattaaaatgttccagttaattcttacatgtgcattttgccttatctgaaaatgccaattgctcagtgccatttgatcttcactgagtgttccttcttttggcttttttaaaatcatttctgctaagacgtgtttagatatgttaaaaaactggaaattcttttatagtttttgtttaattttttcttaataaaattaagacaatgatcaggttgtttaattctgtttatattgtcatgagattaatttttttaccatattttaatatctcattaattaaaggagaaatctaagtgatacattcaaatatctgtactgtttgttatgccataaaatctttagttatgattaaatctttgaatgtctatatcctagatcaacagagagaacttttaaagtttattttaataaatcataaatcaatttggttactagtttggctatttttataaaacatttaaaatgtatgttattattcttttataaattattttcataagatcataagtaagatgtagtcttactttgaagtaaagaaaaaattttcagattaaagtttaatagtaaatagatcagtacttctcaaacttaattgtacatgctagtcactgtatgtactacagtgcatagggtgtcttgtgaaaatgcagtttgattcattaggtctgggataagaccacattttgaggagtaaacacatggaatatctttagggcatctagtgatgactctgctgaaacttcttggaccatataattaacatgcagaattattttactaaacgtaaggcaaagtaatggttctggaaaaagcctgagtactaggataattagatataacttcattctctcctacttagctagttagtctagggcagattttaacttttcttagtttgctctctcagtaccttaaacagtagtaagtacttaagaaatattgatgtgttgattaggatttcatagaaataatcagcctcaatgatggcaatttcaactcgatttagcaaacattgaagacctactgagcctgaaaggggtagtatactcagggtaccactgcacacttgaattattcctttctggaagttatgtgaaaaattatatgaaatatagacattggcattgacttagtggctggaaaactttcttggtggcctttagatatcagcagacctatcatttctgtcatgtgttttttattggccaatagttcaggtttctgtgttgctcaatattcctagttattcctaaatgttaggggtagatgcacccaaaagcttctcacatttacctcttataattcaaatcagataaagaattatatttggcctgagtttggtgcataatagaatagttttgttactctgtcaataatggcataattcaattgttaatgtaaattgggatctagtacactagacatctcagaaattaaataagacattaaatgtctgctatgggagaatactctaagataatgactttaaaaaatctgattatatgccatggaacattctaaattcagatgtggctccttccactcactgataacagaatttggaatctgttattaataataaatccaacgtcagaagctggcttcctgcaaattgtcgttggctggtattctctgtgtttcaaattgagtaattaattatattagctacattttgtgttatacatatattagaaacaacgatatgtttgcaatgcagcaaatactattttgttattgttaatggatatggcatgcatgccaattgtctagcctttcttgcctttaaaactgttgttaaaaattagtatgttgtcacacattttgatacaatcttgactacctactaatgtttttaaaaggttggtaactacatttgtaagatataaaatatggtagcctaaaattggacgaatatttttgtttttacattttttcagtctcctcttattacatttgatggtgaatttttcagggaacaaatctcagggttttttttttttttctgatttcagtggcattgtgctttagactatgctagagtttcagagaaaatttaatatggattattttatgaaagatgggaacttctttggcagatgaacctcctttttgtactctctcttttaggaatattaatattaattcataattaacccatgaagccttattctttctacttcttccttcctctttttgatgggatagccacataataagcatggccctctggccatggaaccatatagatagtttcttcaactcatcagcactggcaaatactgtcgtggttcaacaccccattctgtggccacagaaaatgctgacagaccacgtttaaaaagacacagactaattgtgaaaattagcttgcatttctcctaagccaagttcaatttttgccagtgagttgactttggaaaatacagagtaaatagttgcatttcttattcatcaagcaacttgacattatactaccaagcactgcttttatttttaatatgctttgaaatcgacaatgataattcaagttatagaatgataattatcaatatcgtgtcagaataaaagcaaatgccatttactgtaatatgtagactcagagatagctcacaatgaagaacagaataataggaaaggaaaaaattcatattatcacatacacccatgattttagtaaagttttaaaataaaaataagcacttatgatttaccagtgttgaagagccttacttctattaatgatgtattttctttttagaatatttctcttggaggatggcagcctcaagatatataatattaccaggtcagatgctggatcatatacatgcatagccacaaatcagtttggcactgcaaagaacactggcagcctcattgtaaaaggtatcatattatcttcatttgtgcttgatgaacattgtaaatatgcaggcatattatgacttgtgttatggtgtcaaacctgtaccatattgtgtatgtaaaattgttgatttcacaagttatctaagagatccattcccgtactcattaataacatgcacactttgccagtgggataccatggtagatgtgaatactttggcaattgaaaatgctgtcagagtgtcattcgagttaaaacctacacctaaattatttggctttttacataagccttaatgttaggggccatggacgttttgataaagtcactggataacatttttttggtcaaatatctttcagaatctttatttttatttgaaatatttacatgtatataaggctaccaaatacataactggctaatttgtttatataactccaggtacaaaactaatgaaatgcagggtcacaacctttagtaagcagttcttttcaaagagaaaaaattaaaatctgtgtgaatcattattatattttcatcacagtaagcagataaactcatacaatttatagagataaattctatactttacttttaagatttctaaatcagtatcaatccaaatgttcctacatttatcaccaaggacataattaatattagaagtatctattccctttccttgctgctttattttgttgaatctcagctcataaaactagtgtgtttactggaagctgtatcacttctatcatttcattgcctcctggatgataaaaatggctctcttgataaagcagtttaagcagctaattaagcccaaatgattaaaatcagcatttggtgctttctcatcttttccattaaaataaatatattcaataaaaagtagttagctgctacacttcaaccatcctttaaaatatctcaaggaaaataaacacccacctttgagcctggaagatatttctgccaacttgtctcaagcgtattacattatgacgacaattgtctgaagtattctggggaaatgtgactgataaaacttggtgtgtcaaaatccaaccagtatggcatattttgaaaaacttctcttccttaagattgtattgtcatcaatttttaagacagagatggacttaagtgtttcaagatagatgttatggctatatttaggaacagactatttctccagcaaatttttggcaatactcagacactgaaaaatgtgaatgctttatatttggaaaagtaacaagttcattaacgggaaaaaaagatatttattatatcatttcaaattaagaaggtgtaggtagtatgcaaattttattacagcagaagattaaaatgtggtgaaggataaaaaggcattttgcagttaaatcttctaggtatggaaaaatccagagggcattaaaacgtgaaatagaagggatagaaaacatcagcagtagcaatgtagtttttaaaagaaagtttctttagaatactggtgatctgggaggagggccaatggttttgctgttaaaatacaatgatggggattccttcactctggaggataagaaaaacacaagttaatggtagattgaactgaatgaataggcactcttcctccagtgtttcttaaactttgacatcataatattcacagtccactaataactgatgaaagaaaaataaaaggtgacggctaacaaaaatactaactgagaaactcggaagccactggactgcattctggatgtaacatttgcatatttcagatgtgtaatatagccatgttttctgcaagttaggttcctagtacttatgatagaaataagtttatctacactttcaagtattccataaatctaaccataatccccagctactctgctctttccataggtaaaacaataattaatcaagatagctcagttaacaaaaaaaaaaaaaaaagcctgacttacatttttgtttgttcatttctagtgctctttgctgaggttgttgaaacaaaattatcccactaggcattccttgttaccttaatcagttccactctttcttcttctgtaccactttttatcttcttacgaactgtataactgacttacttattatggttttttttcttgtcttttcttcccttctagaacagaagcataaagagggcagggatttttgttttaatcaatgatgaatcataaatcctagaacattgctgggaactgtatgtgcccagtaaatatttattgatttaataaaatgttattatcttatgcagcttagttcatagggatatttttcatactggcttccttgctctaaaatcggacagttttcaatttttcagggtctgagcttcttaggacactttgcaaaaaaagaacatcaaagaaaaaaaccaacctttttacatgcattcactttctaattgtagggtttgtaatcttttatttctgacagacatcgatcacctcactctcctaagggggtacaagcctgaacctacatcgaaatccaaaaattcgtgaagagaattcattgttttggtatttctagcacagtacaggagaataactcacatatacaaaaagggtacatgataacataactgatgtcactatgcctgattatcaagttactttcatgcatttacacctaataatgggaaggaaattttgctatattttaaccttcatgacacatccacatcccattttaagtggactttggggtcttttgcttctttgtcattaacaagaactatcctatgcaatataaacatgtacatacttaaccacacaaatacatataaataaaataaacacaaaatgtgtgtacagtatgaagaaaaacagccttagaaagttgctttattatttatctgtaatgtttaatctttatgaaattgtgtgactgtcatacaagcacagttctaagtctattattaccatgtcctcttaactagactgttatctctaattccctttcatataaaaatgttgaagacatcactgccaaggaattattattttacaacctacaaatttgaagcctagcataggaaaaaattataatagtgtacatcaattcaaccattttcttgactattgggtgtatagtcatctggttgtttcttaagatggcttaatagttgtgtatatatgtatgtgtattttctcatcagtaatattcatatgattgctgttacagaatcaaatataattttgtttctcaagccaaaatcagtgtatagtgaccttaagagtaatagagtgttaaggagcaaatgagaaatctcagtaaagctgataaaacaatcatctccctttgaatttacttatcagcctctgtcatgcaagaaatgttgttgttagataacatggaaaagataatagttacaagagtgagatattttccagcttagtttttagctgatatggcttatctctgttaagaggattctgaagttatctgcactgtatgttggaaatttctatttcactaatacagcaggataaggcgattttccattcaaacattgtgagtgcaattagcagcagcttttccagcgcctcagaagatgcccagtataatttaaggacatgtttcagaggcacaaacaaggaatcaagaggaaagagagtttacgtgttttcattttggaggactgagattaaaattacaatgtgtacatacactaagaggtatatgaaaatcacataaaaggagaaattatttgatctggcatttggaaaattattaaaaagcagagtaacagcaggctataaaaatgatcttgtttgcaggcaacatttgtttttgtttccccactggagaagttttggatgttcaattataggcctcattgcttcagtgttattttcaactgaaatgtcggaacttggaaaagcatatctaatgtgcaaattaagtttattgctgctcatttagttgtttattcttcgtgatagaagtctttattataccagcattacagagtggcctatccattttctccagcagaatgatacgggtctaagtttactaagagaaatgcccaagatatgtagataattggaggcttcgtggctctagaaggcagtttgaaggatttgaggtatcaagctcagctttattgacaagcccagtttgattgagcagaccaaaagtacactttcagagaaatgacaagatgtattggaatacatttgtcatatcgtagtacttgaaaacaccagagaagtctccagcagcactaaaatctccccaaaaatgttcagttccacacgccactttcctacacagaatgactgaaagcatttcaacagaatgaacatttgatttaaaaattagtgatggtaaaaattactttcaaggtgagaaaatatataaggagttattatactggtcagatgaaaaaatttcctgttccaatattgaaagtgatgctgcgtgaattattgaaacgtgaatactacaatctcttcaagtaaaaatgtaaaaacaagcaaaaacacgcatcaatttaagcaagcccactaagatcaatgttgtcttggtcttcatgaaaatttagttcacaatcttttttaaaatgcagcatatgtcactcagattaaattaccacatatgacatatagctgtgttttttcttaatgtatattttacaaaatataatgtaaaggatagatgttaatacagcataggttttaccacttttttcaagatatttttactgcatagtttaaacctattattggtcaaagttttgtttaattttgataaaaatagggggtgtatagctagtggtttatgccagttgaaggagaccagacacagaagagtatagaactcttactaaagtggtcaatacacagcctctggaattatattaacctgccattactaactaacgtggaacttgacgacttagtttttatggttattcatcttgttttctttattattattattcattactatttgttaaatacattctctgtcctaggcaccatgataggttctttgtgtatatcatctcatttcaactttcagagtaatgctttgaagcagatattattatctcaattttatacaagggagattgaggaataggttgctaaaaccacttgcccaaggtccctgcattagtaagtggcagaactttagctttccttcttttccatcttccaacaaatgtacatattaaaaaatgcatgagacaattttacatcgcattgttcaaagtctagcaggaataaaagtatagtaacatgcagatattagtacttcctcctaaataccgcagccttcattcattagagtgcaattttatatgtacatttttatatgtaaaaattcatttgagtgcaatatttatgtgcatttacattttattatatgtaaattttacataaatgcacatttatgtaaatgcacatttatgtaaaatttacatataataaaatacataaattttaatgtatattcactaaattttgaaaatggcatttgtaacccaaaacacacaagatatagaacatcattatcatccaacatctagaactttttttatgtcacttaatccttgttcctactacactcctagaagcagctactgtaataattttctcaccatagatttcattcaaatgctaccttatattgtgtattcttttgtgtttggtgtcattcatacagtataaaccactagctatccatctcctatttttattaaaataaaaaaacacttcaaccgatacgtttattctgcaggtaactaaatgcatatatacatgtatgtatatataaatctcaaactattaagtctttttgatctttagtttcctgcccaaacctgcaaacacttgtgctcacttgtttcttgagtttttagttaagaattggaaatttagtaaatttaccttgactctattctgaccgtaaaagaagcaattaggctactcttcttcttaggcattctctctctaaattagctcagtggtcacttatgctctagggccattttttttttttttaggaataaactatgtcattaagatggaaaagacttccccagaagcaagctatgttttcagtctctggatcctgaatactcaagcaagtagttaccaaatgctttcaagtccaaaagaggaatggggttgaagggcgtggaaggggaaaaaataatcacatgaatcaaacttagccttatcctctttttttgggttttattttctcattttgactccctcatcccaacatgaaacgttcagaagaaaatatcatttgtattaacacctattgacaggcacaataaaaatttctactttcatcttctacaaaactacaggctgggtgtggtggctcatgcctgtaatcccagcactttgaaaggctgaggtgggaggattgcttgagaccaggagttcaagaccatggcaagaccttatctctactaaaaataagaaaaattagtaaggcatggtggcatatgcctgttgtcccagctacttgggaagctgagatggaaggatcacttgagctcagaaattcaagattgcagtgagctatgatcatgccactgtactccagcctaggcaatacagcaagatcctgtcccccaaaacaaaaaaggtacagaagtcttctattgtataattcgctacagccagcatgaagttactattggagaatagtctgaatgaacactatctatttataagaaatataaatatgatgccataaatatgtagtcactgcctattatgtactaatagctttgaaacagagtagttgtcatatctaatttattacacagaatctacagagcatgttctgtttaaatagatgtcaggccctgctttgactatttgttaatataaaagatctgtgtttacattttacaatattatttgctagggaaatagggtaacattgcatgttttctcatttagacatctcaacttttagacaatgctttctctagactggtttttcacttgtttcttttaatctggggttctcagtagtcttttaatatttattccaaaccatttaaatgttgaagtagtaaataaatgagtaatggtacctgaaggtaaattggaatatattgaccatgattactttatgcattgaaattaaattttactctgtggtgaaatatgataaatgctgcatgtagattttaatctgtagatacacgtgtgagcagataatcatgcacttgtctaagaggatataaaacattttagacttacggattgtatttgcaaaaaggaaaagcttattaactaaagactaaaaacaactcctttatttctggcttgctacacctggagaaatgaagaccccatcacaccgatttccttgttcgtttgcctgcttttctctgtccaaggtttatttcagagtattagctttgattttcctgtgtttgctttcccttcttttgttcgtttgcttagttttctacggacttgccaacaattcatttcccaaatctatctcaatagtctcccttcaatatcagcctgccctgtgtgttgacgctccattgcctaactccatgcctttctgtttcttaacatactccttcactttggttgattaaaccttccagtggatttttgagaaataatccaagagatatacaatttttttaatctttcatgtttgaaagtgtctttattctgtgtttacattttattagtggtttagtttgaagtagaattctagactggaagccattatttctcagaaattttgagccgttactgtgctctgaaagcctaaactttgttgatttctaatctgttgtttgtgacaccttttccctcttgttctctagaattctgttttctccaatgtttgacaatttcaagataatgtgtcatgttttaaatctgttatcaactattacactgggcatttggcaggctttgtcgctgtagaaactcatacttcttggtcctaaaatatctttctgaataatttaatattttattccattccttctcctaaaagccctgttatttaaatgttatattttctaaactggtagtctagtttatggttatattcatctatatgtatgtatataaacatacatgtatattctatacacattctatatattctatatacatgtatgtatacacgtattttttttctttttttctctcttagtcttcattttatagctgtacctaccctttgtatctcatccagttttatgtttctaaatattatctataagttaattcccaaactcaaatcaagctaattccagctcagatatttctcttcaatccccaaattcaacagcctattttatcatcttcacttacaaatttactatatcctaaccttgaactcctgattcttactccccaaacttgtttctactgtcttctttctccactatattaatgacagtctgcactgacagttgtttagaccaaatccttgagattatttttaatttttttctttcatttaaaccccatattcaattgccccaaaatggtttcagcttcaaggtacatacagaatctaaccacttctctccgcttcaatgaccaaactttaagccatgccatctctttcccagagtattgctatagcacagaatggctcaaccaggatgattttgtctcccaggggacattggcaaaatatgcaaatatttttggttttcacaactgaagggtctcacccgaccccatccgctgccttgcaccacacacacgctaaacccacaccttgacacacacaagaaaaaattatttggaccaactgttgataaatgttaagcttggaaacccagtaatagcttcaaaagcatttgtcctaattctttgtttcccttctagaagctacaatgttgctattaaaatataggcaagattttgtcactcttaggactgaaatcttctaatggttcttcagtttggttttgttccttttgttcagcattcctactgatgtataatttggaataaggtaagggtgcaatactaattaaatggttttcaatagatgattgaataaacaattagtacatttctatgttaggaatctctacttctgtccaaaattatacttatttctttctctaactgacagcaattatcatactcttcaagctattatctaaaaacctactgataaatggcctaaatatttttaccaatacacttaatctattatgaaacattaataataaaggagaataatctgtcttaactagttgaagtaagcttatcacaccaacctcccactgatgttcaccacaaatattgttaaaatatttaaaaatgaacaaaaacagttttttcaaggaattgtgacaacagccaaggtgtttgcaacatgaggtgcagaagcctggagaaaacaaaagcacagagaggttagccccacattccctgctgtttttcttctcagaaatttgtcaattcctaagcagtataaatcaggaatgaagaaaccaatcagaaagtagaaaacatctcagcagaaattttggtagacttacagtgaaagggagacacaaatagaggttcagaataaaccaaatagaatgaagtctgctaagcagctcaaccttgagtcaggacatctgaaggactatgtcctagtaagaaacaaaacaaaataaaataaaattgaccaggacttaaaatgactaagatccagactcaattcatatcagtttcggaccagcttctggctctttttataattgcatgcttgaaaaagtaaatcttcccggtacaaatataacactataaaatcacttacatttttgatccacaacgtctagcattcaataaaacgttactaggaataactggagctatgaccaaatgaccaaaactcagagaaaaaaacagataatagtaacaggtcacagcgatagaaatattgaagttctcagacaagggctttaaaataattttgattaatatattaaaagatagatgacaagatggagaatttcagaaaggaaatggcatctgttaaaactccaatggaagttctagaactgacaattgcaagtgctaacattaagaacagaatacattgatttaacacaaggatagctataacagaaagaggattagtaaaggggaggatgcgtgaatagaaaatgtctaaactgcagcatggagagagaataaaatgggaaagacagaaagtatcataaggaaaatatggaatatagtgaataacttttaacatatataaaattgttccaaaaggagcagagaggacagaaagaaaattaggcatgagcaatatttgaagaaatatttgccagatactttttaaaaactgaaaatgataagtatccaattcaagaaattatgtgagtcccaattcagacaaatgcaaaggaaagcctagctaagcacacagtagcaaaactaaagggaaaaaaatcagataaaaaagatacattaagtcaaaaaaacaagactagcagttgatataacaaagaaaaaaggaacccagaagaaaatgaaatgacatttttaatgcgctaaagacaataccaataagaattctatccctatttaaaaatccccccaaataaagacaaaataaagatgctttcaaacaaacaaaacctgagagaatccccatcacttaaaaaaataaaaatttcatatatttaaggggtacaacaccttaaatgtttgacctacttatgtgcaataaagtggttactatactaagcaacttaacttatgcatttcctcacatagctgcctcttttgtgtgtgtctctgcgatgagaacacctgaaatctaaactcttggaaagttctcagtatacaatacagtatttatgatacagtatacagatatatatatacacagataactgtatcattgtgctgtgcattctatctctagacttatttgttctacataacaataactttgtacctttgaccagaatcttcccattttcctcacttttgtgctctcagtgaccaccattctagtatctatttgtatgtatttgactttttttgatgccacctataatttagatcatacaggatttttctttctgtgcctggcttacttcacctagcatagttcttccagattcttctatattgttgcaaatggtagtatctccttcttttatagagctgaataatatcccattgtgtacacatgtcacaatttatttatccattcatccactgatggacactaggtgatctccatatcttaactatcatgaatactgctgcaatgaacatgtgagtgcagatattcctttgactattgattttattttctttggatatatatccacaagagggattgctgggttgtatggtatctctatttttaattttagggaaccctccatactgttttccataatagctgtaccaataaatattcccaccaacagtatgtaagagctccctttttccacaccctagataacagtcatctcttgtctttttgacagtagccatcctaacaggtgtgatgtgacatctcatcatggtttagatttgcatttgcctgatgatttatgatgttgagcacattttcacatacctattggctatttgtatgtcttctttggaaaactgtctatttaattcagtttctacagttggaaggaaaaccatgtatatagaggaagtaataaagagcaacggaaaggactaatatcttaatatgtagcgtaatttgagattctgaggaattcattagaaaaaagaccaatttttaaaggtatttatttctagacattgcaagttaactagcaagagaaaatatgagagaattttgtcacctatttgaagtgctatttatatactagtttacttaatattgatttcttagcaacattttctataatgtcatagataaataaaggaagagccccatgtttgtacaggaggaagagtttgataatttttcttacacttttgtctatcctttgagaggagtttataacttcagcaacaccttagcagttattattctgaaaagtgacattgataagggtttcaactgagttgaaggaaaaaaaaaacaaaacaaacaaacaatattttctgtatggtcaggaaagatgaattatacatttaactgccatccccttgcttctaaaaatgtagttagagatcatgaaaggtaagagtgtatttatttggccattgatatagagaagcagtcccatttttaagtgtttaaagaaatcacaataaatggtcctgacataagttttgatgtaattagtcttcatgtctgctggggtccccgtaactaaaatgcattctggaaacatcattggctattatgaaatgtgaatttcagtaaggctattcatcaaaagcgtcacatcatatattctattactcttcttaagaataggactgctagatgaagctgtttttatataataacttttagctcactgacagagattgaaaatggtaaatattaaaattctgtggttttacaaactcttcatgaatgattgtcatttatatttagggcaatcttcaaaaagtggctagttcttatgatttcagaaagtgaatgagaaatgttcctccctattctgtatgtaaatattcactctcccccaacatgttcttccttttattattgaaaattgcaagcacacacagaagtagaggtgatagtataagaaactctcatgtatacatcactcagagtcaatagaaggcaactcttatcaatcttgtttaatctatacactaacctacttccacaactccaattatctggaggcaaatcccaaacctcaataatttcacccacaaatatatcagaatgtatctttaaaagattaaggaatcttctttttaatataacataaaaccagttttcttatggtaacaaattattatttctaaattatttagaattcaaatttccataatagtctcataaatatgtaagcttatatgtgtatgcatgttaaataaaaacacatatattttatatgtgaatatatgacatatttatgttgtgtttaatcctcttcaatcatgaaagcaacatttccggacattgtttctcagaagtccttatataccaagatatacttccatttctatgtacgaacactgtatgtatcaagaaatgttacatggattaaaaatattccatactctaccaaatgtaggaaaccttgaattaaataaaattttaaaaataaataaacttacttttaatgacaaaaaccgcaattacttttgcaccaatccaataaataagaattcctttcatttaggaattctcagagcttttaatatgttaaaatgtttaagaaatgataaaagtggagataatatacagaattaattacagttaaccttgggactccatctttctttcttgaagtattactaaccaggaacacttactggatataaatttttcctaaatccacagtattagagaatttcagacaatatattttatatttgaatgtttcttaaatagaaatttcaggttcaagttttaaaaactaagggaacatttgtcaaagcatggtctctggaataactatatcaaaatcaagtggagaagcctgatgaaaggacgtattcaaggtctagacacactgaatcagtatttctggtgcaatatgaggagctcacgttttgaatgcatgctcaggaaactcttacacatgttaaaattttaaaaccactagatcagacttcctacaaatggctaaggaatatgcaagaagaatagcatgacatgaaatgaaagcgaataagtaaccctttgttttgtttgaaaagacttaaagaatctcaaatttttacaaacgatagagtctagcgtagtcaacaactttcctcctttttaatttgttataattcaggccctaaagatctcaccgatccataaataccgagaagtgtttcagtgtcgatgagcctcgagtaactgcagctactctactggcacatatgcactcttaggaagtgagtagaatataggatctgagtggtttgaagaaatctctcagatgcttgagtttcttaagaatttaaggtgtatttgatgaggaattaatggactgaagcccctcttctttccacaaagtagcatgaacagttttgcatatttcaactgtgcaagcaccaatcttccagtccctgcaagtgtgatttttgtctctgtggggtactcatgttagtgctggggctgaggctgcacatggctgtagaatgaactctttgagagagcaatcaatggcctcatggctattagacagccatctgcacaggatgaggacaggtctgcctgtggtgggtggagaggatacagcagttaaaatgttcttgtccaagcacctcttcacccacacaggaggctactcccaggaggaactatgcatcccctttttctggataataagcatgcttatgtagagctacttcttttcaaatacagtctatttttcacactgcagataatggtatgtcatcatatcactcctctgcttcatacttccaaagtttttaactttttcagcaaaaaatgcatttctaaaatttttaattgatgaatagtaattttgttttatgtatttgtgggatataatgtgatattttgatacatgtttacattgtgtaatgattaaatcaagctagttaacacagccatcacttcacatcctatcatttttttgtgatgagaattaaaatcctcattgggtaattttgaaatatgtattacattaactgtagtcaccatgctgtgccgtaggtctctaaaacttattcctcccatctgaaacttagtacgctgtgaacaacatctcctcattccccatccctccctcccaccagcctctgataaccaccatgctactctttactatgctactctctactatgtaagaatatatttcttagcgtgacatccagagctggtttcatggacatacaatccagtcacacagagccctgtgctgaggaagtccccatgtttgaaatattctgctgtgactgtcttgaaattcttaatcattttacctctcaatttgtgttttgtacatactaaacacaaattgagaggtaaaatgattaagaatttatttgtaacctgtgtgtgcatgagctgctgctgctgctgcttcaccatacccacatgcatatgtggcagctcctgcacacacaagttcaggcttaaagacccagcagtcggcatgcgtgcacagcagttggtgtggtgtgcaggtgtgcacatgcttgcctgggtagtcatagtcctggagtcctgagggcatgggcacatcagaacctgggcctcttaaagggatggagataatggtggtagcagccatagaaacggcagtggatggcagcaaaggctgcaggaagcgacttcaaaagtagtcaacaggaggatccaaggtgggaggccagcttgcccatacctcgccggaggctgtctctgtgggatttgcaaaaatattaactctccatcctgagcaccagaacagaaattgttagtgctcaggcaataaactttgtcaataaattattgcaaaaggaaggcatacacatggacattgcaataaaatccacaggcttagaaatagaaattaaacttaaagattattccagtcaatgataagaacattatttttatatgatgctttggggaaaccaataattgatgagttttgctttgtaattgaagatacaaaaatggaatggtaaaacaggcattttgaactatacgaaaatcatgaagtccctttcaatttcttgtacaacctccacaagttacagtgtatgtcagaggaaacattaagattccattgcatacatttatatttaaaattaaattcaggctttcataaaacagatttgtataaagagttaaatctttttagaaaaatattggtgaagagaatcatcagctctagatatttcaacatttatatttcagtgtataattcatcagaaacttctgaatgttactacagtctataaaacagtcttaatggtttcataaaagttgcatcagagaaagatactttgcaaaataaaaacttatcaaaaagtatttgtgatcttgcatttgccaggagtgactgatgtcactgaagttatatcaattgaaaatgaagttgctaaaaatataaattctgttgatctagtaaacaattgaccagaaaagtaatggagaaaattatataatcaatcaagatataacctcaataaagtattatttattatatcgtataaaattatgacaccaaaatcatgtattttgtaatttgtaagtgtatgtcatcactcatctatgaatcataccctaattttattttataagttataaattattttaaagcgaaaagctttgtatttaatacctttaatgacactttttcctctttttcaaaaaagacaccccacgctttcattttgcacttggacccacaaattatgtagctgaccttaatgacgtttgtggcttatatcctgaccaaggctatcctccagcttcatcttcttcgctttcactcctctattactctgtgtttaatcctttcattttcagcacatggttgcacggagtctgccgatcacagttctttttcacacagtttctctgtgaacgctcttgcctgcgcaggaaatctagtttcctctctctacctgctacctttacccagctcactactacttgccttttacttctcagcgaaaacagttctttctccataaactgatcccctcaggatttgccaaacatttcaaacaagtcacttctagtatatggtgcttatcacacattactgtatagtaactaatatgattggattcatgctagcttccttttgtagacgttcatctctgtgaagcaacactccttatctttttgacttgctgcgggtttttttttttttttttcctcattttcttccctatcttgactccagtacttagcataggattggacatacattacatgctcaataaatattagttacaaatgagttaactagtgaaaaatgtaaccattataagtgatgaaataaacatttcttattcataaagctttcatcattattactgtacaacaatgagctatgtagatagggaataatttgtccaactttgccactatgtggtgtcataaatggaaggacttgctgtcatttttaatgtctgaaaattactttaattgcatgatctaaaactttaaatctgggcagttttgctctgtcaacacatccagttagccaacttatcctcctataaatgtaaataagacatttgtgattttttttttcagagtaactacaaaaggaaaatattttctctagttctaaaaaattttcttggatccctggatatcttttttttttttaaggttcaatcacactttattcatttatgtttttaagttttttaggtcatacatttcctcaattcttcatacattttatttcagtcaattaaattacaaaacaatacaagctttttaaattcaaagtctaaagtatataaagtaataatgattccctctctttctcttacccttcaacttcaccttgctaatgtaacaaacttaataatttaatgtgtatctttttttattttctactagtttattctttgattagaatccaataagatccaaaaaaaagaaagaacccaataagatccatacatggcagttggccaagtttttttttaatctattggtttctcctccatctctcttctttttctttctttttttttaattttattattagtatactttaagttttagggtacatgtgcacaacgtgggaattgaacaatgagaacacatggacacaggaaggggaacatcacacaccggggactattgtggagtgtggggagcggggagggatagcattaagagatatacctaatgctaaatgacgagttaatgggtgcagcacaccaacatggatccctggatatcttttacccttattttggttgcaaatctgtgaagaagccttggaattaagaatgggcatagtccacaaaatcattctttaaatttctccttagacaaaattagaatataaagtgcatgcatctggttaggtgcagtgattaacgcctgtaatctcagcacttgggaggccaagtcaggtggatcacttgatgtcaggagtttgagaccacctggccaacatggtgaaactctgtctctgcaaaaatacaaaaatttacctggcatggtggtgcgtgcctgtaatgccagctactcaggaggctgaggcaggagaatctcttgaatctgggaggcggaggttgcaatgagctaagatggcatcactgcactctagcctgggtgacggagcgagactccatctcaaaaataataataacaaaagtaaaaaaaagtacatgcatctaatataaatatggaaagtattttaaataataaaaaatgaagacatatttgatacagaatgagtttgattttctctattatattcatattcagaactatagcgtgtgtttttattttttcatggctcttttgtcagtatgtaccttaaaaccccaaattattacttcctactttctacttctaaatatttatgaatgaagaaaacaattaaaaatgtttaaatggtcaaataataactaaacattctattggtaaaatgcagttacacattaatcattgtgaacatataaatgcaatctcaatgttagtttggtttcttgagcagaatgaagaaggtagaagaaagtgaagattttagtccatttcttagagagctaaactttatcttataaattacccatggagaaatagattctccatgggtcatttcactatttttaaacttcttcatgtataattttttttttacaataacttgcctaaaacctttattcttaaatgtaaatctttcaaaacaatttattcttggtaagatggtacatatctaaatccaaatatttgtccagggccccttcatagatattgagttgctctttgatgaattctcaactctctggaatcagaactttattataaacgaagtagtcataacgatctacattgtgagtctcttttaatctgaacaaatataggactctcaagtacaactggcacaccctgggattgtcctttgaaattttggtcaatgaaatgctaggtcttgtaaaagaaagattgacatagagaacatttctagagggaaggtttttatgatggatgcataattttaacactggaaaatctgaattattaaagggaaaacttccatcttccctattcatgttgcatctttaacaaaaagaaaattagagctacgtcaaagacagaataattatgttgcattcaccctcttaaatataaacgtatgtctaaatctctatagaaactatggtggtcataatcttagaaacatggtttgtctcatggtatatgaagttaacagagagcatttagagctgttaccagtgtgtcaattgtaatgttatgactaaaatgttagaataaaatataacaaaaacaatgcagtgcatcctgtatatatggaatgccattttttgaggtctacagttttctgtaaactattttcatataaggtgtgaatatatttttaattttagtataagtaataagctacaataataaatacaagacatttaaaaacaggcaaaggaatatttcatactggacattgtagaactccaggttgcatttatataatttcaaatgaatgataaagtattcagaaatatgtattttataaccataggctagcatttcataagctttaaaaaataattttttttctcaacagagagaactgtcattaccgtcccaccttccaaaatggatgttacagttggcgagagtatagtgctaccatgccaggtgtcccatgacccctccattgaagtggtatttgtatggtttttcaatggagatgtcatagacttaaaaaaaggagtggctcattttgaaaggattggaggagtaagttactgaaattgttaagtgcttaataaaatgaatcaagtcttttacatgaatcaccatttttcatagttactctctccatctttatttgcatggataatcactgactgtttttgaagctacatttgtttttgttttggtttattttgtttcgtgtcttccgtagaaatacttgttttctagatgtaattataataagggggataataaaagggtttagatacaagaaatgacaatgatactagtatatcttttaatttcagagttgttttatgtttcgtatttatccagctgtaacaataaagtaggacttgttatatgggcttacgtttttatccatttctccctttctgtctgcaggaatctgttggggatttgatgataaggaatattcagttacatcattcaggaaaatatctctgcacagtacaaacaaccctagaaagtttatctgcagtagccgatatcattgttagaggtaagcataaatggtgaaaaagtgatcacattgtttcttcacagttacagtgttcatatctaaattgtagacctctgagaaaccacaccatgttatggaagtgagatgtaatcagatagagttttattttttaaaccccaggactccatggtatgggtagtgtgaatacagacatggaactgtgtgaatacagacatggaactgtgtaggatttgactatcatgaacggtcacgcttggcaagcggtgtcagtaactaaaacttagacataccttctgtttataataaatcattcttgtcaatccagagtcaaatccacatgctcctgtagttcttcatattagctgcaattacttgagttagattttaagaggaattaaagatgatggttctcaatctttgagtataggttgatatgcaatcatcctatgcctgatattttctaatctccagaggaagcactactacattaatgtcatttaccatgtaaagggaattaatagaactttatcgctaataatgtgctataaatacattatggtcaatattttacttcctaagcacaacaggtaaaaataaaccatcctagtaccaaattaatgaatgtaagtatctccaatggagtcatgataaaacatttttttcaaggtccaccaggtcctcctgaggatgtgcaagtggaagacatttccagtactacttctcaactaagttggagagcaggcccagataataacagtcccattcaaatatttactattcagactcggacaccattttctgtgggttggcaggctgttgctacaggtgagtgacaaaagtgttttgggtcactttaaaaataatattttagtccaataattttaataaatgcaattacattttaaattaataattatataattttgtacaattatttgtttttgagtagtcccaacctaggtgccttagtgtctcattctttttagttccagaaattctcaatggtaagacatacaatgcaacagtggttggtttgagtccttgggtggaatatgaatttcgtgttgttgccggcaacagcattgggattggagaaccaagtgaaccatcagaattgttaagaactaaagcatcaggtaaagaatcaatgtgttctaaaagtgtggaagatttcgtatgatacagttcttaaaacaaaacaagtatttttatgtgtcttctaatacttttggctcaaaattgtttggcagtaaacgagtggctctcattttcttttatttttacatacacaaggcaaggtgtattttctccaaatagtaggttcaataagaaatgattacctttaagccaacatgtcaaaatcagagttcttaggaaactgtgtttgcatcgcatctattttctagtcaaaattcattagagaatctgtagatttgtatatgcaaatgagttactgcttgtttcattaaaatgttgtagccaggaattaactgagactctgttggtgcagtcagccatatattttcatctatttctcaactctgaactagttgtagcttcactgagcagtagtataaatttttttccatgcaaatgaggtaaatcctaagctcatttaacaggggcactaattgagcattaattggttcactgaacagcagaacgcaagaacctggatcagataccatgccttcttaagctcttttcaatggatcctctttgttccactcaaacttttacatccagggtgacatttaatctgctagctgtatatagcccacaaagttcacattcttattcgatcacataaacaaaggatcacttgtcatggctagcttaatttaacaaacacaaattaccttattaaagtgtgcacaattgtcagaagtcaataaatcaatccttaaactaaagataatgttatatgtttatcatagaattggggctagaaaaaggacatacttgacagtgatatcatccaattaaatcacgctagaagcttacagctgagaggaaatccctttgttttacagaagaggaaaatgaacaccaggatattagctggttgtttgtgacagagctaggttttgaatccaaacctcctgatttttacacccagcattctccataaaagaggatcttaatgtagatgagcaatagattagccaaagaaagtgtgtaaatatagaaattccccggccctcctatataccccctggatcagaatcttcaggtgttgtccatgactctggatatgagctttagtttcaggttgtttgtttacagttgatttatattttggtagctttggacagggttgacagaaactcttacattttcatagcaaagtttgtgtgccaccttctaaccattaatactctcttgtttcagtagcagaatgagactggtgatattcatacccactgagtcaaactctactaactgaaaacctactgagtctctcgtctctccctctctgtctctgacatcatcaaagactaacaacttgttctcaatatggttttaggcttaagtacaattaatttaaaattgaatagggaaaggaattttctatttctcagaacattggaaactttgtagaaagtaaatcaaaatataattcaaaatacttttccttacacagctaaactatgcaaagatcctgagatagtgtgcagttagtcactctaagctgtcaagcactataaattcagcaactctgtaaaatccactctgattcacatcgcttttgatcaaaggcattggaagtcttagaaaataaggtttaggttcacataacttctttctaaaaaattatgaagcttaaagctgacaaagttaagggtaaatttaaatacgaaaaggtatatctgaaaggtgcaattttgaaaaagaacaatcagattatcatatgactattttctggtcatgtttatagagctaaacatcagtatgaaatggaaataaataaaataagcaatctagatttatttaggtggtctatatggtggggaaaaatttgaaatgaggaattaaaacttacatattttaatccctgcctaccaatccccagacatatccaagtgcctcctcaaccaaccacctctcctattgttcagacatggtccagtatagacaatttcatgtaattccacatttaaaaagtataccctgctgatttagcgattatcacagatttaggatacttttgtcattacgtcaagaaaaataatgcttttaaacacttacgcatgtgtaaagtaaaacctcattctcgtgaggcactacaataccatatacacactcagcatttcctcagttttacagtttctatgatctattattcattgtgttagtccttacaaggatacagagttgaagggcatagttttttaaaactcatcaaaattactggtttctgaatcctctaccacagagccttagatcccaagaaataaatagaaagaacctctcccagtcgcattcttgacaggagaaaaacctgactttgcaagtgaaaagttagaagaaaatccctcttcttctctcccgagagatttgagattgtaacgaggagttttaaaacaagaatatttatttacatatttttcagtatttaattttaactggtaaaatatcctgatgactaataaaaggaaaaattagtttagtttgtttattgaaaaaaaataattaatatactgcctcagtaacttgtttacagctcaactgtataattaggcactaaatcagcagtgtcactgtcaccatctgaatggaacatcattttgccaattagtagatgatgcataatgatgtcaaatacccgatgttactcaatttttaattaattttggagccagggtgctcatgtatcaaacacaactgtgtcctctctcttagaaatttggatatgtgtaaacataatttacgttcattaaaaatgcaagactctctcacagtatgcctgtgtgagattttgaaaagtgaaattcaaaaacaaaattcttcctgatgaagacgtactttaataattgccatcccacatttctcttggttatttttagtccctgttgtggcaccagtaaacatccatggaggtggaggaagtcggtctgaactcgtcattacgtgggaggtaattttctgtccaactgagttattttgaagaaaagagatttaactggccagaaagaaactgaaaaacaaaaagatttatttgatcactattgagagcgtaaaaaaatatggtataaaaatacatcatcctgatgatgaattatttagaggaggtattaggaacttttctcatggtgagacagtatgacgaactcagcacaattttctcccaaatacacgaaaaacaacttcagtatctattgagcgtgtgtcagtagcattttcgttatcgcttgatgaattaggcattgtttgatttgttacctgtggcactgttgtattgtgaataagttgagcccagtagactgtaggcaaaaaatagttcttgtcctaaccctgctgttcacctctgatcaactcattcttccctgcatctagatgaaagcttaggcacatggagtagattttgtggtcattcttattacccattaacatacaggctcatttttttaccttattaaaaatttcagtctggtgtgtacacttcaaactggagtataaacgttagaatttagactttcaaccaatttaaagtttctcattttcagtatctcagtgcctcagcctaagaattctatagcgtgaaagggaatacgtggtcagttcaacttctctccattctgctctttaatttatctttccccattcacagtgttacctctggattctccagagctgtagaaggttggtgttggtaggggaggagaaaggaaaaggtctggattgctggtacatttctcgtttgactttggtgtgctctagttatggcaaattatcagacgctgccatttcatagggtagggtttctgcgttttttaatttattttttatctgggagatggccactggatgatcccccaccaaggactcccaactgcaattccttggtgcagacccaactggctgctgaagggtatcagttcctggattttggtggtccatttccagactcttccagtgaatattctctctcttgtaggtggtctttgtggatagagtccccttgaaggctgtccatggatgacccacttgcatgggtttcacatttgtcctcagcagacacataccctgctccatgtttagcggaagtgcaatgcatacccacttagcatctctcttcactctgccaccgtgggctgtctggatctcttccccactttaaatttctcagacatttgtcagttaaatgaacctgcgtcccttatgttccaggaaatgcaaaccaggtgtttcttgctgtagcctacttcacatagctaggctatgagagataactgggaaccagagacgttattctttatggttataaatgacagtgtcagaaactagatgcaattgccctgaaagtcaccctttcctctggatatcttgtttcatgtggacattataggcctagcacagtgcttggaaagtggtccaccctccatgaacacttgttgaatggaaggtagtgttttcagagagttggaactctcagaggccagacagagggggaaaccctattttttcaagcatttacaggatttcaggtgccacacagagcatttcatatcattcagtccccacaataatgctataaggtggttataccactttcaagtaagaaaactgagacttagaaaagtgacatcattgggcagagaagcatttgaacacagggttctctctttctgttcttttactgtatcctgtattacaatcccaattgtcttcatgcactgtgatggctgagggtgggcctgagtccttgagtatatctaccttaagtagtaagttaaccatattatacctactactccaaacatatttcccataaaacactgactttcaaatgagtctacaagagaattgtttgtgagtagtttatttaggtttctatattcatcaaaggccaaataagcattatcatcatagtgtacaggaagttttgcctgacttaataacttattttgttctcctccttggtaagaaattcctacaggctgttgttgcaattgcttgtacacagtctataatgagggcccaaatgctatgcattcattcttaaatagagatgagcatgaattaccaaagaatactgtctttccacgatttataatgttcttttttctttaaggcaaaggtacacaaaccatgacctatgagacaaatttgtctagtttcctgttttgataaataaatccacccatagctacatccattaatgtattgatgctttcttgctgttgcatgagaccatatatcccacaatgcttaaaatatttactatctggtagcaacaatagacgctagcgtctgctagagtgacgagaggaagggcgagggttgaaaaactagctatattaatgggtactgtgctcactacctgggtgacgggatccatcataccccaaacctcagcatcacacagtatatccatgcaacaaacttgcacatgtacccccgaatctaaaataaaagttgaattttttttttaagtttactctctggccctctacagaaaaagcatactaacccctatttttaaaaattaaactaaattaaagccacttcctctgtgtttattttttcttcctgaggaggaggtggggggtggatatctgatatgcagatacttgcagaaagtaaattagtgaaatcggtttcccatttatcactcatatttgacattatgtacaagcagatactgagccaacttcttctggtgcccagcttctttatggaataagttatgtatatttaggagaagattcatacattaggatgaatctgagccaccagaatgcaggtagtaattccttcaatttaatgaactctattaggtagcttctctgttcctatcagtggaatacaaaaatggatgagaaaaggtctgaatgctcagaagcgtagaggacagaatggtcttaacccagcctggaaggaggtcaggaaagacaccatcagaactgagtatatctgaactacgttttgaaaagtgacttggaagtagagaggccaccccaggtcaatgtcactcctgttgtagttgaaatagtacctgttggactttgaaaggcactgcgcgacacaagactgttctaagttcagtcacaatctgccattacgtttcataagtgacaactttaatgattatccttcatttaggctccctgtggtataatctgcctgaactgaactaaatatctttcccgtgttttccccagagccacacaataaatgtagattttttgtttatttgttttgatttggtttgtttccaaaaacctagacataatatcaaatttttagaatatagcaatgggtaattcctttttaagggcatgtttatacattattttatcataatgtgtatactcccaaatacttccaggtttgaggtgcttgtggtgaatgtctcataaatattactataaaattaggtacacaggataaagcactatagagtaagagatacatacctacactgagggttggcacgctttttatttaaagggccagacagtaaaaatattcagtctcgtgggccacatgacctcttttctaatgtctcagtctgcttttgtagctcaaaagagccacataccacttacaaacatataggtgtgggtgtgtctcaaaacctttattttcaaaaccaggctgcatgccagatgtggctagaagtacatagttttgctgattcttagtctgtactaaagatttggttcttacagacactgtggttgagaattacattattagtttatcaattttcatagattttactcccaggagaatttcacaatttctttattttactgaacactgtctccacttaaagaaaactctttttctggccttgttaaataactatatatattttttaatcatttgactctctgttgatgtaagaataaagggaagtatctaaataagtctcttttttcccctctaatctgcatatgttggactcaggtctttcttgagagagcaccatgagaaacactaattgtacttgactaacaaaaacaaaactcccctatttatgtagatgaactgactaagcatcgtgattaaatccgagatgaaagaaacttcagaaatgaatcaaatgctctagcaagtagcatcgattcttataaatctcttccatgccattcaaaattaactggtttacttctagtctccctatgaaaaagaagagaagtgttaatatgaggaaatactttgttgtttccccagatgtccggagcagcacttttcttcctcttttcactttctgtatttgttagactgttccacatggcaagaaatagagaccagctcaggtcatctcgggtaatgggggtttattttaaagctacatgggaagtaatgaggacaggaaaaaagtctcagcaagcaggcaggaaggtcagatgaagaaccggaacatggttcatcactgctctgggcactcgggcacaggagctctaggcaaccatcaacaacccctctgctgatccagccccggcttgaatagtctctcatgcttatgcctcagttcctcccatttcctttacttccagttttctacctggctgccagctaatttggatgccctctctctaatttacagcatctgttttctcttagcttctattgcctcactgttcctgctactccatgttctctactttttgcctgctctgtgtatatctatcattgttttgccacccaccatgtttcatatgcaaactctgtgagaggaattgaccaggtctgttagtcaccgtagagtacagagattctgccctcatagatactcaccaagacggtgcctgtggttctggcgctcgtgaattggtgctcgcatgggttccaagtggcaagtagatagtgtgattgatagaataaatggactcccatgaataaagagaacctctgaaatggagttgtggacatgagggactagaagcactgtgtcctgtcaggtgttgcctttattagtctgtcagaatatttattaaaaaaaaaaaagcaaagcattttccttgggaaaaaccaaataaattccattgatttttcaatacaagtttcttgccatcaggagatatgttggtctaaattcaagtacagattcattttaatttgctaagtttatgtgattgtttacaatttttagtatctgcagagtacagggggaatattaccaatttctattttgctattttagtaattttagatttgaaatgtattttatagaatctgatctttgtgagagttaacagtttattctttcatgtgaggaaaaatgcacacatgtcactaccaatgaagatgtatgcctaaaaaaatgatgggaggtcttttatacttttttaaagaaatattctgtgtcttaaagcatatgttatttcacagtaattccattacacatgtcttacaaaaacttgtttaaaatgttgtgaaaggaaaacatatctagtcttgaaataaatagttaagaagttaatttgtgctgagtttaaaaattcatatcaaaccacatttgagtgtgtatcataaaatcttttaaactgttttattattataatttatgaatgatcaaagaaaaatatataaatatgtaaagcttgttttatatttctatctgaaaacttaaactatttatctgagtatctttaactgggatcatttttctaattggcattccaaataaaagtgttttttaatacatcattaaacagaataaatatccatatttgtctctatggaagaaatgtgaaataatcaataaacattatagtagcttaataaaatatttttgcaaatactcagtgattgatcacattctgcccaagtcaattccagaagaactgcagaatggggagggatttggatatatcatcatgttccggccagtgggctcgacaacctggtccaaggagaaagtgtcatctgtggaatcatcaaggtttgtctacagaaatgaaagcatcatcccactgtctccctttgaagtcaaagtgggtgtgtataataatgaaggagaaggatccctgagtactgtgaccattgtctactctggggaagatggtaagttgtcctcaactctggttttctttgagactctatgcatagtttgtgttcccttgttccattttcaatgaaccactctgctaaagatggttatgtctttctctggatggtagaacctcaactggccccaaggggaacttctctccagagtttttctgcttctgaaatggaggtttcatggaatgctattgcctggaatagaaacactggaagagtgctgggctatgaggtaatccacattaatttcacttttgcttatgaatgtgccaatggacttcgcaatagctcctattcaacagtcctatcctactagcctgttgttagcatatgataatgtgtgtctaaagctaaagcagagaatgaagttgagacagggtaggtgagcccccacattgagaggcttagcctgggatgtttcttgtcctcgctcaagacagaattcgagagtgagccagtggtaaaaaaacaaaaacaaaaacaaaaacaaaaaaaaacagctttattgaggcagcagtgttacagttttgaaattgcttctgcagagcagggctaccccataggcagtgtgctaagagcagcagcttggaagcagttctacactcatatttatacccacttctaattacatgcaaattaatgggtgagttagttattcagaaatttctagaaaaagggtggtaacctccaggccattgccatagaaagggatggtaacttccaggtgttgccatggcagtggtaaactgatacggaactggtggttgtgtcttatggagaggtgctttagcctcttccctgtttcagtcagtcttcaatctggtccacagtaaagtcctgcctcctccctcaaagtaagggaaatctttctaggtaattcaaagcaaacaaattaacacatagtagccatttttaaaggcatacagattcagtaagtaagatgagtaagctctaaagatctgctgtacaactgtgcacacagagtcaacaattatgcattgtacccttaaaatttttcaagaggacagatctcatattaagtgttcttaccacaacatcatttttcaaaagtgatcaggtgattatatgattaattattcaaattgcagtcatttttttttcccttggtaagaggtgaagtctgctcctcaatcatcttacaccatggaagaatttcattgagaaacctgctttgtgaattgcagtataacttggaaagatgtaatcatctcagaaaaggcagttaagtaatgaaaaaaaatacctagattgtcttgaatctgctatttttagtctatgaagaataaggcaaattacatttgtaggccttcatctcacaaagtaaagagacaagaacattttaagggaaagttgttcatcactcaatctttttcaacttgcaaattcagtgattcacaaaatgggtaacataatttatttaactttggatttagaataaatgtataatcctaaacattcttaattttgcctatatatatatatatatatatacacacacacacacgtatacatatacatactatatatacacacatatatatacatatatacacatatatatacatatatatacacatatatatatatatatatatatatacacacacacacacacatatatatatatatatataaccataatcctctgattccaacagaaagttctactctcaggacaggtgtcttttccactccatgccaagaatgccttacctcttatctgaaccctagttacttctcaaatttcatccctagtcgcctcttctctctgagctctactcccatcaattcctgatgtattttgtcaaattcttgtagcatattttttctataccacttctttgcaatgcattctgtgacttattttcacatacactgtggattctaacctcttagctagatgataaggggcttgaaaataggtacttaatttattctctttttttttcaatgtacctaaaacaatgctaatgcaaaggtagggttcagtataaattgaattattaattaacctgtgattcaaataactctgaaaagaaatgccaatagcaagacattataatgaaagtctttgactgattatatacaaatgtgtttttgtctgacttgttatacatcatttgctaaagctggtaacctttagatagctcataaaatactttattttggtaatctaaaaaatcacgttctctaatttccattgtgaatttgcattcatgacttttttcctcataaatattagagaataacaattttgttgttgtataaccattttaattagaaaacgtttttgtcatctatacttctgtcttcttcccatattccttgtggttgtggttgatagttgttggtaaaaaatgattgatagttattggggaacaataaattgcttgttttggtttttaattatcaggtcttatactggacagatgactccaaagaatccatgataggtaaaattagagtcagtggaaatgtcacaaccaaaaacatcacggggctgaaagctaataccatctactttgcttccgtaagagcttacaacactgctgggacagggccctcaagccccccagtcaatgttaccaccaaaaagtctcgtaagtatgcatacactccaggaaacaagattcatctgtgaagagcaacctattcctttgcttgatgttcatttcattcccacacctcatttctttactaattggttactttggttagttggtttgtcccttaaatatggatacttgttgaaaccttttggtaacaatcaaggtaattgttttcatatttctggaattccaaaagaggaatattccaagtatatcgatgaaagacagaagagcataatgtttaagactggccctgacgccctccttctaaatgcattcaaaaactgacctcctatccttggaacgttaggtggtatttatctttgagtctcagttgcctacctataaaatgaggaaaaagtcatatttatgttttcataggttttgttcaagattgaaagagattattaataataagtgtccagtacacaccttaatatatgctcagtaaatggtttttttgttttgtcatttgagtccgagtatattcacatgtgatcctacaactgtcagacacctagatctttccttttaggataccttattactacagcttacttggaagtccctgaaatctaagaatgaactcttctgttttgtcttatatcccctgataatcagccaggtgatttcacagaatcagaatctgctacataaaagatgaatgtttttcatcttttggtgattgttgctgcctttattttctgactgagtctggtaatgcacaaatattccataatacgaggcacagcaataaattgggaaaggtctgatcatccgacttagttgttcctgtaagatgatttttttgtggttgaataatatttacatattccttatatattattaatgaacacaaattattcataaaatcagactttttaaaacacatttttttgctctctgaatcctgatgaatgaaagataacaaatatagttgctgaattttgagaaagactaagacaaattcagtgccacttacaaaaatctagtttacctatacatgccgtagtctaattacaccaccatatttggaaagaagagatggttaagaagagtttgaaaataaagttatattaaagttattccccttatgcgtatatatgcgtatatttgtcatgtccaaaagaagttagttaggaaccatctcagagaataggcccttgattaaatagattatccagttatttccacacaaccagatcaactgtcagatattcatgttccaattctgggtacatcattgactcacaacttgaaataggacaaggcattccatttttttgctttcatgttcttatctatttattaaatagaaattatctctgtcctcactccttcccaaattacccatgaagcacaaacaaggtactgattctggaagcatcttagaaaatacaaagtgctgtggaactgcaaaagcctgtggagcaaaaatttttgaaccaaatttcctccagtccacccagttttagacaggctgggctgtgagttattttcaagaatggattagttaacaatgaagttctattccttttcctgttttactcaatgttgactaaatcaatgaagttgttgccagataacttggatgtatgatttgcttctttggtcttcctggagtggtttagcttctttcagctaatctgcaaatccgaatgaaaatctccaatcaatcagcagttttcagattacctagacatttagttctagttgactgagagatgccaaactcacagaaactcttgtgtgtagggggaggagccaagatggccgaataggaacagctccggtctacagctcccagtgaagacgcgtgatttctgcatttccatctgaggtacccggttcatctcactagggggtgccagacagtgggcgcaggtcagtgggtgagcgcaccgtgcgcaagccgaagcagggcgaggcattgcctcacttgggaagcgcaaggggtcagggagttccctttccaagtcaaagaaaggggtgacggacgcacctggaaaattgggtcactcccacccgaatattgcgcttttcggaccagcttaaaaaacggcgcaccacgagattatatcctgcacccggctcggagggtcctacgcccacggaatctcgctgattgctagcacagcagtctgagatcaaactgcaaggcggcagcgaggctgggggaggggcgcccgccattggccaggcttgattaggtaaacaaagcagccaggaagctccaactgggtggagcccaccacagctcaaggaggcctgcctgcaactgtaggctccacctctcggggcagggcacagacaaacaaaaagacagcagtaacgtctgcagagttaaatgtccctgtctgacagctttgaagagagcactggttctcccagcatgcagctggagatctgagaactggcacactgcctcctcaagtgggtccctgacccctgacccccgagcagcctaactgggaggcaccccccagcaggggcacactgacacctcacacggcagggtatgccaacagacctgaagctgagggtcctgtctgttagaaggaaaactaacaaacagaaaggacatccacaccaaaaacccatctgtacatcaccatcatcaaagaccaaaagtagataaaaaccacaaagatggggaaaaaacagaacagaaaaactggaaactctaaaacgcagagcgcctctcctcctccaagggaacgcagttcctcaccagcaacggaacaaagctggacggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatatagagaagtgcttaaaggagctgatggagctgaaaaccaaggctcgagaactacgtgaagaatgcagaagcctcaggagccgatgtgatcaactggaagaaagggtatcagcaatggaagatgaaatgaatgaaatgaagcaagaagggaagtttagagaaaaaagaataaaaagaaacgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaacggcagccagagagaaaggtcgggttaccctcaaagggaagcccatcagactaacagcagatctctcggcagaatctctacaagccagaagagagtgggggccaatattcaacattcttaaagaaaacaatttcaacccagaatttcatatccagccaaactaagcttcataagtgaaggagaaataaaatactttacagacaagcaaatgctgagagattttgtcaccaccaggcctgccctaaaagtgctcctgaaggaagcactaaacatggaaaggaacaaccggtaccagccgctgcaaaatcatgccaaaatgtaaagaccatcaagactaggaagaaactgcatcaactaacgagcaaaatcaccagctaacatcataatatgacaggatcaaattcacacataacaatattaactttaaatgtaaatggactaaatgctctaattaaaagacacagactggcaaattggataaacagtcaagacccatcagtgtgctgtattcaggaaacccatctcacgtgcagagacacacataggctcaaaaggatggaggaagatctactgagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatctatgcacccaatacaggagcacccagattcataaagcaagtcctgagtgacctacaaagagacttagactcccacacattaataatgggagactttaacaacccactgtcaacattagacagatcaatgagacagaaagtcaacaaggatacccaggaattgaactcagctctgcaccaagtggacctaatagacatctacagaactctccaccacaaatcaacagaatatagatttttttcagcaccacaccacacctattccaaaattgaccacatacttggaagtaaagctctcctcagcaaatgtaaaaggacagagattataacaaactatctctcaggccacagtgcaatcaaactagaactcaagattaagaatctcactcaaaaccgctcaactacatggaaactgaacaacctgctcctgaatgactactggatacataacgaaatgaaggcagaaataaagatgttctttgaaaccaatgagaacaaagacacaacataccagaatctctgggatgcattcaaagcagtgtgtagagggaaatttatagcactaaatgcccacaagagaaagcaggaaagatccaaaattgacaccctaacatcacaattaaaagaactagaaaagcaagagcaaacacattcaaaagctggcagaaagaaagaaataactaaaatcagagcacaactgaaggaaatagagacacaaaaaacccttaaaaaattaatgaatccaggagctggttttttgaaaggatcaacaaaattgatagaccgctagcaagactaataaagaaaaagagaagaatcaaatagacacaataaaaaatgataaaggggatatcaccaccaatcccacagaaatacaaactaccatcagagaatactacaaacacctctatgcaaagaaactagaaaatctagaagaaatggataaattcctcgacacatacactctcccaagactaaaccaggaagaagttgaatctctgaatagaccaataacaggagctgaaattgtggcaataatcaatagtttaccaaccaaaaagtccaggaccagatggattcacagccgaattctaccagaggtacaaggaggaactggtaccattccttctgaaactattccaatcaatagaaaaagagggaatcctccctaactcattttaggaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacacaaatcaataaatgtaatccagcatataaacagagccaaagacaaaaaccacataattatctcaatagatgcagaaaaagcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtccaattgtccctgtttgcagatgagatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactgcaaaccactgctcaatgagataaaagaggatacaaacaaatggaagaacattccatgctcatgggtaggaagaatcaatatcatgaaaatggccatactgcccaaggtaatttatagatttaatgccatccccaccaagccaccaatgactttcttcacagaattggaaaaaactactttaaagttcatatggaaccaaaaaagagcccgcatcgccaagtcaattctaagccaaaagaacaaagctggaggcatcacactacctgacttcaaactatactacaaggctacagtaaccaaaacagcatggtactggtaccaaaacagagatctagatcaatggaacagaacagagccctcagaaataacgccgcatatctacagctatctgatctttgacaaacctgagaaaaacaagcaatggggaaaggattccctatttaataaatggtgctgggaaaactggctacccatatgtagaaagctgaaactggatcccttccttacaccttatacaaaaatcaattcaagatggattaaagacttaaatgttagacctaaaaccataaaaaccctaaaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatcaagaatctacaatgaactcaaacaaatttacaagaaaaaaacaaacaaccccatcaacaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccacttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatatggcacatatacaccatggaatactatgcagccataaaaaatgatgagttcatgtcctttgtagggacatggatgaaattggaaatcatcattctcagtaaactatcgcaagaacaaaaaaccaaacactgcatattctcactcataggtgggaattgaacaatgagatcacatggacacaggaaggggaatatcacactctggggactgtggtgaggtggggggaggggggagggatagcattgggagatatacctaatgctagatgacgagttagtgggtgcagcgcaccagcatggcacatgtatacatatgtaactaacctgcacgttgtgcacatgtaccctaaaacttaaagaagtaaaaaaaaaaaaaaaaaaagaaactcttgtgtgtaattcagtttctatctcaagcaaaatcaagagtgattagaaatgtgtaagaaacaaacattaaaaaaaaaaacacattgtatcatggtagactgacagacattttagtgcagttattgagccaagactcaggtcaacttttattatacataatcccatcaaccagtttaaggtggattgaaacttgaacactgaactaatcatttacctcaggaagagagagatatatccatatgacatatataatacctatacatgttttaaaattcttattgagattttctgtatgatatatacatatatatattcacatctcactactaattttatataaatatataaaagtgagtagccccacactcccttgacctcaagggcagtctttgaagcaccttcttccctgctattcttaagcactgggtggatctgattgcccagatagggcactgcctttccccaaggtcacacagcaatgaagggggacagatggaggagagggggcctagatgtgcaggcagccccacacggtctcattggagtactgagaggcccaggcctcagctacataggagaactgctccttgctgctgggccagtaggtgccctccgtctgcctcatctccggaagcttccgcaccaatagtgccagccccactgccaggaacaagacagccaggaatcagaggaccaagatgatagcagtgacggccccccgaaacagggctccactggagctggagctggtgggtgtaggccaaacaatgctactctcatttgcagaaggggttgatatttgcgcccagggtcgttcccagggacgacagcagcggcaggcccagcgccaggagtagccccaggccgagctgggtgacgggttgacagtgccgaggaaggggcttctggcgcgcgcccctcctacagcatacagggcgggccatgggcacctgcaacggggcacctgacccaggtgtctttgaagtcgctctgtatatattctatatatatatatcagaacatctcagtaataattttttctgtcatctgaatttgctagtttcattgtccatgaaacctaaattaaaagtgttagtttgtgctaaattattctatgtttttaagcagaaacaaatccttgtttttgacactaaattttttcagttgacccaattgatcctacaaatgggttggacagaaattcacatcaaatgctaaagattattggtttgtctgatggttaacgtatgatcaatttgtcaaagagtaggagataaaaattttcgaaaacagttaaattaaccatgagtaatttcacccaagacacaacgttagaatacctctgctaaggaaaaagtgaaataataatcagaaattctaaactgaagattagcgttcctttaagtattcagctttcttaactaaatcaaacaagaaaaacctctgtaattcctagatatctagtttcaatagctcttaaatttgactcttaccagcctgtatgcttcagtgaccctataaaaatagccaacaagcacctgagaataagaagaatatacaagtctccatccctttgcatttaaatacctatccaacctctcattttattactttgacattctacatcacagacattgtgaaagcagaagagtaacttttctattattctattaatggccttaaactcagtgttttaaaacaatataagttgcttatcacacatttttggaggtcaggagttagacaggggtttcactgggtagaaatccagatgtgctcaagggctgcactagctttggaagctccaaaggataatttgtttcctgttttctggcttttggagaccacccatatccctggcttgtgaccctccttaggtttgtgaccccttcctccatgttcaatgccagcaacagtagggtaccttcacatctctgcctctgaccctctgcttctgtcatcacaactcctctaactctcactttcttgcttccctctttcccttgtacggaccctcctgatgacattggagccacctgaatcatccaagattatttcctcatctccagactcttaatcacatttgcaaactccttttccatataaagtaatgtgtccacaggtactggagattaggatgtgatcatgttttgggggatccttattttgcttaccacagtttcaaattattgagcacttctatgtccccagccctgtattaactttatcatactaaatctcacttaattattacaataagtcaaggagtttggtattttaatttctagataggaggacacaaatgcttagaaaggttttgtcatggcctctgttagactgatgagcatgaaatctcttcatcccactaccactgtgctcctttatcaccttcctccctaaccatcccaataatttctctccctgactgtcaaatcctccatctaaacctcaaactgctttgaaatttttcctcctaaaatgccgtcatacttctcttctcttcatcaaatgtcattgtctcctctattccagagaatgtagactaagaaaaaggcaagcaagatctttcacaatgtgtctcaaagctcctttctataacattcctcttctagccctgacatctcaaacttactgatcttctaaagtttaacattcacttacctggcttcatgaaatctctcagcttgtagtacccctgccaggcctatatatggtcaaatggtcttttttctgctctatagcttcccccaaaatttcccctttaatgtatttgcgtttttctaagaattccaataactttggcccattgtgaaacagtgttggaaaaagttggaatgggacttcagagagaattgtggatatggatccctgctcagccatgtactatctgtgtgccagatctaattatttgataactctgaatgcattttctcatctgaaaaatagagatgaagatacttacctctagcgatttctctgagaaccaaaggatataatgtacaccaaggtgacccagaggctgtcatacatcaaggctcagtgcctggtaacatgtgttattatactcctcctttagaggcaatttactttctttgcattttttaaagtaagaaaccacagctactttctttcactttataagtttgttgcagaattttcttttctttaagggtcgtagaaggacatccaaagcatgcatgaaaaacagctttactgaaacattgatgataaccatgattccaggtgctattcctgtatgtaactttgactctccatgtccttgagatgacatcaagattacctctcaatagtggtgactgaaaaaattctgcattcagcactgtcactgtctagatttgtaatctgatatttgatcttccattggaaagtctgaaaaagcagagctcacatttaccaaaatctctgcctgttctaattggctaagctaaagagaagacagaggtattttctttgtttgtttgttttctcacatgatcatccagtcatctactcaagagatagtgcctcccatgagccatgcctagagttagatgctgagggcctaagagcaattaaaccaagcaagatctttgccaaccggcaatttctcttttagagaagaggcaacctaaaacaagaaaaaaagacaaatgaataaaataatcataaattatgaaaagaacagtgaagaaaataaatgagaaactaagatgtacataaggagcatctatatgggataggctatgtattttgatacaaaattaaagataaagaggagttaaaggacaaaagaacttccagacagaaggaacagcatatgccaaacttcttaagtattattgttgctgttgatgatgatgatactagtattattaaacaaatatcagtgattcatctgcaagtaccaaagcctagtggaaatgatggatttccaaaagaaacagaggtactgcaaatatactgtgatccacacagacattacttaaatggaatttagatttacaaggaaagaaagaaaaatatttatgtcaattccaagcagaaaagaaaagtgaaacaaacaaaacactacttatgtggaaagaagtattcagacgcaataactaaaagtgtttgcaaatgttggctcaatttggcccttgacgttgactgactagcactttgtactcgattctttcttgctgcaaatatgcaatcaatccatatttaaacataaaggaagcattaagcttttattttatcttgcacttatgttctttctcttctgcccaaatgtcaaccccatgctgttacttagaggtgtaacataagaagttgtttttgaattgagttcacagtgtgaactacagttgaaaagaaatgccatctacagaaaaattgattacagggaaaccattagaattctgaggggctagtttaatgttgctctgtcatttgattaatagaaaatgatttagtctttggaaattgcctggaaagattttaaaagttagaaaagtgcttgtttgctgagtttaccattgacagacttggtacaaatatcatgacatgtgttttgtgctatccatgtggcagtgttttggtttctcaagatgatagaaattttaattttatcatagatatttgcaatccagtttaatcaactatatcaaaccagaactgttaacagtactcacattaaggtgatggccttctaaagcagctttcagaagttttatttgtcaatatcagacataaaggattgacactggagaaacatccattgataaaaataagaaaggatgtagactaagagatattctaagataattagctgagactctcccattttatctccctttctaaaaacatatcaagcatccaagtaagagcaatattattaaggggaaaacttgaatgtacactaattgtatctaagaagtgaatcatttgcaaacttcagagttggattattagcaacaaaccacttcgaacacaactgaaaaattgattatgtcataacaccacagtggagaactgctactcttggaagagaattaacagttacagggctttttaatatataccactaaccaaatgaggaatatttcatattttatttcatatctcataaattaggagttattcgtttcattttataatgggaaaatccggctcttggaagagattggatacaaattcaagtctctctgacatcaaagcccaactcttctcatctcccagagagcaagagaagtaaaacattctaaataatctgtataattggctattcataccaaggtactcactccgaatgcaactcttctcgttttatgcccacagaaagttgtgcttctgctttggtagatgaggacacaaatgcaaacatgtcaatgacaaagtcattgccaacattgcaaactgctcctttacatagctggaagaaatcaattctgtctcctagccagttgattttttcaatggatttatagtgttgaaaacaatactttttcctaaaacaaacaaaacatccggaaatacataaaacattcagaatccacactgccaatgacactgaagtggtgaatttgtattttctctgtattgattatataatggtaatgttagtgctgaattttaaagaacagagataaaaagaaaggtatcaagagtagactagatattaaaattgcaatatcctgtgagaattttgatattatatcttttatagctgagaaaaagattttaaaaggcactggaggataagttgaggaaggatagttacaaaataattcttgctgccattcagacctttagaaataaatatgttgataagcattataaatgacaagtacgttgtacattgacaagcaaagtaatggatgcttagtaagctaaaagctttcaggcctttaattatgggtttatattgtcaagaaatgtaccaggacatggtcaatccaattggcctgtccatcttataaataggtatggattgctatgagtctgaccacggcaattggtcttgatcataggacaacataatgaatggattggctgtattgtgtcacctatggatctgcccagagcccagtgcataatcaatacagcctgagaagatcaccacagggccctgaacagttttccttagccaccttattgtacagtcatttattcaacgtgtatgaattggatgtctcctatgtgccaggcactgtgctaggggttagtaatacagagttgagtaaggcacttgccctcaagaaatttaaacaaacacataaccaagaataaatgtaaaccaatgtgataaacctataataaaatatgaactaagcctcatgtaagcatacagggaaacatttctctatcacatcccaactggactgtaagtgattgagtgaacaatagtgatatcccagtggaagtggggtggaaagagaatgtatggtaatatatttgagacacctggattcagcaatatgtgaatcttccagtgacacacaggagattaaacagcagttgactcaaaactatgaaagaaatagtttccacttctaccagtgttataatgaattaaatattatgctcactcagcctcacaaattcaaaagagatgccaaaaacatcttgttgggcagttttatctttacttccactttccagatgaattattttatatctctccagtttcaatctcaaaaatagtcatgtggactcagataagcagcaagttgttctgcagaaacactagactgaaagcgctagaccaagattcgtcagctgcatgcttttggataagtgacttcccaacctggattctcgttttcttgtatgtaaaattctctagttggactatatccattactttagaagccagattctaaatctttcatctcttatctcccaccatctctcacgcagacaacattaatttcagaaaactaaaagtcgcagtttggatttaaagttgatgtcctttgggatgatcaatcagtttgtgatgattttccccttttctggcttcccaaaagctccatttattttaaacggcatgcatctttcacattgtccagacacagttgattaagctaagatagacatacgaccaaatgaagtcaatcatcagctttctcaggggaactcaaacttggactatctctgaacagaggaggttttaagtttcaggtgtggtgaacagtcatgatttctgccgtgtgcagtgagaatgacaaagaggtactctctggcaagatgagtatacagcagaccctgcttcaataagcagagtgaagactgtggctttgtgacatttttttctctcctcagactctgctgcaatctgccatgacttataagaaatatccttgataatttactacaaatattttgcttaaaatatcttgagttagttgtgttacagttagaaagctaactaatacaatgttaaaaagtaaagaattttaggaatgaacatctatgtgttgatatatataaaatgtttgcaacttgaatttgccaaacatgctcattgattgatggccaaatggaatcctagataaagagaccctctgtctgtttatatatgataaagtaaacaaactcaacagcaatgattaataaattaatactggacatgcagcaagccattattaattcataagtctgtcacaaaggcattcccaaatgaccagatttgaataaatttgcttactgtgattagaattaatatatttcaaatgacactgaagacattttagctccttctatgcaaatcatcgaagacttattttttcttttcatgttgatgcatcatactttgaccatgagctaattaacattcatttggatctttgattatctctttaaagctccaagccaaccaccagcaaacattgcctggaagctgacaaactctaaattatgcttgaactgggagcatgtaaaaaccatggaaaatgagtctgaagttttggggtacaaggtgagtttttagtttttcctttaatcatatcaattaagttactaaggaatgaaacatgtgacacccaaatggaaaacaaattggatgcatatggaaacactggaatctttttcaaaattattttgaaaataccattgctgctttctaattttccattgaaaatgttttacattccaaggtccagtaatgtattagggaacatcaataaatcaaattccataggatgtaacattttttcttcaagtggcatcccttgctatcataagatgatggcttatgtgcatagtagatgtgatgacaatgagatcaaaaaatatatctaaatagagattttagaacttaggctgcagtatgatgtgatcttttaacaacataaaaggcatctaacaagagtacaatcaagtacccagagcaactcatttccatcagtgacaatggacatcatctcttggcagacatatattcaacatttgaaatgggtccaaactcaacagtgactttccacagcaagctccaatgataatagcctcaagctatttaactaatagggataaatctactctccttccagaggcattggccaaaaaaaaaaacacctctttttcttaacaggagcaatggaatataaggaaaagacatcacttggatatttccatctgaggagtacaacatttatgatgatgtatcttatgtcttacagtgttccagaacagttgtgtgaaccttagaaaagcaacatgtccatgttaacttgatacctcattttattcagattctgtaccggcaaaacagacagagtaaaactcatattttggaaacaaacaatacatcagctgagcttctggttccatttgaagaagactacttaattgaaataagaacagtcagtgatggtggagatggaagcagcagtgaggaaattaggattccaaaaatgtcaagtaagttgagtcaccattgctgtagtagattctgaacctagacagctgcagcatgaaattcagctccatgaaaccttccagttatggcttaaatgttgggtgataagataaattttcaattgtgagcaaaaggtgatgagccatttttttaagttattctccaaaattataacatacactataaatggttttatgcttcctcatttgaaaaccaaaaagagaacaggaaaaaaaatctttgtgtcattagagcataattgtatcactcattctattatcacaaaaatcagaaagatttttcatagattctttcgggtcttttacaacaggaatggcaaatatgaagcacaggtaaatatacaccctttcccatgttcatggcagacatcactaatcaagtgtggctttcataaggagctgagtcacaactttcaagtcctcctcaaaacaattttctaagccaaccaacaccagtcagtcagagttagcaggcaataataatgtatcatttttgcattagaaaaatcacttactcatctgcctgaagctgtgattgagtgcaagtcattagcatccaatgttggccaatcctttaggcagactttgccaatttagggattttccttttgcatttttatacttaaatcagatgtccttggacaaagacacggtaaggcactttctaaaattaaatataatgtgaatgagacaagtataataaaatatgttactagaagagaaatgatagtatgaaattggggttttgaaaaattaatctaacaggcaatactttatctcaaaatatttttgtcttatttttatattttgcaggtttgagttccagaggaattcaattcttagaacctagcacccattttctttccattgtcattgtgatttttcactgttttgctattcagccacttatctgatgaataaaaccataaatctttgagagttttttgaaagcaaatcattctgtatatatgctctccagcctctgacacaagatgcgttcttaatacagacttgtttgcaaagaaaaaaaaaagtatattattaaaatcctgtaaatatctatggtatattaataaaacaattttaaacacttttgaattttaaaatccgcacatgattacatgaattcctaggtgccacattaacctggggagttgtaactgctgtgtcttttaagttacttatatggagaaaataaataactcccctcaatgatgctgatgatgaatacaaacttggctcctagttaccataactcacatgtacatttttatgtattccagacaatcacttcagtatttaaaatttccaccctacttcaaaataaaatacaattatttgtttatagttgggattctttaaaaatacaaactattccaaagcatggggtgcttttatctctgaatcaagttggaataagaaatctttttactcaagaatatttcaatatacatgatgttcttctcagcccacttttcagaagattcagtcacaataaaggcagaaaaagtattttatggcaaagaaaaataaatgatgggaaatgagcacccacctaaaataatcttctaacaactctggtatatattaagcaattgctcatggcaaagttgaacatttgaactgctgcatgaacaaatctcaggtaattatgacaagttgattgcaatgtatgtggccttatttttataataaaacaatgtggaaacagaattatttgatcaagttttctacactttggtcaaaatattattttttgccaatcttctctgcagctatgaaaacaattctacatgaaccagggtttagaaagattgtgtgggttgacttttctctagggtgagcctgtttcagtcagtgacctcacttcttaggattgtgtagtctggagaaagcagtctgggagaaggtgagattagtgacctggcccatagaatgctatgtaaccaccccccttcctccacaaacagccttgagaggtcagttcctgctgtcagccttctctggctcccagccagtcaggtttgttgtcctttagagctaaatgtgagaaatgctcacgtgacttttatcttcttaacatggtgcaacctcttaattatgttgagaatatttgagctattctcacaaccctcaaatcatacaatcctcaatatgggattttgtcatttgcatgtctgaggtattttagaactctttaaaataccccatgtagtcagcagcagatgaacaatggctttcatagttcagaacttgctccttgcctgaacagtgtgtcaagcacacaatgcaaattaatgagccttattctccccattgccatatgatctgactgtgcttttgtagagcaaaacaaataagcaacaacaaatactatttggcacacccgtgttaacagctgcctggccaagatacatctgaattgaccagagataccagtgctggcacatggtcttaatggtttccttaatttggtaagagacaagatttgtgtcctcctccccaaagaagacattgagggttaaaaatactgtgaggtttttgtttctactaattaagtgaatcagatatacagtcatttgtgtgtgagttcaaaagctaagttagtttttatcaataattcttatatgtttgcagagtactatttagttcatgatttctggaatattaaatgtctgtattcactgtctaacatatctaacatattatttatcttttcatcagttcactaaatttttcagaatatactttggcattaataataagcagcatgggctttggtgcgataggaatctctcctcttagtgaaaacttggacatatttcttttaacatctccatttcactaatatcagaacaatagagtgttatgtacataaggtatttggcatggtgcaaggaacattgtaagttgtcaataaatggagctgctgttatctgctgctatgaattaaatcccaaatgacataagttattacgtttacatatccaatatattatgaaaatagtttcaacctgtgtttatgtcaaaatccaaaccagcttcaagaaaaatgaattgatcacctactctccatactacatggcactcaaggatgaaaacagtggtgattctaataacctgtttcagggaaatgttctacatgatgtgtatactcctctgacattcaagaaggatttccagtgcatccctgtattgactgagtagactgctgttataaacatgatatgtcatttccatacttcctacaaaaaagggagataatgtgattgtacctggaaatggctggagaaggaaccagaaataaggtttaggagactcaacacagtggaaataccactttaaagctatggactgcctagatcgtgtagagttcaaacacagcttcatttttttctcttttgttcacactctaatcctccatgctcagtgtctcttttctatctatacagcagggggtgaggagggcatggctgctgtctttaaaaacaaatgcagatggtgagggatgacctggaacctatatggattctaaatgtaataacataattattacttctcataagtaaatctagtatttttatacttctatgtatgtcagtcttgagatgcaacatggagtacacactcctgtattagtccattttcatactgctatgaagaaatacctgagattgggtaatttataaagaaaaagaggtttaatggactcacagcaccacatgactgggaaggcctcataatcatggtgaaaggtgaaggaggagcaaagacacatcatacatggcagcaggcaagagagtgtgtatagggaaactaccctttataataccatcagatctcatgagacttattcactatcatgagaacagaaaaaaaaaaaaccacccccatgattcaattacctcccaccaggtccctcccatgacatgtggggattaggattatgagagctacaagtcaaaatgagattttggtgggaacacagccaaaccacatcaactccctgtgtacaattattacttaatgtgctatagaactacatattgaattcaggagatattttgttctagacaatcacatctttgttgaggtcaatacttgcattaggattctccagagaaacagagccaatagggtgtgtgtgtgtgtgtgtgtgtgtgtgtgtgtttgtggagagagaaagaaatatattacaaggaactgactcatgtgattatggagactgagaagtccaaatgcaagagagcctttgatacagttccagactgagctgaaggctaagaaccaggagggccaatagtgtaaattccagtcggagtccaaatccaaaggcaggatgaaacttacttataatctagctcaaagacaatcaggcaaagaagaataattgtttcttactcaggcttcttgtctattcaggccttcaccagattggatgatgcccacctgcaatgaggagtacaatctgccctactccatctaccaattaaatgtattaatctcatccgcaaaatccatcacagacacagctagaatgtgtaatcaaatatctgggcaccaaatggcccagtggagctgacacataaaattaactatcacagtattctttgggctgatattaaataattcaattctgctttcatcagcttttggaatgaaattatttaaatgctcctctcaatttattcatttgtaaaatcatatgttgggatgacaagatctcagagttcttttaaaactctataattttgtactaatgtgcataatgtgtgacttctttgggtataagacagtatttcagaaaccttcacaacccacacatactctacagtcctttccctttttttcccctgtgtttttaccagtcgttccgtgccttttaaactggagtttacattactaaaattgagcatgctttttcaaactacaaaagaccctcagagtttctaacccgtctctgcactccattgagaatcactggtgtattgcagtggttcccaagggcaggactataatgaagttttcactgttcagtgaaaaaaataagaaaaacatgtagagtttggtgagctattcataatgaataatttgtgaaatatggctttcctgcactgtgaaatgctcattctttggggaaacaaagttgagaatggatcacagtttgttttacctgctctgttttaaaataatttacttgggaaaagagtagattactttatatcaagttcaattatttttattattaaaaatgtttatcttctaaggaaaatgaaaagttgaaaaccactggtgttgtcatctttttaatatttctttaatctcataaccattaaattagcaatttgactttgtgtgttgaactgtagtttatatgccaaaacaccaaggttctgagttctatagaattattgtttacttatataaatatttatatttacttataaatttacttatatgaatattaatttacttatataattatattaatttacttattaatttacttatataaattacttatatacatttacttatataaatctaggaaatatggcctaccacttataacaaaacatgaatataattagattgcaagaaaaatagaatgtcaaaatcctgacttttttaatatcttaaaatatggaaattatttgctttccacttttctatgttaaaaattatttcatgaaattaaatatagttagctgttaggctttctttaatgtatttacaaatgattttagcaaaataattttattttagcaaaataatttttattgaaagatacatttatttcttcagtttttttcaaatattattgttcttaacagtgcttggtgtggtcctgggcagagaatgatgcttaaaacatgtatttgctttctggactgatttatacagccaactgttggcaatttgttttcccttggtttccttaataaaataagggccaggcaaggtggcttatgcttgtaaactcccagtagtttgggaggccaaggctggtggatcacctgaggtcaagagtttgggaccagcctgaccaacatggtgaaactccatctctactaaaaatacaaattattagccaggcgtggtgcacatgcctgtaatcccaactactctggaggctgaggcaggagaatcgcttgaacccgggaggaggaggttgcagtgagctgagatcgtgcctaaactccggattttggtgggtaaataatatatctctgaaataaataaaataaataaaaataaaatccttcgaatattgtcatttgaaaaaacatcagaaatgctggtatgttgctattttaaaacacatactttaaaatctagttagatgtgccttagaagatccttattttgtttggagtaaagctctggaggaaagctcacgcgatgactctttaaataaagatagcaagttgcagctcaatgagagtgaaaagaaatcttgatgtaaagtgttttgttccctacacccattaaagagaaggagtaagctaggctaaaatgtttgtgggtatatcatgttattcctggaactgaatgctctgttggatagaatcctattcttaagcagtgattaattaatgtttataaatcacttcaaagatggaaagcattgtataaagtctaatcatttctattatagtgatttttttccaagaagtatattgactttttgcaatagcagtttgaaaaagcatgcatttgtgactgaggccaggtatcatgcctggaggaaaatagtaattggaaagtttgaaaggtaataattctgagatactgaaaatttaggtgaatttataatagcagactattataaattagtccagtctgcatggactaaataattttaattcaaacgtgaagtaatctacatctattcatgacagttttcagcctgtgaaataaatgtcatagcaacagactgtgttcctgaaatgatatatacctgtaacaaacctcaggtaatctcaggggctttcatagtaacaataatgagtttagggaacttttattacctgtaactgcagtagttataaaaccccccaaaactaaaactaacttggaacagattcattttagcctatttttgttgacagaaagcgtaattagatatattactggccttttttccttatctgtgtaaaagtgaaaatgttgtaatttaggcatcaaaattactgttgtatttagacttgcaaacatactgagatattttcatcttctaaattcttaaaagaatagagtctatatatatatatatatatatatatatatatatatatatatatatatttttttttttttttttttttttttttttttgagacagagtcttcctctgtcacccaggctggagttcagtggcatggtctcggctcactgcaacctgtgcctcccaggatcaaggaattctcctgcctcagcctccccagtagctgagattacaggcacgcaccaccacgcccagctaatttttgtatttttttagtagagatggggtttcactatgctagctaggctggtctcaaacttctgacctcaggtaatctactcatctcagccttccaagtgctgggattacagatgtgagccaccgcccctggccgagtctacaattttctaaaagagattcctaagtccgaggacatggctcaggttattttgagtaatgtttggactcacataatatttcaaactagatgacagttgaaaaaagactgtaactagttaaggaaaatctgaaaacccacaacttgttggtgtcaataggtagacagtactcgagaggctgaggctggaagatgactggatctcaggagttcaaggctgcagtgagctatgatcacgccactgcacgccagcctgggcaacagagcaagactatgtctcaaagaaaaaattgacagaatggaaattaatattcatttaatatctgttgataacaactaagataccagatttttctacctgaaattgatattcttcatcagaaaacttcatgccttgtattatatcatgttacattaggttgccttacaccatattttattatttaattatcatatgtctcattttgttttagaaaatgaataatgagttccagaggcgatggaccttatctttgcatttccccttgcatccatcacacccagaagagtacctgacatccagtagttgctcaacacatatgttttcaatgaatatacaaacaaaagaaagtgttgagtgtgcattacttaataaaatctcattgccactcctggaaaagtggcaaagctaacctaaagaattttgtcttttgtaaagctttcatattaaaatattatattgtttttgccttattatttttaataatttatcatgggggatttaacacacttttaaacatttttatcatcttgttattattgctcttttttggggtgtctttacttgggggcttttattaattttattttattttattttattttactttaagttctgggatacatgtgctgaacgtgcaggtttgttacataggtatacatgtgccatggtggtttgctgcacccatcaacccatcatctaggtttcaagccccgcatgcattaggtatttgtcctaaggctctccctccccttgtcccccacccccaacaggccctggtgtgtgatgttcccctccctgtgtccatgtgttctcattgttcagctcccacttatgagtgagaacatgcggtatttggttttctgtccctgtgttactttgctaaggctgattgtaaaacagtataattgaatatgacatacagttgatgcagcactctctgcatataaaatattttaattttttaaagctttctaagattaaaataaattttaagggtaatgcttttttaacagaaaataccatgtaattttatgagagtttcttttccttcccctcaaagatttttaaaagacaattctcaaaatttgtataaacatggctattagaattgcataaccaagccagagagcaacatccatggtgtcacagaagccatgaggatcattccaaggtctaagttgcaattattttccctgcagccgaattaactaaagtctatacccttgatcatacacataacaaaatgtaataatcttgtcatgctacaatattaaatccatatattcagccaggaagatatttttagttggcagatataacacaaacttatgacttcccctttttaggtgctacttctttaggtcatactgtaagattcactcagttttatttccaaaagctcaaaataactgatggatttgctgaaaatttcagagaaaaaatagttctttggcattaaggaagtggcaaactttcagtacaaggtcaaacaggttagatgtcatcagtgcctctttacttaaagatgaaaacagctgtcaatgtttagatgtcagatttcatgtaaatctcactgtccttgaaccactctcagtctgccttccttcatggcactaagctggtgaactagtgagtaagtcttctcttcgagagggagcattcttctctttaccatgctcctttcccagctttcataatccatttatgaacctatctggcccttttagacatttgagttttgacccttgttatatatgatgcaatgtacctagaagacaatattttatggagtcattgttttttacaccatattaccttatgctcatttatatgaacacctcatttcagctgtcatgaactatgagcatttaatgtaagaaagttgaacatttacataacaagaaaaataaaattataatgataaggaattcatcttgtaaaaatatgtatttctttttacattggggtcagaaacatggcaactactcatggaatagatacattcacatttataattgatcaaatctgtcaagaaaacattacttgtttaccatgttctatgcattgcacttgactctacgaaaaaaaaaaaaaaaaaaagcagtgaagaagagaaacatgccaccgaggtgaggagcaggtaataattaagccaactcttctcacttcaaaacaacaatcacctgttatgataagtgctgaggaaaaacaaggaagatgctctgatagaggataaaacatggggccagatgggtaccccaaactggattggcagatggctattcttagagaaatatcatttacagagagacttgaatgatgcaaaaggtaggcatgttaaaaacggagaaaaaagtattccagacagaaaaagaaaaaaagtctgcaaatgccttgaggagaggaagagcttggtatgttctagttactcaaggaagtctggtgtggatggaagatggagctgaaaggagactgaggcatgagttcacagagccaactggaacctggtgatcctgaaagttccaggtcttcagaagtaacttggatttaggttttaaacattacttatgttttaagaagatcactctggttactgtgtggtaagtggattgccatgtgtcaaggagagaaacgaagattctaatagtagtccttgtaatagatcagtggtgggtagactagtttggtggcaggtaatagacctgtagacttgtcaagaattgcccattgatgagatataaggagagtgagggatccctctgaatattttaaagctacctttattttatcacatggagaataccagggaatgatcattcctaggaatacagaagatagggtggtagtcaagattcagtttgggacataagttagagatctctatgagagatctgggtggagttgttaaagagacagatctggcaattagggtcaaggagatctgggtttccccagaagttctagctcttttattaatgagcaacactgacccttgacttggaaggtgacatttgaggtgacctacttcactttatgagtctcaaatttttcttccatataatgcactgctttgttagaggaacacttacattattattagtactcaagcagtataaatgttggacattactattttatgacaagaactctcaaactgcaagatactgagtcagtcattgaaagagttaaattcagattaccatgctggctttattaggcttaagagtgtttttgcctttaagatgttcagaaaaaagttaactataatatacacaatggaatactactcagccataaaaaagaaggaacccttgtaatctgtgacaacatggatgaacctgtaggacgtcttgttaaataagccaggcaccaaaagacaaatatttcatgatctcactaatatgtggaatcttaaaaagttgatctcatagaagcatagagctgaatggtggttatcagaggctggggtgattgtaggggaatgcacgtgaagagttgggaagatgatggtccaaggatacaagctttccattaaataggatgaataagttcaagagatctgttgtaccacaaggtaactacaattagcagcatattgtattcttaaaaatgctaagtgggtataaagtgttctctccacaaaaatgatagttacgtgatgtaatgaatacgctaattaactagatttagttgttccacaatgtatatatcatttaaaacatcatgttgtgcatgataaatgaatctaattttatatgtcaacttacaaattttttaaagatcataaaaaggaattaactggaaaactccattccaaaattaaattggtcattaagattgaatactgataattaattcagaacaaaaagattgttcaggtgtgaccaaattctaaaatgagaaattaacaagttttgttttttatccttgacttgattctaaaaacagagttctcaaactgtaaactcataagcttaaagtaaacttacgatttgctggtccttggcatttttcttttgcacctttagaattttgcttatgctcctttttctgcatggaatgttctctttcctttttctgcctggaatattctctttcccttttctgtgtgaaatattctctttcctttgcctggggagcagcatcttcagctaccagctccagtgccagccactgcactgctgagacttttgctgcagcccactctcctcagaccactctcgcattttactcagtccctggagctccctgtgtccgtctcagtcatagcatttggcatttggtttctcaaccgttggtttcctttcctgcttctctcacttgatggtgaattaattggggattgtaaattcttcagcactgattattatgctgggaacgtagtaggttcctgagatgtatataaggtgattattatgctgggaacgtagtaggttcttgagatgtatataaggtgattattatgctgggaacgtagtaggttcttgagatgtatataaggtgattattatgctgggaacatagtaggttcttgagatgtatataaggaagacaaataggcagagaggaaaaaaaagaaattcaatttttgtttgtttttcagcaagtctgactgtattttgccaatcacatattttagaataaaatgaatcaaaatacaaaaacatagaattgtaatactaaatactctagtttgcctgaaatttttttctaatatttataaaaagcacaccttgaaatatcttgaaataagaagaaaaaaacatattatcaacacaaatcttttattagaacatttcaggcaaactgatgaacaaacattttaagatattacgataagtggctccatatgaattattttctgggatttgtagtacataagacaactctgttggctttgtgacagttaaagaagcaagtttttttctgtaaactgatatttccaggcaaacaaaattccagcactactgcctcctttgtccagaagacaggttaatacccaaaggcaaatgatttaggcattttcatcaccaagatcaatgtttaatttcttcacctaaatagattcctctttacccttttgacctacctacagagtcttgtcattcagcacccctagaatcacagagttgggagggttcttgatgggggggtaattctagctcttcccaagctgcagtctccagacaggatgaaatatgtgtccttcaaggtacagacattcaccagtttatgaataaattgtattgtcttaagaaatctgtcatttagttgttgggacacacgttcactttgttaatagaaatactgctgaaaacagttttttctgcagcctgtaaaagcctatttatcttataatggattgacagtgtagcacttcatggtactcaagaacccaatcttaaaatgaaaccgcgattcaccaacaaagcattttcagagttctggctttgcttatgggaaaaacatcttcttccaacataccagcaacttgacagtagcaacaaggactccacgagcaacaaggactccatgacagcatatatggcgtctctcatggtgtaggacaggaaccccagtaagacaagagtggagaagcagaaacataagatccaggttgtaggaattaaagaactgtaaggaaagaaccttccatcgtgaaactcactttatcaggtgatcagctttcatccacacgccatgttcccactcttctcaggaactttccagtcttatcttcttctgttactttctcttttaataaccttttaaaacccatctagtatcactttactattagctttttgtgttctagcccaagaaaattttattctctcctactgataagctgggcctccatctcaccacagggcctttgcacatgctagtaccttttcctgcaatttctttttgccctcaacaatgtattcttgctcctttcatctggttaattgctattcattctgattaggtaaaactctatatttctccactgcaccaacattattcttccctaacacttatcacagctatagtttatttatttctgttattctccaattaattcctataatttccaaacaatctacaagatccatgaggataggaatcctattgtattgggttgatcattgattgtatccccagtacttaacatagtgctggcacctgggaatctctcagtaaatgggatttatttagaaacaagtgagtcacaattacaataaatatctaattaaataaacataaaattttacattataaaataaaaagttaataacttaatgacaattacttgtatcttctcttaaagactcctgtccataggactcaatttaaagctttaattatgctactttttcctcaaaaccaatagacagtttttctcatgttttctcatcattcttacagcactgaaaataataggaaatcagaaaaatttccattaaattctactttgaatgcctccttcaccttacctccaatctatacttttttcattaacccagttgtattagtctgttctcacactgttaataaagacataactgagactaggtaatttatacagggaagagatttaattgactcaccgttcagtatgattggggaggcctcaggaaatttacagtcatggtggaaagggtagcaaacatgtccttcttcatatggtggcaggaaggagaagtgctgggcaaagaaggggaaagacccttataaaaccatcagatcttgtgagaactcactcacaatcacgagaacacatgagggtaaccaccttcatgattcaattacctcccaccaggtccctcccatgacaagtggggattacgggaaatacaagttaagatgagatttgggtggggacacagcgaacccatatcaccagtggaatgaaggtggcaatatctggcatgcataactctgcctcctggtgatccttagaatccttcttcacacaatcatgcaggcaactactactaattaattttactggcaccatgaaatgaaattgatttacaattccttaaagaggtaaaataaaaagtctcctttctgtttacagcaatataaacttttggggaattgtgatgagaacttactttctaattattggcatttctccagctccacccatacattaagaacagctttaaattgttccatagttttgttgtaaaaaggtaatcttggaatatccaggtggacccaatgtagtcacaagggtcttaaacgtgagagacagaagatgagtcagaatgagatgatgtgagaaagtccacaggggccactgctggccttgaagatggaggaaggggacacagcccaaggaatgtgtacagcctctagcagctggaaaaggctagaaaatgcattttcttctaaagcctccacaagagatgcaaccctgccaaaacctatattttggccccctgagatcccttttatgtttttgtaagctgttaagtttgtgacacagcagtaataggaagcaaatacagtgagtttaagaaacttgccaagttcacacagtgaatggatggttagaaataaaaccgggcagtgtgttttacttagctatcattttatttaactgtcaatgtaaaaacaaatacgtgcatgcacacacacacacagatgtatatataaacatagcataaatatacatatatatgtatatgcatacataaatgtaatatgtgcatatatccatgtatacacatatatatgcatgtgtcatttccaatgttgtactgcctcactaattttggtaatttgaaaataatacatttctatggtaatacaagagcagagatatactcggtatcaaagtggtactaaatactgtttatacagcctgtttcatgagatgctgaagatgtactgtaaacagtaatacttacacgaaattaaagtctaccagtgttatccttgggctgccaattgattgtggttcatggatttcatttactttgtgtgagtgcatcaatgttcttttaaagcgcagggagagtttacaactataatttttactaatgattgctgataggtttttcatgatttagatatcaggaatcttgaaatcaaaactaatagcaatagacaagaagtgataaacagatacttagaaaggtataaggaaacaagagaagggcgcttcattacaagaatgagcttggggagcaggtgtgaccagagagtgtagaagctgtgctaaaagccaggctttgatgtaacttggaggaagtatttagaacagttagagaatagccacttcctagagccagaaagaagacagatcaacttgtaattccattattttccaggtggatgatactgaaatgtatagttaacctctctgagcttgattcttatctctttaaaaagcacattaatatctaccgcaggaggctgttgtgatgattaagtgagccaatgcatgtaaatcacctaggattggtagatgttcagcaaatattatttcctttcttcctccctgctgtctccattgattctttgctaccatgctttaaggtcatacatcctgaaatttgctgccatcaaaggatataatatagttgtttgcccactttttaaataaagtaggttaaatgaatttattttcttttattataccacctctttgggcctttcttattgaactatgcattatgattctttgaggaacataacattatataatagaaatcacttctcaattttatttttcaacaatttttttcacaggaaattacatgagagaattgacatgagactagttcaacaaaacttatcacaagaagctcaaacttaaagtaaaatcttggaatcaagcatcagaatacatgagtctatagttctatcttcactgttttgtggttgagttgagttcaaaacaaatatgtaatgttttaagaactttgttctacctccgttgtctcttctatgaagagttttgaggatgaaactgcaagcagtatgcaaaagtactatccagagttaaaagctccatgcaagcatgagattattattacgttcttttatcatttgacccactatttgttccacaatgtgaaaggaatatagctgattgctcccaaagaccttggtaggtcaaagtaaagaaaagtgcatattatcaggccagaggccacaaggtgtgagactggatgaaatgaacacaatacaatgatctctgtgagaaaataatttatttcaaaataaatgccctaactctagagagctggtagagtttgggacatgaggtacacaggctcttttaacattttcattgaattttcaagcattgttatgtagaccataataatgcacaaaattcttcagaagaatacctggtctcataacaccctccatcttgttgagaagctacatataggtctcttcttttctctgagattcagtattggaaatgtttagagagatggtgggaggattataaattaacagatttttatagttaaaaacatttccaaaaatgtggtctgtggaatatttaaacctagagaactcttccccccaaaaaaattattccacgatcaatgacatttaggatgcatggctctatcccccctctaggagcttcacaaggcacttgaccaatctaaaaactcctggaagtcctgaagtaatgaaaaagattaccttgttctaatgcaatatgtccacaattatttaatcatgttaaacattatttgcaagaaacttacaaaaatttcaccagataatattccaccaaacctgtgggggaagtgccccatgagataatatcccaggtccccaagtcctctaccattcctggagtgtatatggttccccaggagggtgcaggaaggacttggtgcctctacttctacagccttgagaccttcttttataatagtattggtccgcccccatggagtcagtttgtggctggaagtacagtttgcacgattagtgtgcggaacacagtgtgggctgaacaggctggagggaaaaggctgcttcttggggaccaatttttagaagaaagtgcctcctctgtctcagcccttaccaattcttcttgccagctgtggtgtctgtgtttgcccactccagggggattacacattcattttatgtggcacaagaggctgagaagaaaaattgctggcatatgagacacctgtgacatttggggtaaacacaattacataaagccctggtttatgggcttgtgtcatcactatgggaggatcaccttctccctcctccaatggatgggagacctggctataagcagcagaaggggactttataggctgttagacaggcttgacatgggctctgggggtcttccagtcaggatttgcctacccacgcaaagtgcaaaagagaaataaagcatttaaccagaaaattaagacccaaccaagtcacaagaagttgattgtagcaaaagcaatgtacattggttttttctaataactgttgacacataaatctttaattgctaataatgtattgcttatgcactctgctataccatatatatatatacatatatacatacataatctcatttatgcctcacaataatgctccaaggaaggcatttcttatactggttttacaaatgagaagctgaagctgagagtgaagatacggtttgcccaagttattacatacaggaagatagcagaccagaaattcagatcaggtcgagtcaactacaaaacccatgttctggaaccactaaggtatggactcttcctgttctgcatatcttccttgtgttcctccagatcgattctccacccttctctgcccctctttttgtcctaggaggatgatctgcatggattatttttataagttccattttctctggcttcttgttaaatgtgaccaatagaggtcactggcagggttggagggggttcctttaactgactctattctaccatcattgcttttctcaatgcagctaattctatgtaattttctcgctcatagttctggtaaccactttcttctcttttccctttgaaccaagggttgtgtgttagattgctcacagagatagctgcaattattattttcattgttgtataaatattcttttgtaatgagactttgtttcttctccaatataggagtggagtctatttccccatcccattaattagtggtgttcttatcccttgctttaaccaagagaatgtgacaaaagtgacattttccatacgtaagttccagaaccatggcctcaggaggccttacaatttctgccttttcctttttgaaactttaagatcatcgtataaggaatcccagttacactcgagtatgaatgaccacaagatgggactgccccagctaacagtaaaaacaaaacttcagtgatgtgaatgaggctacctgggacctttcaacccattcaatctgccagatcactgcacttacatgtacaatctcaggccaggctagcaggagggctgcccagatgatcctagcctaaataactaaatcacagaattgtgagcaaataaatgttttaaaacactaagattgggaggtgaggttgttatgcaatagatgactgatacagttgttcaactgtcttatgcttccataagttcattttgttcataaatccccctcaaattatctgatttcatgtctaccacctggaccctggctgatacctccaccatgacagtctgataattaatcgaagacttatttgaaaaaggattaccataggatccatctccccatgctcctgaatccatagacgtgtttctctaggaaatcttaattaatagttatatataatagttacttggtgtctggtgtgttgcttacattatcactgcaaaactggaattaagtattattatcatcctattttacttacaaaaaagcagaaatttggagataaaatacttaattaggtgcagtgctagtaagtaccaggctctgagttcaaacctagatcttcactttactccaacacttatgttctttccacttcgtcaaactgcctcagaaattgaaattttagttctaacagctaaccaaccatagacctcgagcacaaactctgtcaacttaggaatctctggatgtccattccataaaaggtgttttgaagctgtaatttcttctctcagggaataaaggtcagattagtaaaagcatattttgacaccatcaaatgaatgtaacttatttggccttcaaatgtagagatgtcaaatcattggtgtagtttcctaataggtcattgcctaatgtttgtgcagtttcatagtaaatctactctagaaatccatcttgtagacccccaggagtaaaagtagatgttcacaaatagagggggaagtagcctgtgattctttttcactatactttctatatttaacatttacgtttcctgtaagaggctccagagataaagaatttatgttaacataggtctctgagggaatatatcatccgaagtgactctagcagattcctgagtatgacaggagcaatactaacttaaggatttgtgctgaagtaacaggcagcacagagcagatgaaaatatattcttgtgacagagcacggaccacattgttaaaggccagttatagaggctatgatgataatagaaacttttttttcttcctttggagagatagcatagatatggcacagtacatcttaggtttggacgctagttatgatgtcttctcattgtgtggcatgaggcaagtaacttgtaacctacaaatcttgttttctttcactatgaaaagaaagaataacaatgacatcaacttcatatgctattgtgaagattaaatgagacaatgagtgtaaaaacttacttgaatacctagtatataaaataaattaaattgttctttatcattggtgtgcctaacacaacaggggctttacacttattgccccatttggtacttccccattcctctatggtgaatatattgtccatttctgtaactgaggcaagttacctacccaaggccttgctgccagtataggtcaaaattagaacttgctttgtcctctgactaaataaaaatcgatctttttcctccacatattgtttccctgcatcagtctgcctctccctggatggtgcatgcatgtgtgtatgtgtgtttatgtgtgcgtgtttaagtttgtgtgtgtgtctgtgtctgtgtgtgtgtgtgtgtgcccaatccctttcatagaaaaagcacagccatcataccacgcacttggctgggggtggggggtgggaagggggcttgtccaacagaggggatgcatttgtcaaaatccatcctctcctatgtgcagtgaccccccacacattaaaataagagagccactgcaggaagctggttccattcatagcttcagaacagagggaagataattgggctatgtagggagtgagcctatggccttggcctcattagcaacatagtttaatcatcagagccaagccaccacaggtggctgtgccccatgcaagtgttgtgcatttcatttcctgaaaacgtcagtgtctgagaatataaatattacttataatcctgggatgattgtgcaggtactaatggaatggtttcatggtattgattttcaatagctcatttgctataatcagcttaacttcatctgctagaaaacgaacttctaattccagtctgaaacatagtacaagcaaatgattttagcctagtctgccaccaccttgaatcccttatggaagtaggctgggtataaatcttaaataaataaatcaactttagcttttcccagattttcatgatcttgcaagattgattttcttccctttaatctgtttttaataaaagagatattttcctttgagacatggtccataatcttttccatgtgtattatcattctcatagacatcctcttttcaatttcaagagaagcaaggcctcttagaggaaggtagcttttgtgactagccaaatctgcacaaagttggaggaattctaggaagacggatgggcctttggtgtaggttggaaagaacaatgtttaaaaataccctgtctcctccctgagaggtatgataccatgattctctctctttatctaaaggtattagtctaaggaattaaaagccatttttctatgagaagaaaaatgaacaagatatgggaaggtgaactagcagagcaacatatagaaataataataaaaggccttattcagaatgtaaaatacactatactaaaaggtttaccttgattatagcactcaatcattccaagactctgagattgtagctattatcatatccatatcttatagaagtttatagagttacatgaacttcctcaatgtcttgcagctagtgtgaaggagtcaggactcacaccatagcacccatattccagaacccacagctaaccactggattctatgcctatgaggatacataatacttactgtttcaaataactttataatagttttcagttaaaatcttgtctctaggcttttgggcaaagaactttaaaaactctgagcctccattcctccagcttaaaaatggagacagtaggtaactcttaccactgagacaacgtatgtaaaacacatacacacgcatgcacatatatatacccccaaaatactggtgttctgattcccattttacagatgtagaaacagggactcaaagttgtcaatgtgttcaacgttttataaaagcagatgaaagagtcaagactcaaacctaaatctatctgactgcaaaaggtgtggcattacctgggcagcccattgaggaagtgctcggagctcattgagtgggtgaggatcttggcaacctggccagggaggcaatgggagaatgactggatgcctacatgtgactgtgataacctgtgtatggaatcatttgagagaagtatcaattgtcccaaaatgtctaccggagcagtgagggtgaggtaaataattgaaatgtttgttcctgaagatgggtacagtattaagagtttctaatgatttcttataagctcctgtaactttaggattttttgtttgatgatgtacttgaggggaatgtgacatcatctgtgtgacgtgatcaatgcagtagatgaaatgagtatttaaatacctgacttaacctgaagcaggataattgttaaaccagaggtgagaacacagattgagaaggtgaccatctcaaccttggaaatttgaacaagtattcccagaggaagaaacatttgactcaggacttaaaacgtgtaagagttttacaaagaaggtattaaataagagaaagggaaaaaagaaaaatgatgtagtacattctggtcagtcaacaaaacatacttatctaaaagctatgaagatccttataaattaaaggcacagaaagaaatgctttatattggtaaaactctatattttggagggaataacactttaattttcaaagtgctttcatttatattaactcatctgattcatacaaccctgtatatagaaggaaataatgtttggtaagggaattgggaaattatttaaatgagttgatcatcaaacaaataagttccaaagctgaactaggacccaaaacctttacatcttgatctactgctccaactagatgcagtataaacagggtgtttacatgtttaatactaggagcaagggcagtgccatacttttggaaatagtaagaaagaaataatgcgcttgtagatctttaatgctaagaaaaagaatctcctatggcatgagattgaggacttttagaagcaaagaggtgaaaagtgagaagtctttatttcagaagcatcatataacgaatgttcatagtcaagagataaataaattattcattattctctctgagagaaaatcaaaggactgattttgaaatattagacatttgtagcagtagacatttgtatctagtgtccactatgataatctttctaatttattttcaacactacactcagaaatatagattcctgattatcagcaagtagcaaaatttcttcaggtcctggctgtttcttgtgttgtattgttggtttccagatttctaagtcaatctgaaggttttttctaagtaacacgacttgcatcgtaagtacttttttagtaaaaagttgtagtaaagagttactggtcttgcattagatataaccactttatattagttttggttatcccaagcaaactgcttgacttctgcctctctctctctgtctctctctcttttatttttttctttttgagacagtctcactctgttacccaggctggagagcagtggtgttatctcagttcacggtagcctaaacctcacagcctcaagcaatcctccctcctcagtctcccgagtaactgggattacagaagcacaccaccgtgctaggctaattttcaaaaaaatcttttgtaaagacggagtttcactatgttgcccaggctggtctcaaactcctgggctcaagcaattctcctgcctcagcttcccaaagcactgggattacaggcatgagccattgcacccaggctgttttctctattttatagctaaccccaatactaataacagctaaaattaattgagcacttactttgtagcatgtattgttttaaacattaattcaaacattacctaatataatcatcatggtactttgatactttgtgatattttttacctctgtgaataccaagaaagaagcaattgtttaaaagcaggaaaatccctgaaattgaggaggcatatgttccaaccccaggtcagctacttaccagctatatgacctctggaaaaacatatacagcaagtcctcacttaacattgttgacatattcttggaaactgaaactttaagtgaaatgacctataatgaaaccagttttatcataggttaattgatataaaaaaggtaagttcttatggcatatttctgatcacaaacatatcaccaaacatcaaaatgaatacccaaaacacttctaacattaaacattgaaataaatgtgagctacacatatatttaagaaagattaaaggccaggcatgatggcctatgcctgtaatcccagcactttgggaggccaaggcaggaggatcacttgaggccaggagttcgaaatcagcctggacaacctaatagtccacttctctgcaaaaataaaaataaaaaacaaattacccaggcatggtggtgtgcacctatagtcccagctactcaggaatccaaggcagaagaattgcttaagcccaggaggtcaagacagcagtgagctatgatcatgccactgcactctagcctgggcaacagagcaagactctgtctcagttaataattaattaatcagtaaggtcattatttacccacttattcataacagttcatggtctcgggtggtcatagcctatcacagcagctcagggaaccagatgggaaccaaccctgaacaggaccctggacagcatgccatcccattggagggtacactcacacacacccgcactcactcagactgggaccatttggacacagcaatgaactgaacatatgcattttggggttgtagggggagacatgagggtcctgataaaacccacatagacatgaggagagcatgcaaattccataaacacagtggccctggcgggaatcaattttttcatcatcaacgttataaggaaataacattgaaagaaacaaagttatttgaggacctgcttatcataaatagaataaaatcaatttcctgaactggaaaatgcagataatagtctctgataagtagcttaggcaggtaaaaatacctaaaataataaagcagaacatacagctgtgtgtctggtatgtttcggaggcccaatgttttccgttgggtttatttaccagtactttagtccacttgaatacttagtttacataatcctgaaaatacaattgagaattttattctctgcttaattaccagggttgatgttgtggatctaatgaaataatgcatatgaaatgacttgaatattgcaaagtaccatacacatgtaactgttgttatgattttccttgcaacttaggtggaagctatttcctatttcaaaactttatgatcggggaaaagtaatcccaaaggacctagaaataagtcgtatgcagtcaaaacatgagaaaatggttgtaattttactcagacactatcaagatgcaacaacctgcatatgtgagcaatgtttcttagaaaggctcagaacactttaccattttctgttgtgttcaccacctagaaaaaaaaaaacggttacagaagagatttctgcaatttaaggaagaatttctaagattgtcaaggtgataaaaccccagcaaggattattgaattaagttcttgagactccttcccaggagaacttcaagatgagaacaggcatctatctgtcctacatggctcagacatttaactgctggagggcaagttaaaggcttcctgccggactagatgagtcgtcaaggtcccttctagctcattcatttcttattcaccaattatattccaactgacaaccttccagttttttaaagggactcaccatatttcttaaattacaactcattgctaaactttaaaatcattgccattgattacactttatataggatacacagaaaatagatgtaatgatctgtagctagatttgacctacagcttgcgggttaatgtgtagggagagtgggaaaggtgactctatctgatgattcactacatgtagaaattccatgatataaaacctgaagtgacagaaaccattgccatcccatgataataattttcttggggtttactttgtggttcaatgtccaggtcagacatgatgacattttagcagggatttttttgtgtttggaatattttctttgttgttttttttttcttactttcataactaatttcccttgaaagggtatgacttggatctgacttgttctgaattttacgctacaataaaacatgttagggagaaacttctgtgtctctgacagcctgtcctctaaaacacatctcaacatgtgaactgatgaaccaaaatgccacaaccttgagaagaaattaactcagagttattcatcttcgaaatccatgttttaggtggtttccatggtgactccctggctagcagcatctttgtctaccagatgtcttattgttcaacagctcatctgtcttcagagtttaaggtttgaaaactgaagtccaagcagaacactttctctaaatatcacagagaagggggaaaaagacaataaaatcattagaatgtttaacggacataagatgggaatggcgagcagagacattgttctgccatggtccaaatcagtgcatgacaaatgatttaggttttcattgggttctgagggcataaatatgttataataatgaaagaaggcttaattatacttaaaacagaactcctactcacttggcaaattttatctccctattggctccacgatatattagttcacatggtaagccacttacttctatcaagtcctgattgttgcaagacaatctgcaagttgatatatgaaagtaacttcaattcagaggctttttttttttcttgaagaaatgagagtaagtggctgctaaaaagattgtacttatatattggcttccacgtctaaagttctgaaaacatcctggaacaaagtcactcactctgttatgttttaattcggtaccaattatgactggccatgcttcaacattgtattccaaaatgagaaaacaagcaacagtaatgataaccaaaaaggttggaagcagtgtagggccaggtgtgaagctgaagaaaaaggctgaaaaccaaagctctgatcctagggttcctgttcagtgaagtgcctggtttgtgtgaaggcaagctggaaagagccatgctaggctgggctcacttgtccacattcctcatggaacagccaaggaaactaagatctagtgagataagtaaattattcaaggtgacaaaaattggttgtgtgactgaaatcagacttaggatcagtgatttcccagttcacgtaggtggaaataggtgatagaggttaagtgattcgtacaatattacccagatctctagaatgtagttttcaaaaccatgcccataaactgtagttctgttttgctttttaatgatcaccagcattgactagtaaacctctctcccaacctactccaccccaaattgtcttttccttgttcttggagccgactttgagactcaacccctttcatgctgagctaaatatcaaatatgtgaaagatgataacatccactaactatgtttaaaagacaagtttcaatttcattgactttctagccaatgctacctgttaagtcaattgcacaagagggatttgccaatcgtctaccatgtatgtgtagggagggcatggtgcagagcaaaaccatgtacaaaacagtcatcgccccctcagaaagttgacactgtagctgatagaaaaatgaactgtcccataacaagatggaatggtatgctgtccccatattacaacctcatgtgaaaagataacacagtttgctaagagtttttcatggacgatcaaactaagaagagataaatttcagctagagtaagaaagataagacggtgggaaacaatgaacgacattagatcctggaagaggaactgcatttggaggaagaaaggagagtgaggaatatttttatctataaacttgagattcttacctcatagggttatgatgagaattaattcggaaaattatataaaccatttagcaccttgcttatcatgttaaaaaatcatgtaaaaataaatgtcatttttattatttaatgatccatacagagttggggtggaaagaatattatagaaagaatctaaagttcttggttcttaatccagtagcaaacagagtaaaataggaatatcatctaatattgcaggatttattttatcattgatgaaatgaaagatttagctaaaatgatctctgggatccattttcactcataaattctatgattctgggacaccaaataaatgttttattcgtctatatttgcccacaatatgcattttttagacccacagggaattttttctgaatcgtggactcagaaccagttaagtgcatgactgacacaacacatgaactttgaacaattacattcaaacatcaggacagtctttgttaacatcgccaactctcttccttattaccagtaagtttttttttttattcgctgtgtaagggcgattaattcacatttcttataaagttgtacaatacaaattgcataagaaaataaatgactcttttctattacttggtggaaaaagttgatttatagtccctgagagaaagaactaaggaagagagttaaaattccacttactatatgagatttttaaagatctagcactcatgcatgttgtgaaaatactaagtatctcaaataatgtgtgagattctccttagaggtaaggttttatattgtcaagacattttttcttttattttttctattgagttactgtctttatgctttacttgtacctcatactataaattaaaagattagtgttcggtgtcattgcattaatgaagattattatttacaacaatagctagaaagtgattggaggtttaagtccagtaacttgagcaattaaaacccttgtagattcctatgaggtttaaaaaatacatgttgttaagggaaacctatgtactcaagaaagatagttattgctagtgtaccttcttcaggaaaccaaaaatgtctctcatcaaaaacggcttctggaaaagactggagttttattaacatcttagtatagatttaaagaaatgaatctcttctcctaacaactagatttcaatcctcttttcagattctctaatcataaaagctaaacatcataaaataattgaagactaagtgataattataatgaacacccaccattttacccacctactctttctctttttctcatgcatttctcttctctctgtaaaagtaaaagcactttattttatttattttattttatttttttaaattttaattttattttattttaattttattttatttattttattttggagacaagagtctcgctgtcgcccaggctggagggcggtggcgccatctcggctcactgcaagctccgccccccgggttcccgccattctcctgcctcagcctcccgagtagctgggactacaggcgccgccaccacgcccggctgattttttgtatttttagtagagacggggtttcaccgtgttagccaggatggtctcgatctcctgacctcgtgatccacccgcctcggcctcccaaagtgctgggattacaggcgtgagccaccgcgcccggcctggcacttacttttctctggggaactgcccctctatgtttcagtgtatcccttttggaaatgtcaactgcagtgacttgcctcttcatcctaacttctggccaatcagtgtgggctattgacctagacatgaatgatgacacttgttttccctgaaagttgggtcttgagcaaagtgacacacaattaaaaatctggatggagagttattttgggttttgagactgccaaagacttcctgcaatgaagatctgcactctgaacttctgagctgctttggttcccatctttcctgtggctgggtccctccctctctctgtttttcctgtgagcacagatgactacattggtgaattcaatcaaacatttaaagaagacataataccagttgtaactgtattcggacaacagagtttatgtgaacatttcccacctcatttgataaggtcattatatcagatattaaaggggagagaaatacatatactttctgctatatataaaaataaatctttttttatatatagtgttgataaacagatataaatatatgtactataatatagatataaaagaaaaaactacataccaatatcactcatgaacatagatacaaatttttttaattataagcacgtagtatctacagacatatatatcataaatatatctatggaatatatggaataatgcactataaccaaacaaaaaatgcaagattgaatattttaaattcagtcaatgtaatcaccccattaacaaaaaaaagagagaaaaaccatattatttgaatagatgctaaaaaaacatttgataaaattcaacacatatttatatttgtgaggctaaggaatgtccttggatgctaatccaccatgttgatttctgattaacctctgttctgggaatgcttttcagctttctactttatgtactattaccgtaaatcctatgcttctgtcaaagcaaccttgaccataagaccacaagtccttccctcaggcagattcacataactttcttgccttttcttggggagttgacttcagttgccctgcacgtttcttgtctatgatatataagccctggatcttggtggtaagcacatggatccatgaactggtctctcggctgccctagactattgcttctgcttgtaaatctgtattcaaggtttctgagaaactgggaatgtcgggctctttctttgtccccaaagcttccttggccttttgggggaaggtttgcatatgcttgctcaccatagaacaatactaagtaaaaatgttcagcaaacaaaaaaatagaacatctttaagatatagtgcatctaccaatatcttaaagccaacatcatacttgattccgagaattcaaatgcttttctaaaaggatcgggaacaacacaaaggcgttttctcaaacaatttctattcaacgctgtactggagatcttgctgaatacaatataaaagaaaataaataaaaggcataaataatggatagatcacagcactgtgtaccttaataaatgtaaaggaattcacaaagacaataacagacctaataagtgaatttgacatgggtacagaacacaaggtcaatgtaatacatacatacacacatgaacaatcaacaaatggttgggaaataaaattgtttaaacaccatttacagtgaaatctaaaaagaaacaaaaattataggaataaatctaatgaaatgtgcagaaggcatttttagtgaaagacatttatactgaaagctacaaaacagtactgatagaagaacaaaacaaatacagaattgacctggccatgagttagaaggtgcaatattaagataccaattctcctcaaattgatttacagaatcaataagacccaataaaaattccaaaagactttttaaaaatagaaatgaacaagttcattgtaacaagcatatgaaaagaacaagaagacctagaatatctaaggcaatcttgaagaagtactgcaaactcaaaggacttactataactgatgttacaactcattttggatctataaaaattagacattatgctgttcatgaaagggtacacaaataaatgaaggcacataatcaacagtactgaaacagacacctatataaggtaacttgaattttgatgtaagaatcaatgcatttctatgtctaaatgaaaagttctttcaacagttgatgccacagcaacttcttttgaggggaaagaacttgaattttactttacatcagacataaaaaattaattttaggttaatcatagtcccaaacatgaaagctaagtctataaagcttttagaaacaaacatggaagaatgcctttataattatagtataggcatatattatttaaatatttctttaaacaatagccagccaagagaatttgacaaactacacttcaaaaaaatgaaatatttgctcatcaaaagttatagttagtaatgcgaaagggtaaatctcaaactaggagaaaatgtttgcaatatgtatcttacaaaggactattatccaggatacgaatgaattacaagaagacaataactcaagttaaaaagttaaaaacacttgtgaatacatacttcacaggagatgatgaaaacccaataaacacttcatattattcgtttcaatgctaatacattttaaaaccaaaatgtgacatcaatttacatccactagaatagttaatagtaaaaagtctaacaattgcaagtgttgaggaagatatgagaaactgcatgtcttgggtaagaaaagtgaaatgtaaaatgatacaatcatgttacaaaactgtttgacagtttctaacatagttaaatacccaacaccttatgattcaacaattctacttctattaatggttaggtacccaagaaaattggaagcatacattcataaaagatttacattgtaggccgggcatggtggctcacgcttgtaatcccagtactttgggaggccaaggtgggtggatcacttgaggctaggggttcaagaccagcctgggcaacatggtagagacaacagctgtctctactaaaaaatgcaaaaatgagccaggtgtggtggtacgcgtctgtagtcccagatgcttgggaagctgaggcaggagaatcacctgaatccaggaggcagagattgcattgagctgagatcgcaccagtggactccagcctgagcaacagactgagacaccatctcaaaaataaattatataacattgtcgatgagagtcttattcataatagctcaacacttgaaatatcccaaatttccatcaatataatagataaattgtatattcattaaatggaatactcaggaataaaaagaatacatttctcaaccacacaacatgaatcactttttaaaatactattttaaacaaaagtagccagacacaaaccggtacatacactaagattccatatatatatataacttcaaaaacaggcaaaattaatctacagtaaaagaattaaagctacaggttacctctgtaggtggttaagattggccaataaggaacatgagaaaacattgtgggacgatgagaatttctatatcttaattttaacgatggtaacaggtgcatatataaatacacacacacatatataactgaagtgtatacttagtatctgtatgttttactatagatcaactaaccacattaaacaaaaaaagacagagagacacaaaagtatctttatttctagatttcattttcatcaatacagtaaaccatagaaagacactttcttgataaatatctttattaaagaagtgtagcaaaacaaagggtaggaagttgaagttaggaggatttaataatcaactggtatttctaggtatggcttttaaagggctgacttttctggatatgacaagctggcaaatgttctcagagtaggctttcaaaaaaataatgttttccattttcgtagaaatcaagatttagtcctttgagtaactaagataatatagtagacttgaaatgattaatttatagaagtcactaccagttgtcattataattatgattttttattattaaaataattattctttgaaaagaataatttgcatatgccacacagaaaaataatgtattttagtaaatggaggacttaaatatttagtcaatgcaacattaggtctactcaccagataatcaagatatagcagtatgattctgacaaaaatatctttctctcaatatctggaatattaataaatagcagtaagatccagtttgatttttttcactctctcaatatcctcgtaactcaagcaaagcaaattgtagataatttgtttttgaaatccagatttattcactgagtgtaaagatggcaatttctgttttttgttaaaatgaaatatattttcccttcaacttgtcatataatttacccactgtcctcactgcttagaatgaaaagagctagtattttacaatttgagaaattgttgtactcagaatatacacacacatacacacatgcaaatatacatatccagattgctttgtgctagcaccaaaatcatcatgaaaataccattttgaaacttgaaaccccaaaatccttttggacttatgttttagttactagtctgtttacacagtcatatgatgacttttctcttttttacaagtctgaaaaagtttctttgcaatctaagggtccaatattaccttatgtatcattatagtatgtatgcctaaatatttttgcattaaataagtagagctctcttaaagttaatatatctttatgaatattataagcagagtagaaatccatacaagtatagtataattggtttcctgtatatgcgttgggcctttttacccagtgactccaggagaaagatctgagaaaatacagaatgtagcaggacttctacgaaagttgagttaccaaagtcaaagtcagatcaaaaggaaataaaggacagaacacttcagggagtagaaaatattccctgttgggtaaaatgtaaagattccatatggtgctggaaatgtgccatgtcctcggcaccccttgtaaatgttttgttagttcactggtgagtctgcctgtttctctctgacttgatttcacagctttggtcactgctgtccacagtcaggcaaacacaaaaggaatcatttagctgttcttcggcactggaaattttcttcatactgaaaaaggcagcagggaataccatttgtctttcgctttattctgagctatggtaactaaggctctgggtcccctggttcccattgatctgtgcaatacagaatagcaaaattggctactgacagccagctggggcaatcagcaccaagacattcagagggctatatttttcttccattttaactaggtccagtagctacctgcgttgcaacagcaccagggtataaggaaggactccttttgaacaccattgcaatcacgatattgagcatagcctctatcccagagaaggcattcaatgcaactttgtgaatgattgaatacaatagcccactatattactttatagccattactctttataattattactctaagcccagagttgggagctgcagagttgagaatattgttaattcctgacttaaaatgaaatgtgtttggtattgtccccattgccctcaaataaggccaagcccccttagattgacacacaagattgcaaccctgatttttttctaacctcacaatcaacatccaaagcccacatgtgatgagtaattcaggggtcatagtctctcttaggtctgagtcttgtgcatcttttcactcacctgcgacagccccacccccttccatgtggaatgcctactcagctttcagatctcagactcaacacctctggctctgggaagacatgaggctttgggaagtccgggctggctttcccttctaagtgctcccacaaagccctgagagccccttattcttcacgcagtgcatggcgattgcatgtctcaaccaccaggccacgtgtttagagacgccagccacacccttccttgtcttcgttactgctgctgacagcatgctctcagtacacaacctttgcgagaaagaataaatgagtgagtggagaagcactagccattttcagggtgaattggtggtaatcagatgctggaatttgctggtggagtcactcagatgaggagaatggccaaaaatttccttgaggtactcaatagaagtttaaaaatgaagaaataaccccaacatcgagtcacaataactaagttgtattttaagtggttgtatttaacatattagcacacacagaatatataagatatttggaaaaaaatatgaaaagtctcactatagatgcatgaagacgttgtgacccaggtccccctggtcctcagctccttaatgctttgttccatgggagtggtttccaggggattcaggaaaacacaccctgtccagacagaaatgagaatacagcctctgggagaaataaggccccagcaaccactcaacatttttctttccatatcccaggcgcaaataggcactgagggaagagtgagcctttcttcctgcccttctcctcttgcaacattttctggagagggcaggaagacctaggtagccagcctgcgtccaggaagggagcctggggcaccttggtgtgatagatgctgaggggacagggccaccagagggagcctgagagtccagagaagactaagagaatcatgtgaccctttgagggacttgaaggtaggctgtggggagtggagggtctacaaagaaggataaaggggcccagctttcctaggtgagccttgaggaccctggagagaagctgatgaggtctgagattactgaaaatactacaggagcattgggatcactgggggagggttctggggagtctggaggatctgggggaccttgggggaaagcgtatggggtttgggagcatggaatgaactaggggagctaggggtggtcattggtggagcttggacgtgcctggaggagcctggagggatgatctgcccctcaatcaatagaaccagttaagaagagaccatctcccaaccctgaataggctcagtgtccgaaggtaggttgtgtagaaatgcatccccacaatcacaagaatcaatgtgaaagtaatatcaggagttttatttcagctattggtgggtcaatcttttttctctgtggaattttttttcttccaaagtttcctgttttcttcataatttaatttccttcttagctttttttcctcctatatatatgatattatgaagtatatatttggtcttcatcctgttttgtgacatacagctgctaaaacctttgaaatctctggaatgaagagtgtcttctgcttgctaatgagatgacttgtgtctggaggccccagtatagcttcaggaagggggctggtctccagaaataaaaaggcatgattagagtattggaccagtcggccccaccctcaaacctcccgggaggagagaggggctgaaggttaagttcatcccaaatgaataatgatttaatcaatcgtgtctacataatgaagcctccattaaaaaaaaaaaaagagggacatatttcggaggaacttcctgatagctgaacctgtggaggttcctggaggacagtgtgcccagagaaggcatgaaagccctgcaccccttccccataccttgcccatgcatttcttccattggggacgttcatttgtatcccttaaaatatcatttataataaacaggtaaacataaataaagtgtttccttcagttttgtgatctgctctagcaaactcatagaactcatagagaaagggtagtagaaactttgatctgtaaccagtccataacccatccattagaagacctgcacagcttgcaatgcctgtctcaagtaggaggcactcttgtgggactgagctcttgaccaacctgtggaatctaaccctacctccaggtagacattgtagaattgaattgagttagaggacactcagctggtgttcattgcaaaatagattgcttgcttggaattttccccacccgtgtaatgtcagaagcattgtgttgtgtttgagagtatatcaggagaaacaggatttgtttttttctatatcctcagagtataaatattgtttattcattggttattttaaacttattcatgtttttttattcttggcctctcttttttcccctaaaagaatatttttcattttttaatttcttctcacctctcattccttcttcatagattcttatttccttgtgtttttctttatatttttctttctgcacaattattttctttatgttcttttcagttttttagcattaacttttcagtttttaataatttcttattttcttctgtttatttttttatttcttcacaatttccttcttctttatgattatttgctaagtttcctttagcttctacctcatcataacttctatctggtcttcttttcatatattattttcttctttataataattcccttcttgggggcttctgtttattatttctttatttatatttcatattttgtttctttctttataatttctctctctcctctatcttcttcatggtttggagtgtgattcttctctctccccttgatggtgatggacacttgctttgggaccaggcagtcctacatccattcccagttacggccctggttagctggatgtccatgaactaaattttgctttctgaaccttatttttgtgacttaaaggtacttatgtagtaactgcaatattgtttttatttatagaacagtttgccaggaaagaaaatatttcaaagacaaattttccactaaaaaataatacagataaaaaacacaaaatatgggcagacttagacttggagaggaggtgcctacacagactaaaaagctgatgcctcttcaatgtgattttctttaaattttatttgtttcactttgtggctgagggtagagtcttgtttctcttgctctttgtttcttttagaaaacatctatctttaagcaagacattagttcccaaaacctgacttttctcagcaaataatacattgatattattcagcttcaaaattttgactgtgacttcaagattgacacatttttaatgttgcccccaacaatatcgccaactaattaagcaaaagtccactctaaacgtaagcatcgaataggtcaaccattacaaggagagcgtttgcttctcttaaaagtttctttccacctctaggtgcattctgtttcaccagctatataaggatcaacagtgtggaaacctgcatcaactggcattgtatttgtaatttattctgatgattgtttagtgtcctttatatttacacaatttgtggaacccagtgtaaaatgaaaatgtgaggctccttgttcagaattattaataatttcaagaaggcaattctagggcattaggcaagtgcaggactctgctgagtctaggtcctgtacagtggcaaaggtcacacgtttgtatcaccggccctgttgatgttgaagttcttagcacgaagctggctgacctggttccaggtacaggaagtgacacccatgaggaactttcagatcccctttatactctcaaaattttagtttttcttttaactttagaaaacttgcctggatttcagttattcatccatagcttgaatatgtcatttttcttactgcccttctctcctctcaacaaccactagtcattccctgtaaaaagtttgggaacattcaacagacttttacagcagaaagtatataatgtggtggcagagaagccctcttctcaaagtcagtatatttcaaccagtggcatacttaggattttgttgtaagtagcttaaaaataacttgcttcatgtctcagccattacttcccacagttgagccctctggccaaatctaaatcatgcaaagggccaattgttaaagtgaatgcctgctaagtaggatggcttggaatccaggttgaggatgaaagcagcaacagcaggaaggaagaacagtggagtaagccaaaagaaaaaattactgctggcacacttctgttcaccatacaattcatccccccgcacatggcaatggagttggtgaacaaacaggtgcataaattaaaatcatgcaattagcggccatgctgcccaccgctgctgccccagagctgcagtaatgctgacactagttaaacaaccaaagcaactgtcattagctaagtgtgttcacttctagaatatcctttttattaacgtgtttaaatagctggatggcagagatttgctgtgagttctataacagaagccagttaacaaccttaaagaccaaattaattggaaagacatattttaaaaccaacacagaacataagctagggtgcataaccagaagctacaattgctcaagttttttagaagaggccatttacattgtaacatcccgccaaaatagtatgattttttaaaatcacagaaattgcacagaaactagatgtttcaaggtatttatgttaacatttcaggataaggaatgagagtcttctctggtgctcatcattttcaggatgaacaattagcattgaatatgcaatgtggtatttcacttcaatctccagaattcctctcaatgcttcattaggctaaagaaattcttttgatactgcgcaataagagtttatattttattccctatttttaagcaaagacaaagagatgtatttaatatgtaagatttgggagaagaaaagtgaaaaatcatcagtgatgtgaactaactttaagatcacacaaacttgaaactactagagtattgaaataacacttgagcagacttaactcttcatccagaatccctgggtattgataacttttatagtgacatttgaaggctttttgtaagacacaatgaattacagggaaaatggagattttatgaaattatgttctacatgaatagtcatagtagttgaaatgtgaagatgaaggaatgaggcttaattagagaagtaccaaagaagatcaagatgattatctcacaacatccctcaggttgttgtctgaaagtaatggtctccatgaactataaagacagggtgtgtcgtgttgagagacaagacccagacccaggttttttccccagctcactaaatgtgtaaaattagataaattctttaacttttttcagcctctgttttgtaacctctcaaatggggataataatacatgtttacctcatagtcttattttaagtgattaaataaaataattcaaatagtgcttagcagtgcctaacactacctttatgtatgtaacttaataggtgatacaaatttatctccctttaccagtagttttccttgactacaaattgaaatcttcggggaagttgtaaaaagcactgatgcttgaagtcacacttggagcttctaattgaacattcttgggtgtggcctgagcatcaggaattttgaaagttccccaggtagttctactctgcggccaaggttgggaaccacgttgctttagacagtaaatacatcattagtaaccacattaatttccattactcaagaaattcactgaacaccctggcatattctaaacatgacaacttgaccatttctccctgaggctcattttctctttgttgcccttctggggttaaaaacaacaacaacaaccaaagtcaatgagacaataattttagcttagaacttaaggatccttttcatgctctacttaataataaatagcagaggacttctttgaacaacatctttaatgtagttgctaaaacaataaaatacacaacagagtacccatcctttaaggaggccaaatatatgatgccctctcttttttttttttttttatcatacatgagtatttctgaaacaagttgagctaaactttgtatcctttgatatcatgggaaataaggaagcagtgcacattctctaaagaaaatgacaatgatttctcattcattctctcattcttctgtttctgttttcatttgctttaaaaacttctttttcttttaagatctgactttccttccaggtgaggaaaaaagaatttccaagtgaggccaattagagttgcccagatgaagcaaagtccccagggatcaatcagaatgcctacacagatgagaaagtaggaatatgtcctttctttctccttgttagagtttagtttctgccctgaggaattctagttatttattttctatcagaaaaaagaatgagctctccacagcacttaactctttcctacttgatagaaatatccaccttcacattgtaaccttgtgctgtacctcattgacttgtccttagttaattatacagaacatctcattcattcagattatgctaactgggaaataaaatatgtttacaagaattaggccaaaacatacaattgcactggaaatggtgtaaaagagatttatcagacgccagctttaactaggagattagatttatgaatacttcccagattgtgtactagggaacattactgttcatcaggatattaacaaggagtttcgtggtcagattaaattgagaaatgataattaaccattttcattataatgatgataaccattttcatcatgctcttctgagccttgcagctctgaatgtagtccgagattggctgcattggcattacatagttacttgttataaatgcacaatctgtattaattctgtagtcccacccccatactacagaattaaaatgttcatttgaacaaaatcctcaagcgattcctatgcacattatagtttaatagacactaccttggatgatctcaattcatattagtatggcagcaaaaaaaagtttttttaagttgaattcataaatttttaaagtctttttcactttgtttatcctatgatataatgaaattatttgaccacagaaatatagctattctgtttttgaaacagttactaatatttcatggcccaaaactttttcacataagataggaaaaagctaagtcaaattatatttcaaaggtcctggtaattctcatattctgatatcctaaaaagatggtaaagaatatacttaccttctcagaaaagaaatattatttaaaaacgctgagcatcctctattggtgatattgtcaattaccaggtagactatagtactatactggtaaagaggctttttcatgtgtagtctgtttccatctaaaatgatgacctctgaagatatggtgtgtgtgtgtgtgtgtgtgtgtgtgtgtgtgtgtgtgtgtgtgtgttggcagtcagtgttcagcttctcttggctgcatccactacagaggatgtcctgaaatggtcagccatgtctccctccagcctcacattactactgtctccctgcccttctgtattgactggaatttggccagagttctaccagagtagtgcctggatcttcatctaacttttaaggaatcaccagacttaaatttatccttgaattaaaattacttaaataactgaaatatcccctccatatcttccaaagtctacccaaatttaggacatggtgggtgttattcctttcctatacccaggcacacaggtcttttcatatcctgctggtattaattattccaatgctcttcttgctttcagaaatccctagatgaaagtagacaccaactctgttcccatgtgttgcacccaaattcagggtccaaacacaagctgcactgagaactcttttctcaaccatttgctccaacaaagtgagaatgggtctattgtttcttgtcctagtgtatatcccccatgaagaaacaagatgtcattgtccctttttgaaagacagagaataaagtgttccttcttgaaagaatgatttcttagatccatatgttatcttataaaaccaatgcaaagtgtgcttttcaaccaaccattttctgagacatcaataaaaataattttatgctttgtatgaataaatccaacaggttttcagtcttattttagtctcttgccttaaaaaggaataaaaaatgtatgtatttcagaaagaaaatgtagaatttaggctgttttcttccattttcttccttgaaaataatctactttggatttcttttgaagacaagtggacatttggcatttacagcttcatagaattgtaaagttatgtctctctagcaacaaagcacagtgccatatttctgaataaatacgttcttccttgagttaaaattgcttacaaagaatctgtaataaatcaatcttagtctttagatttactgtttaaggtcaaactatgtcaattgtgtttttaaattcagatttcattttgaagcaacattttataattatgtctaatttctatttgtgcttatctgttttgaaaaaatttagattaggtcaatcacaagtcaaaaaaatgactaccttctggctccctctcaaaaatgtccactgttcaaataaaaaaaaataacattttgctcagaaattctaattttttaaggggtgaaagtaagatgtgtttatttatggtatattcattccagagtattcttaagaatgcccttactggaaagatgttaggtctgagaaataaagaggagcttgaaaactcacaagaaagcattttttaagccagcagtgaaagaacttttgatgtttcaaggtcatttcactgtgggaggaaattgatagcgtctaattagagtagaaatgctataaagtctgttcagtagagatgtacttggctagcaggatgaagtcagaggaagtatataaaattttctcttattgacttacattttccatggtccccaaaacttaaatgtatgttaatatcacctacagtgtttttatccttgttgagattaaaatatgaaacctgggagttttctcctgcttagttccttattatgggtattcaaacaaatgctgagttgtagatttaattccttatgaattgcctccacttaacaaaatcccaaaacatttactcagaggttgctatgcaaaagccaccgcagatgcaaaagatcctagagatgcctacaatttggaccttggatttaggtgattataattatagttgcaaataattatgtgtcaatattccgtattttacctggaaaaaaaaattctgttcaaaagttttaaatgtatttacactcactttccaaggtagggggtgatagtattcatgttagtcatatatttatatttcacactatttctctcttctgctttcatcgattgatgagaatggggaaaaattattataaacttaatgcctctgcagtttttctgtgtcactaaataatgagagtctgagaaaatatgtattgtttagcaggacatcttcatgtgttttccaacttaaaaaatacaacatgcatgttttcaattgtaagtgggagctaaatgatgagaacacacagacacatagaggggaattggggcctatcagatggtgtagggtgggaggaaggagaggatcaggaaaaataactaatgagtactgactaggtttaattcttaggtgatgaaatattctgtacaacaagcccccatgacacaagtttacctatgtaacaaacctgcacatgtacctctgaaataagttaaataacaaataaataaataataaaataattgtgattaaaaagagacaatatgctgtaaaatatttatttaataaaatagctttttaatctgtacagaattgaataaaaaataaataaaaatataacatacttaataacctatttccaaatctattcttattaaactattaataagctagggatttttctgaaaaacaatacttttttcttagaagaatataatgttggattccttgctttaactttgtgatgcttcatggatcacctatctcaaatctctcattctacttaatgacccaggtttcttgaattgagtgactagagaaaggaatttatagaagatctttaagatgcttcatttttacccctaaaagaaaaacagtgaaaccaagaggacggcgctagctgtagataatttagggtaattcaacccagagatggagcaagtaattatttctgttcttgtctcatcctggttgccttctatttatcctaacaaaaaagccacaacaagttccctataaagagttcctgttgtccattttataaagaggaggaggatcaactttatttatgaacattacaatttatcagagggactctggttctatgtaggcaaattccaaataacattaaattcaaattctttttattcaagttctatcagatttgctgcccatctgttaatcccacttgacttcacagtgctgtttatctcctaataatgtttttataggattgccattgcatactattttttttgtgtgtgataggtacacatagaagtcacattcattgtccttcctagtaatatctgcatagattctgattccatgatcctttaaaatgagcaaagtgagaggtaccattccagaaagaagaaacaagtcaccttgtaaaatgatctgcatttttgtcatgtcaggagcctgcacgtgttgggttacttcatgaagcaattgttgcctacagtagcatttcagttcaaaagcctgttccgttaaatgccatttcccagttcaaatggacttgaactgattcagcatacaaatggtaacatactctttaaaaatatagtgcagtggttaaacgtgaagattctggagacaggtcatctgggttcagaacctgtacttgctgtgtgatcttaggcaagctacttgatcactgtttcctatatttaaaatagggggacaataacaccaagctcataaatcactgtgagaattatgcaagtttattatacatgcttctcatgtgcctgatacacactgagcagtcaataaacgcttgctgcttctatttgaaatcttaaagagaccatataacaaaacctcacctttgggcaaatgagcaaactgaggctcaaatgttaaataattgacctatgtgttctgtccattagagtccacctttactttctccttatttaaagaaagttgaatgcaaaggcattacttggaaaacctgagttcaagttccagttccaccctacatttgttccataaccttgagcaagttccttaatatttctatatggctcagaatggttaagtaatttttccaaggtcacacagctagtgagtagtgggacttggattcaacttgagcaagtctaattctaaaatcagatttttgtccctactataatgtcaaaggttgctttaggtaatatgtacatatcacttttggtcaacgaagaaactgaagttaaatgtctaatgcacagttacagcaaatttagacagagcttggactacaacggaagtcactaagctatcaattaaatattcttcccactagatcagtgattcttaatcctagctgcatattagtcttacctgggtaacccacttcaaaaagacacctttacctggggccctatctcagacaaattattttttcaaagtctcactgaattaattgtaaggtgctaatgtgaagaactgctgaccttgactgaaagagtgcaaagaggattattttgccaaaacagactcactaccaggttgcttccaaattaactaaactcagaactgtcctaacacaaacacaggtgggagtggctctaagccctgttatttacccttcactttctaacattttatcaaagtcagtctccagtatagatgagtagctatgggaaaatactaggaataatcctcccaggccctcttatttttttcctggtttcttatttcttaactggattgtctcctcctctatgctattatattccactgctggattagtcttactgacagctcttaccttgctattctgctttccaagagtttcagtgattcctcagcacccgcagaggaggtgtaaatacactttatctggagctaccaagacctctagcatctttccaaagtgacgtttccaaacttttccatgactaattcaccttcattttacatgccttaaagagcattgtaactccatagggctttctgaaactgcactgtgctgtcaccctttgtgcttttgctatgttattcctttgtctctaatgttttgccctgtaaccctacttgtgagtatcctacttattgcatcattaagcccaagcaattttctgctttcccatcttgactatgactgtttatccttgaatgcacaaatcctatccagaccattgaaatgccattccccgctttgagctcaatggttcaagactagcctgtccaaaatgacaaaaccccgtctctaccaaaaaaaaaaaaaaaaaaaagcaaaaatagtcaggcattggtggctcactcctgtagtcccagctactcagaagctgaggctggagactcacttgagcccaggaggcctgtgttgcagtgagccaagatcataccactgcactccagcctgggtgacaaagtgagaccctgaaaaaaaaaaaagagagagaaagaagaaagaaagaaagaaaaagaaaaagaaagaaaggtaattttcttgactatttcatccatccctttctcttctcaactcctcaccaaaactttttttaatttattgaacttccatagaaatttttttaatttttaatttacttcattactttgtcacttatatttaaaggcagagattattttggatttatccttatattccacacatcccaaagcctagtaaataatactatagacacttctagtttgccttctcctatgaaagaacaacaacaaaatactagatataatcctctcaggccctcattatttctttcttggtttcttatttcttatctggattgtctccccttctgtcttattatatcccatttctagatgagtcttactaacagctctcacgtaattctgctcttctagagcttcagtgattcctctatgcctacagattaaaggtcagtgccctttatccagaactccctagacttgtataatctagtcttaagtgaccgtcccaaacttatctctatcttgtttacctctaccttctaacattttatcaaatatttaatcaaaattttatctcttctagtctcaagccacacccaaccttcagatggaacatgtggatctggcctaagcccacctgtgcacaccattctctggtccatggtgactgcttccaggcacatgacctaagctggtcatagaataaattttaggagtctgctttagggtttgaaccattaaatgtgtagatagcaaggttctggtaattattctgcaactaagagaaaaaaaaaaaaaactgtttcaaataagactaagagatagagaaagaaaggttgaatcccagagacacatctaggacctctctgtccaggatagcctaaaactagacctctctctgaaccatccagttatataaatcccacacatttacttttatgtttacattaggacttctgtaccttgaaatctatgaaatcacaaacacaagacattcactcaataactgttaggtaaccaatcagcctttcaaccgcattaaaatatgccaggaggaggctatataggataccgcaacaactctctggtttaatttgactaagtttttatttttcaatttttgttttttatctcagcgtaagagatgtaatatactaaagcttatctgatatgaggctacaaaataaacacaaggatagaaaaaaccctcatgtccctctctctattaacctcatgcagcaagggtctgtgttcatcattagtttgactttgcaatgcagaaaatagacagtctcctccaatccacttaattgtaaatcaggatcttcagctaaggctcagaacaaagatcaaagataaaaaaggaaaaagagaaaccttcatgtccggatcatgctcttatcttcaggacaacttgagtttctttcaggtatttgtaaaagcaagagaaaatcaatgagaattaaggtcggaggagacgaccaataggactgttacaggtttatcatgttttggatgcaaagtggctggtgctcatcctgagtccatcatctgtctcaggaagacagcaaactattgtgcttgtgttttcagaattgcagtggagataatgctgttaacacaatggggcattgcaagaaactcataggcacaaggattgatcacagatattgcttatgggatctcagagggtaaagaatacccttggatgaagagctgcttaaaagatcatggacagttacagcaaatttagacaaagcttggactacaatggaaatccaagaaggttgaagagttctatagaaccatccaggaggcactaaactcgagatatatttattacacagcagaaaaagttgaaaaaggaaaggaggaaggtggtaaaagtgaagtagatgaagaaatctgggtagcctaaaatagtatatttatatactaaaataatacattaaggctgttctttccttgtgttgctggtggagatacagacttggaatacataaaggagcaagttactattattatgtggaacgattaaggtggagaacttcaaatgccacatcaattattatgtaaatcctaatgatgccaagaaactcacattcaactaaagggtcctatgtgtgtggctgaggtaaaatgtggccttttgaagttgtcaataaaggaacaaatagattgttgtgactatatagggtctgatgagccacttaccagcagcttccaagaggaaaatgtacaggcccaaaaaaatgtcacagaactgccaaaaggataggaaatcgatgacataaatgatgaaataactcattcttctacttgctctttattggtgttaaataattgctaaatttttatttgaatggaaaaacagaaggaaattggtgagtgacagctccttcaaagatgatcctctaaaccagtggtccccaacctttttggcaccagggaccagtctcatggaagacagtttttccatggatgaggggtggggaggatggtttggggatgattcaagcacattacatttattgtgcactttatttctagtattattacattgtcatatataattaaataattatacaactcatcataatgtacaatcagtgggagccctgagcttgttttcctgccactagagggtcccatctgggatgacaggagacagtgacaggtcattagattctcataaggagcatgcaacctagatccctcaccatgtgcagttcacaataggacacacactcctgtgagaatctattgtcactgctgatccgacatgaggcagatcttgggccataatgtgaacaacgggaagcagcatctgtattgaacagatgaagcttcacttgctcgcccactgctcacctcctggtgtgtggcctggttcctaacaggccacagactgccaccggtccatggccctggggttgggaagctttgctttaattatgtccaaaaaagtgtatgtcccttaaacaatttagatcatcaccaatgggaaaacagtggatacttctcatggtaaacagaggaaacagaaaaggaagtaagctaagcaagtcatgagtgaaatttactaggcttttgacctgggagagtagttatctgaggaaacttagtgtagaattgactatagtttaccctggcatttggatagctattgttggtgaaatattcacactcgttcatgcaactactttatgacatatgaactctttgcctgctttattttccttagcatttaactttaaaacaaaattttaaaaaaacctaacattgtgtgtgtgtctagatagataagagagagacatagagacatcaacacatagatacaaatatacagatatagatgatatagatacagacacatcaaaatatcagcctatctcagaaaataggaaggggaagaggttacttataatttgaccagaatttagaaggctaagtagtatgtgcccttggagttaatagtagcagtacccaggttgagaaccacaaggaaaagacagccccataaaaaaacaaggactcactactctgctctctcccacttttcaaagtgattgccatttgccctttattgacactcctttgttattttccccagagaaaaataactatgcattattctagcaggtgtactagtaaccctcacttctctccattcccacacacctgaaagttccccttccagggatggggaatcccagagacatatctagggcctctctgtccaggtcctagacagggatctgggtctggattaacatagaaagcccttcacattttacaatgtggatgtgcatggttctgagaggtgaagccagctgagcttctgggtcagatggggagcctcagaacttttgtgtctagctaaaggactgtaaatatacctatcagcgctctgtgtctagctaaaggattgtaaatgcaccaatcagcattctgtaaaatctgtgaaggtctgcggctcactcctgaagtcagcgagaccacaaacccactgggaggaacagacaactccggacgcaccacctttaagacctgtaacactcactgccaaggtctgtggcttcactcctgaagtcagcgagaccatgaacccaccggaaggaagaaactctggacacatctgaacatctgaaggaacaaactctggacacaccatctttaagaactgtaacactcaccacgagggtccacggcttcattcttgaagtcagtgagaccaagaacttactggaaggaactaattccagacacagttctgccatgacactcttcagcctggtagcccaggcaattttgccattgacttttctaggttgtaagacttagctcttccttgaaatagaatgaatcttcaaattgtaccacatgttaatatacttaaaaattaacaagacagagaggtggttagtggctataaggtgttcactgtaaaattcaactttgctgaatttcgaaacttatctattaataataaaaactgggaagtattagcaagtgagtattttggtttttgtggggttttgttcttttgctttgtttcgttttgtttttaccaattctgtgtcattctttatttgaaatgcaacaagaaaaacagcaagctgtcagtcatgccattaacaaatggatgttataaaacccatgcctgtctgggtgcgtttgctcatgcctataatcccagcactttggaaggctgaggtgggtggatcaccagaattcaggagtttgagaccagtctggccgacatgctgaaaccccatctttactaaaaatacaaaaaaattagccaggtgtggtggcaggcgcctgtagtcccagctcctctggaggctgaggcaggaggatggattgaacccaggtggtggaggttgcagtaagcagagatcgcgccactgcacaccagcctgggcaacagagctagattctgtctcaaaacaaaacaaatcagaacaaaaaacaaaaacaaaaataaaaatattattaaacaaattaaaatatttaataattattgtacaaagttacatttatgatttattcctaggattataattattattacattccaaatactgagtcctttctatgtgtcagttaccctgtatgcattatctaattttattctacagccattctatgaagtaggtattataattatgaactgatttacaagtgagttagccaagactctgggccattaaatatcctgcccattgtcctcagacagaggagccatgtgtcaagctcatgtcttgagcacaattccttagatacagcgttataataaactcctttcaagagatgcaatgagtggacattttctctacataacatgtgaataagacacattgaggaatgccattaggacttgcccaagtaaggacagagaggatacactagcaacattttaatccctgattgtatttgaaatctgccaagtacaaaataaacatcaaaggcagctgtggcagccagatgtcttctttgtttcttctcatgtgagccttctccctgctcaagaagcatgaagctaagtgtgatctaaaaggctatctctgctgcccattcattctttggcctttgtacaaacactgccagcagtacatcacttagaacagcacagcacagcaatgatttctataacagaaacattaatcaattaaaaccggaagtaagccagcaaacacattttactgagctcaccagcaagtcatcatcgcatagatcatcagatagaaatgtttcttgactaaaaaacaaaaagaaaactaaactgtgagttggtgaccaggtaccaggccttgttttgtctacttgtgtactagaatattctctccctttctatttcactagtcacatgatgaccacaagtcatagagtaatattttttaacttactgcataaatggtggggtttatcactttagtttctgtcaccttaaaaaaaatatggtttcttcaaagaatttagataatcaccaatgggaaaaaaatgaatacttctcatggtaaatggaggaaacaaagaaggaagtaagccaagcaaggtgtcagtgaaatttataggcttttgacctgggagagtagttatcttaggaaatttactgtgaaattgactatagtttaacctggtattttgatagctcaaagaaaccatattggattatttaaactggaatgatttgctctatccctattttctcaaaggaagtcaaataaaaagcatccatatggttctcatttgcactgctataaaaactcatatttaggtggcatgacactgcaatatacctggtataaaaagcagcatttttgagcactttctatttgtcaggcacttttcagaacagttttttttatattaactaacttaacacataggtcacagtgtggttaagtaacttgaccaaagtcagtaagaggtggacctaccttctcagccattacgttctacttcttaaatatcacaatatgttaaatgtttattcagcaatttaataattttaaaaaattattaccaatttcaaaagcatgagtataatccatttgatattaagataatatcaataaggacgtttaaaaatatacttgtgtaagtctagcctttatattagaaagaccacccccccccgcccatgaccctaggagtctttttagaagtaaagtaagggaggagagatttaattttagtcactctcctttttagtgtgacagagaaacctgaacgttgttacaatggagaattgccctgttgccaattgcgaatgtctccattactgagtacttaggagaagactatggacttgttgatgagataaacatgctcaaaatttgacatgggcatccagttctgatcaacaataatactttctcttattgctcccagaatgccttactccaaatagaaataggaacaatatcagtaaacactcgttgctgtcctaagcatcactttctgccttgatggcagtggggccagccaaagagtcactgtcagctgattgtgggtgagtgtttagacaggattctttaagtgatgaccgtcacaaacacaacccaaaatatctatcaaaaaaaaaggaaatttattgaatcacatagctgaaaattccagaagcctcttgttttagacaatgctagatccagataccaataaaaatcagttatcattagaaatctccctcagctctacttccctctgtgttttattttcagaacattctccatgatatcagagaatggtatcacacccacataaaataatattttgaccaaaagaagacagagatgcccggcagtaggaaatagcagactacagtgtgccatgatttcttgaacgataacaggcttattttcgatggggtggctatcagtgttggagcctttactcttcctggaaaaaactgcagttgcaaatgcctttttctcatccttctgctctcaccttattcttctctcatatcattggcaccagtatatatacctggtcatcaaacccagaattccaatatcatccttctttctcactaagacctttatttctttttcattattattatactttaagttctagggtacatgtacacaacgtgcaggtttgttatgtatgtaggcatgtgccatgttggtgtgctgcacccattaactcgtcatttacattaggtataaatcctaatgctatccctcccccctccccctaccccacaagaggccccagtgtatgatgtttcccccaagagtccaagtgttctcattgttcaattcccacctatgagtgagaacatgcagggtttggttttctgtccttgcaatggtttgctgagaattatggtttccagcttcatccatgtccctacaaaggacatgaactcattcttttttatggctgcatagtattccacggtgtttatgtgccacattttcttaatccagtctatcattgatggacatttgggttggttccaagtctttgctattgtgaatagtgccacaataaacatatgtgtgcatgtgtctttatagcagcatgatttataatcctttgggtatatacccagtaaagggatggctgggtcaaatgatatttctagttctagatccttgaggagtcgccacactgtcttccacaatggctgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggctgcataaatgtcttgttttgaaaagtgtctgttcatatccttcgcccactttttgatggggtcgtttgattttttcttgtaaatttgtttaaggtgtttgtagattctggatattagcccttggtcagagggtagattacaaatatcttctcccattctgtaggttgcctgttcactctgatggtggtttctttttctgtgcagaagctctttagcttaattagatcccatttgtcagttttggcttttgttgtcattgcttttggtgttttagacatgaagtccttgcccatgcctatgtcctgaatggtattgcctaggttttcttctagggtttttatggttttaggtctaacatgtaagtctttaatctatcttgaattaatttttgtataaggtgtaaggaagggatccagtttcagctttctacatatggctagccagttttctcagcaccatttattaactaggaaatcctttccccatttcttgtttttgtcaggtttgtcaaagatcagatggttgtagatgtgtggtattatttctgagggctctgttctgttccattgatctatatctctgttttggtaccagtaccatgctgttttggttactattgccttgtagtatagttggaagtcaggtagcgtgatgcctccagctttgtccttttggcttagaattgacttggcaatgcaggctcttttttggttccatatgaactttaaagtagttttttccaattctgtgaagaaagtcactggtagcttgatggtgatggcattgtatctatacattaccttgggcagtatggccattttcacgatattgattcttcctatccatgagcatggaatgttcttccatttgtttgtggcctcttttatttcattgagcagtggtatgtagttctccttgaagagttccttcacatcctttgtaagttggattccgaggtattttattctctttgaagcaattgtgaatgggagttcactcatgatttggctctctgtttatctgttattgatgtataggaatgcttgtgatttttgcacattgattttgtatcctgagactttgctgaagttgcttatcagcctaaggagattttgggctgagacgatgggtttttctgaatatataatcacgtcatctgcaaacagggacattttgactttctcttttcctaactgaataccctttatttgtttctcttgcctgattgccctggcaagaacttctaacactatgttgaataggagtggtgagagagggcatccctgtcttgtgccagttttcaaagggaatgcttccagtttttgcgcattcagtatgatattggctgtgggtttgtcatgaatagctcttatttttttgagatacgtcccatcaatacctaatttatcgagagtttttagcatgaagggctgttgaattttgttgaaggccttttctgcatctattgagataatcatgtgtttttgtctttggttctgtttatatgatggattactttacttcttaaatagttttttcaaatcaatccaacttatccctattactgtttctctcccttggataataacagtggtattataattagtctttctgactcctatcttgtcccttcaaatccattctccgtgttgttgccactataatcagtctgaaacacaaattctgccatgccacttccctgctttaaaattatcaagggcttacaattgttgtcagaataatatccaagcgattttacctgctgcgtgtgaatagtatacacttctagaattttgctgcatcaaatgttgccattagctatatgtagcaatgtagttttaacttcaattgaaattaattaaataaaatttaaacttcatgtcttcagcttcactagtcacatttcaaatgcccaatagccacaggtggccagaggctatgtatcacacagtgcaaacatagatcatttccatcttcatagaaagtcttaatagtgctgaggttccatggcctcatatctgtccactacccaactattttcttaaaatagtgctgaacaactggtagtttttgagtgagtcatacatattcatgtctctgtagctttgctccttctagtactgtttggattgctcttcatgtattgctagataatagccactgaacattctttaagagtcagcaaaagtgtcaccttctctagaagccaactctgaaaagtgggcttcagccaagcgttttcaaggtattctgtgcatttgctcacctaaccatatcacagaaatattatctggtttgtgcctgacttcctaagtgacaacaatggaacaaacaaacaaaaatgtcttgttctgtgttgttttatcagcaccaggcaaaatctgtggcatgtagcaagtgctctgatatatgttttctgaaatgtaataaatcatgtaaagaggcaaattaagcattttaacctcattaaacaaacaaaatacctactttaatttttgcaattaatgtaagcagtagctatccttgattttgtacttgtctctagtcctggcctaacctcaattcaactccaacatcatatgtcagcctcagaccatattcaccctagagctgttttcctaatttctttacttacttaacacagggcaaacctaaggaatgagttgaagtaagaggatctaggttgaacaccttttccaagaataacaatacagaaggaaagtttacattgttgtaggttgcctcagtgtcatacattcctcagaatatttttacccacgagagatcatatttcttctttatatgaagcactgatggatacagtatccatgaaaataagagggcccacttttctagagatataacatggttcacttaaaacatgtttagggacgggaagcccagcattttcacttgaaactgttctcttctttttatgtttagatttcccacataccttagcgtagatggaggttcccccacaaaaagtatatatggctacttctccttcttcttcctttccaggagaaactgggagagaagtggcattccaaagggactctgcaagactgtcccatgagctttggtaggttttgcataatttagaacctaatatcccagcaattcagttaaacattttgcatgtcagtctaaatagcatctaaatcttttgttctttgacatttaacatcattctgttcattccagtaaaggttgttgcctttttttttcaatgactttctgacctgtctttaaagtcagcattccaatcagtctccactgacgtacagagaatagtgacatattgacttttacaagaaatgaatcaaaaggtgacagaatatgaatcgatggaaccttagcactaaattttccatataaatgcaagtgtcaactaaacaaagggcttgcctctttgcatagtcaatgctaggtggtttatccacataatacacacttgagtcaaaactctgcataaccttggcctggtgctccagtggaattgtgggtcataatttttttaaatataaagttgacttttacttgaacacttgatcgtttaaattagtcctacccagttctaattttagctatgaaatgatgaatggaatgaaacctcagaaatttccaatacattgcaaaatacagattacttaagttacttcatctttaaacttccttggagcttgctttcgtctgcatttacatgggtattctgatgttcccattatactgctagtactccagcccattagacactcattcttccattgtcaaattctatttcgtgtttcattctgcagagtcccttgactgtttccggttttctctaggtcttctttccataatccaagagacccacaccaattaataagtcattaatattaattataataatgctaatgttagcaagagtttattgtacgtttagtttatgtcagtcactatgcttagaagtgtatccaaattatctcaggcaatcctcaaaacaattccatacagatagtattttactgctatttatccacattttagagataacaaaattgagacaaagagaggctatttaagtatcacatccatggtcacacatctagtaaatgtcaacgctttctcattcaagcccaggactgccaaatttcaaaatccaagctcctaaacagatactcctattccccattctgatgtattcaagtttaatttttgaactataaaaaaatctatttccatgtcacagtgtttaagaatatatcaacaatgtacattatgtcaatcttatcatttgaaaattattttaaaataagacacaaatattagctaatgcacatttacttttccctttctgaccttaatatatttagttataaattctaatctctataaaaccattaccataactaagaaatatcagccaaacattatatgaaaatagtttttttttaagactgtcagttgataacggaaaagaaaggagcaagagtgttattgagaagttatattactgcacaaagtagaggattgctttgtgatagattctctttgaatctgagaagtcattatttctaacagtacatttcagataacacatgcaattaaaatgtcttctttaattatcactaaagaaaattatttcaaaggacagcagcctatagaggtactttgccatgacagacaaacttaacaaaaaggatgaagaaagaagaacgcaatggataaggaatgtaaacaaatttatgaaagaaataaaataaagggtggcaagtgaattagcaaggtggaataagtaacaactaaaagcctacaggatattgacgtaggagtgggaactaaaaacgaaggaaaacagaattagttttgagtgttacatggcggatgaaccacataatcctcacccactctgagcaacacggaaatgatggtctatcttatctccatctggcaggagagaggagggatagtttctagagatacaaaaaaaaaaaaaaagatttttgacctcaggcccgcaagtacagtgaacgtctggggtaaagtatgagtttaaaaaagggcggagatacagaagagtctcaatgccaaatggtagaaccctgctcataggactctagaaaaggttgacaaaaccatgcccccaagccctcctttttttctttctttcttttctttttttttttttgagacagggtctcactctgttgcatagactggagtgtagtggcacaattttgggtgacggcaacctccgcctcccaggctcaagcaattctcctgcctcagcctcctgagtagctgggattacaggtgcacaccaccacaccccgctaatttttgcatttttagtagagacggggttctaccatgttggtcaggctggtctcgaactcctgacctcaaaagatccacccgcctcggcctcccaaaatgctgggattacaggcgtgagccaccgcgcccagccgccgtcctcttaccataagcattaaggcaacagaaaactagaaaaatgttctctggaagaactgaataattacagggaaacaatctttgcatactctcattgagagtccagctgattgtgcaatgactcagcagtgaagtccacagaaccacaaataccccctttgcccatcagtcttcaaccttttaaccaggtttttattctttcattcttacatatgtacagacacgtagacagctgatgaaagccttcaatgtcggggaaaaacaactaccagaaaatggagggcaaaaaagatacaaaataaggtaaggctaacattttcaaaaacctcaaatttatgtcctcaaacaagtaagaaaatgtattgggttaagaggacagtaagagagaaagagaaagaaagaataagtcaaagaaaaaagatagctcttataacttaaaattggataatcaaaataaaatttgggcagcaaagtggaataatagtataacagttgaggaatatcccagagtagaataaaaagataaataaatgaaagatactggaacagtatgagaaaatcaaaaggtaattacaaaagatttgatatttagataacagaaattttagtaaaggaaataaaagcaaaagaattatatatttttctaaaaagtggaaatgttccagattgaaggactgatgggattagctgaagataaacctgcattatgaaatttcagaattctagagattaagaaaacttctaaatattttctgcatggactgaattgtgtcccccaaaattcatatgttgaaaccttaacccccaatgtgacaatctttggaataaggaagtaattaaagtaaaacgaggtcataagggtggggcctcaatcggataatattggtgtctttataagaatagacatcagaaagcttgctctttctcttctccatgtgaagaaacagcaagaaggtgatggtctgcaagacagacagccctcactagaaaccaaatcagctggaaccttagtcttggacttcccagcctccagaactgtaagaaatcaagagctattgtttaggtcactcagtctttagtattttgtaattttagtcccagcacactaatacactttcatagaggaaaaataatcacatgcaaaggatagggatcaaaataacatcagactttccaacagtaactttggatgccagaatacaatacagcaacatctttaaacattgagagataagtgactctgaacctataatcataaccagatatggggttatcgactagaatccagactggggttttccagagtaagtggacatgcagcaagcaattaatctccatcagtttaagtttagggtattttgccatagcaaagctaatgtattgaaaatttatgtcagataattgtatgttctagtcactttaatatttctagtcactgtaatatttccatttctgacataaggtgtaccacccagtaccatctctccctatttctaacaaatatgtagcactctcacataaagtatcttaaaaggcaactttaaatcaaatcatgtactttcattctacactttattggagatctaatatctggacatgcccaacaatccctcaaagttcctcagattttcagttaatgcttaattttttattgtatccaaggtattcccttttggatagggatacagtgatcccaatccgcctttgaatagtttatttgtttatgtatttattcatttatttttgagacagagtcttgttctccacccaggctggagtgcagaggtgcaatctcagcgtcctggctcaagtgaccctcccaccgcagcctcctacgtatctggcactagaggtgcataccaccatgcctagctaaattttgtattttttattgagatgagggtctcaccatgtcacctagactggtctcgaactcctgagctcaagcaatccccctgcctaggcctcccaaagtgctgggagtacagacatgagccatcatgcccagcacctccctctcacatatttgatacttgattaagaaacttgaactcactgtgcagcttagcagcttataatttagctattgcttagttaactgtagtcttgtttgaatgatatactatttcgtcagtactctcaactattttaagtttgctcaaggaagagacaataggttttaatttcttttcagacattaacacaattttaaacacaataggtaggcacaaaataggcacttactaaaggtttgctcaataaattatgtcttccgcagggtgctgtggctcacgcttgtaatcctaacactttgggaggccaaggcaggtagatcacttgaggtctggagttggagaccagcatggccaacatagggaaaccctgtctctactaaaaatacaaaaatcagccgggtgtagtggaaggcacctgtaatcccagctacttgggaggctttggcacgggaatcgcttgaacctgggaggcggaggttgcagtgagccaatatcgtgccactgcactccagcctgggcagtagagagagactcggtctcaaaaaaaaaaaaaaatagattatgtcatgttctccactaaggacatgggagatcatgttcatttacccagaaaataccatcaatgacttctgtgttatagattattaaatattgtcaatattttgaggaggcttcaccctttgtccatgcatgaatctgaatcatctgacttcactgtcatctggtgtgacctaggaatggaaactagttttaacaccagctcaggcagaatataaatatgaaagtaatttcctgaaagaaaactattgcatcctaaggctaaatgttaatgacttcatattttccaggtttatgcattatctcagccacatttccctgttaatttatatattatataatggtagagtgagagtaaacactggagagcacttagtccagcaaagtattttttgcatgagatggagtgacgtgcccagagtcacatgacttgataatgataacagaagcagtggggccagtgtaatcagattccagtgcatgtacctcccagtgacctaagagttggatgatgtcatttctcttgttgaggtttttttttttttttttgtatgtagagatcgagcgccatgtctatcacaaagcatatgagctgatgtttcctggacttaacgtatataacactaaatttcaggaaaataatttagcaaggtagctaaatgcttctgtatataggaaatgctgggtactgcacagcgtaatcaagacattttgtttctaaatctaattctgcaaaatttcccttccatttccccttctaattttctattagaataaagcaataaggtaaaatatattaatcaaagtcatcagttcaggagaacaggaacccctagaattattcaaaccatcgacttggatgaggtagttcacattattaaattaatttgaagagtcattaattaacttccttgcatttttaaatttcatagtaacatgttcaaggatgatagagcattgaacttcattagctgattgtttgactcagtatttatagaagactgctacttattcagaaattcagttatttgtaacactgtttttcttactgttacattttaatgaatctcatgtcttattgtcagactcactcacattcgataaagggtagtggtaggagctatcttttatttctattaatctctttcccgaggttcattagcagggaattctttcctgttagatcaatggcaaaatcaccgtctgaagtcattttgccttgagcaataatctgaacatctttcttggaaatgatccgcgtgcccactggaaactttgagaagtagtttttaattgcatttttgttagattctggtgctgccaagccctgttttgatgcctgagacagtatagaaacaatttgaaatccacaacatgggaagattgtggtgccagtcaagctgactgcacattagcaccaatgttctttacatacaggtttaataatcagaagaagaatcctaagtgtttaataattgaacatgtgtttaatatttaagcagccagatctttccagttgttaaactaatattgaagtagggtgaaagcattctacttactggcaactctccatcttacaaatatcttttgaagttcagtacagtatagggtctatcactataccgtctggcggacagtgttacttatcataaccaggaccaaagacaatgcagaagctttcttcttgtcattacagccatgtgtaaaacttatatgtgcaaaaactatagtcataattaatgattttttttaatctcacattttatgtttttttctttctttgtggctattgaatgcaggaatagctatcctgaaaatgaaaaagaaaataaggcaatgtttacatcaggttatgtgctgggaattatttcacttctaactaatcttcaaattgcaaaggagataattatttacttaaatacttgttagcccagagttttcctgtactgtccacagtgacttaacaattttccttaaggattgttacatattgacaacacttgtagccttagacttcacagcagtggctccaccccaccttccaattgaccttgtacattcttgttgcaaaagatatgttcagtttactgatcacaaggtattttgtattggagcagttaatttcacctacgtgaatatgagccagagggttttaaaaatcttatatttcttccaacaatacctgttcttgatatttctgctcgaaattctgattttaaaatgataatcgtgactttgaaattcactttatttgattgcagccttatcttttccaccaaggattttaggtgactgccatgcaacttagttccagatggccttgaattttcctagtatagcttcttttaaaatttgcatgaggaaattaaaatgactgttttgttcttgatggatacttcaaggcaatcttttagcaaaatctcatacttttgcacaaacttttaaaaacttttaagttcagaggtgtaagtgctggtttgttacataggtaaacttgtgtcgggggggtatgttgtacaaggcttaatatttgggtgataaatttaaactttaaaaacaattaaaggtatcccttatagactagcagttaagtgtggctgctcattagaaatacttagtgaactttgggaggccaaggtggatggatcacctgaggtcaggagttcaagaccagcctaggcaacatggtgaaaccccatctctactaaattcaaaaagtagctgggcacagtggcgcatgcctgtaatcccagctactccggaggctgagggaggagaatcacttgagcccaggtggcggaggttgcagtgagctgagattgcaccattgcactccaacctaggcgacagtgtaagactccgtctcaaaaaaaaataataataataataaatacttagtgaattaaagatgcctgggctccacacccagaaaagctgattcagtgtctggggtaaggtcccatcacatccgtatttttctctttcccactgattctactgcctagcactgtgaactgttacacaataactgatggagaagaatttcatctttaatttttctgttttcttaatcatgtgaaaaggcaaatataaaataatgaaacaaacagttcatgaaaagaattggacagcagagatcttgagaaatcttagccaatcaatacggtcggataagatttatgaggtacgaggccatgttagccgtgactattctccttctccttgcatcatcttactaactctaaacactgtgtgatatttgactttgattctttaatcctttttaatgttgtaatatttcaggactcttatatcaggaaatgcttacttaaattttctccaaatccctcacgtcatataatatttgcttcttacatctcttgtgttgtaggatttgggaaaattctatttttcgccactggactttaattctatgaagttgcacctcatctttccctcctagagataacgtgcagcttacatgatgacttatgaatccataaatgatgttcatttgtttctgcaaactgaaaatatatttacactttggtacttctcttaggtaatcagaatgaaaatttcctagggaagaattttcatttaagtggctggagaaaatattttgcatcagtgaagatgtagtgaagagcacttgataaaatacattgtcacatttatgtctaaggtttttcctgtctaattaaaacagcagagcaggggtgttcacttactgtttcaacttgccaaatgattctgaaagtctgtgacctgtgagtatattctttcttctttctgctgcgtgaattgaaaccctgtgtgcagggtaaggagtgaatcccacttagatagtgactagcgagcagcagcaataaacctacactaaggcgtaccttcaaacatacttattctacttcttctttgcactgttaatactggcctttcctgacttcagcctggattatccattgcctgactgggaaaggcagattgttagaacataaatgaaagaaagagtcagtgctcagtttctgagctccagaataggcccttgaagctccttttgagggcaatctttgtgaaacaaagcttttaatttgccagaccctggctctctaaaaagaatgaacacatttatatctttatagatataaactggagtttcttccacaatgtaggaaagcctcctgttctacagaatcaccccctaaaataataagattttttgaaagaataagatggaacagtaaaaacctacgtaactttgtaatcaaagaactaataaaaataaaaataatcctaacgtaagtaaatattaatgtagtgaaatttccactgaccttggcacctaacatgatagttgatcaaatttttataatataaagttcatacctctttctccaagataaatttctttg

SEQ ID NO: 625 - DNA, 1349122 bp, Homo sapiens
  misc_feature (90903)..(190902): n is a, c, g, or t
tgatttaaaacacaaattatttgcttatttttcacactaataacaaagaatatagacactatatatgttccaatcacattgatcatgcagaaaataaatattctttggtactggttttcctttgatcacaaatagatatgagggcaaaatgtcttatcacttatttacaaataactgatggccaaaatggataattgtcatgatagaagttattgacactggctgggtggggtggctcatgcttgtaatcctagcactttgggagaccgagaaaggtgggatcacctgaggtcaggagtttgagaccagcctggccaacatgtagaaaccctgtctctacataaaaaaaaataaaaaataaataaacactctttggttttggtggtgggcacctgtaattccagttactttgggaggctgaggcaggaaagaagttattgatacaaatatttgcaaaaataaaaagttatttgatacccacaaataattccaaagtatgtccatgtgctaatttgtaaataggaaggaagttcttattttgaaacttgcagcctggaaaatatttataaggttgttatgacattgataactggagtacttcctatatcaacttactagaattttggagactgactttaaaatataataaaaagggaaagacagggaattgaacttccttctcatgttttttacaaattttacagggagccagtctcatttatgtaatcacagatttattttacaagtttggacttgcaaaaatatgccaaaatttgaatgccttacccatttttttgggaagcagctaaaatatgtaatgcactgaccttttaatgttcactttgattggttaatggttacacctttacagctcagtcagattgtaaacaaggggacaaaactgaatatataaggtcagagaagtatagtgacaaaatttatgaacccctatacatttcctatgaataaaaaatgattaaaattcatacgtttgctttttaaatatatacataagaaacatcaaaaattaattcaaagcatatattagcaaatatattcttaattttgtcttgaataaccttctttaggtgtgcctttttctacaaagttatgtcttcattaaacatttttcaaattattagtattattatttttaactgatgcttcatattttatttcccctctgctctcccatcccacctttggtgatggttgtgcccatctgagcatttcggggcacatgaccgtaagtaaatcttgagagaggagtggaattattgtctaaacactaacagaaggggattacctgtaaggatagcataactgttgtgcaggaacagaagctgcccagatcttcttggtggagagtgcatagaaaaaagacttagaattatggaacatctgtccccccaaccaccctttcccacccatcccccaaacccccactcccaccctattccccgcccaattaatagtgttaacaaaaggttaatctaacttttttttttttttttgacggagtcttgctcagtcgcccaggctggagtgcagtggcgcgatctcagctcactgcaagctccacctcccgggttcacgccattctcctgcctcagcctcccaagtagctgagactgcaggcgcccgccacgacgcccaactaattttttgtattttttagtacagacggggtttcaccgtgttagccaggatggtctccatctcctgaccttgtgatccgcccgcctcggcctcccaaagtgctgggattacaggcgtgagccaccgcgcccggcttccagaatataaaaaatgagttccatgacgacagggccctcactgagctggcaggcccctccatggatcaccggcaccaaggcgctgtccaaatcattcatggactgcgagggaaggggctggccgctgctccctgcttgatagccagcctgatctgagtcaagtgttacacgtagtcccagtttggtcattccatcctccttcagaagcttcaggagcaaggcaaaaagccttggcaacatgctcagtcaatctactgtgatccgtaggatcactgaggcaattgtgccggtcatcgtttccttgtaatcccagcactaggatttctaggaaatcctgggaatcgttttctagaaaaaacacctctgtccatatgatgacttttccatttgctttgtattctgatccgtggaatatcttcacatttgttatagtctccatggacttcccatctataggacttagacacccttgctaacgttcttgtcatcatccacccaccggatgtgcatgcgctcctggggatcctccgcgtctgccttcccacaggtgatgctgaagtccctcgtctctagcagtgcctgcctcgaggaatccatgttctctgcagtgatctggaccataacgccatcttccacaatactggacttggcaaggtatccagaagaggatttcagagcgccaccgaacacaaaaaaactgctttgagtttgcatatagttacagtagtactgaaaaatcctcgcaatttaggtttttgttttcagttttctctgttttctagtgcataatgacttaataaatattcatttaacaaaaattgaaatctcaaaggtacatataaataaacaatataaataaccatccttattacagttaactttgtgctttaaaaaaaaaaggcatccaaagaaagacagacgtattcatgcaataaaatcttagcaatccctgcaatagtttaacagaattatcagccctcccatcttagtctggacagaatgaaaaaaaaattagttctctcgtgttattctttgagctccaactaggaaaaattactgaaaacagctggacgttacaactgttttgggcagagaagtcacactgttcaggaggaccccatggtagaaactgttttaaaaaagttctttttacttgaaattacacaagaaagcagaaaatgacattgcaaaaaggaaaaaagtataggcaggaacattgttacagaagccaggtgacaatgagaagtagagagtagaaagcaatcaacccttttgaccactgagaatgaggatagtagaaattcaatggctcatggatagcaatagtcactcacatgtcaataacagggattctgaagagtcagacttatgcatacacagagcatctctaccacatgcatgaattatgtgtgagtttggtgataatgaagagagacaaactgctgcatcaactaatatactctgggagtgaagagcaggataaaaaaaaaactgtagagaccactactctaggtcatttaagtattttaaggagaaaaaaataacataatagaagaaagtgataactatctggagtggtgggatgggtggcttctgacacagctcccatgtttctgattccacctcccgatatcttgtattatctccccttcttgagtatgagctggacctggtgccttgctggtaagagacagaattcaacaaaagtaatgcggtgttacttccttggttagctaacaaggaactatgtcttgccccttgctagccacccccaactcttgctggcattccctcttgccctctcgcttgcttgctttgataaagagagttgccatgttgtgtgatgctttgtggagagacccacgtgacaaggaaccaagggagtttacagcacaacacctggcacaaaactaaagccaacaactatgtgagtgagtctgcaaataaatcattccctgtccagccttaagatgactgcagacttttaaaagagtgagagtcagaggccacagctaatccacatgtggattcccaccaacaaaaattgaaataatgtgtgttttaaaatgctaagtttgggggtgatatgttacatataaatagataaataataaagatggtttggcatggagataatgacagaaaggaattcgactattttaatagtccaatgaagaggtatgaaagatctgaatttggatggtagcagtgtgaatgatgtaaaagataaatgtgagattctataaggtaagattttataggacctaccaataataggggtgagaggaggatagagagatgggagagagaaagggagggggaaagagagaaaaggagagggagaagtggtaaatgaacaagatttttagttcaagtcagtaggaaaaccactggcagagttgttttatttaagcattaacaattactttccgagcaactgtgatgtgtaagacattatgttatctgtactagacactgagatgaaccctcaaaatggtgatgccctcaaaatggtatagtgcaaagtagaatgttgtgaaatttttcctaatggagaaattcatccaattagcatttgaggaaaggtatatgtgagttggactttggatagtaacatacagagattagcattagaaaggaagcaaaatatttcattagacatataaagaagtcaatagtttattttcactagattgcaagcatatgaaaaagacaacaggaaaatgtgtctcaattgtcagcctaaatttaacatcttattctgtagtgaaatcacaggacaagtaaatagatgtcttgcacttaggacaaattatttaagtttgttgaagaaatgagatgattgattttatttttaagtaataagtaatgtgagaacatctgcaatcagtaagatttatgtagatccaggctcaacaaactactgccgatgggccaaatctagtctgcagctcattcatgtaaacaaagtttcactggaatatagccgtcctcattcattacgtaatgtctatggctttgacagagactgtgccacctgcaaagtcaaaaatatttactatctgtccctggacaggaaacgcttctcaatccctggtctacatcataaaatggatttgagtggagagaaagaaaaaaaactcattaaaacatatggggtgttactgccttaaacaagtagtatactaacaatagaaatggaaaggaaaagttggagtgtgcatgtgggtatgcatctgtgtgcatttgtgtgtatgtgatgaaaactgtttaaatgcagggtacaatatagaagaggaggccatcgtggtgcttagatggctctgaattgacagtctcctccgttaatatttaagtgcaattttggaggaataagtctttccactcaactcttaagtggtttaatcaactggccatatttttttcctaatggttagaaaggataagttactcagaaggaaaagtagtactgattgagaaagaattataatggaaggtggggggtgattgcatacttctaggaaagctggagggaacagctaaaaaacagtatgatactgaacacttggatgaaagcatgagtgaaagcaggtgagagcagccctaaaaggacgccagtttgcaccaaaagtaaacactggttttcatgctgcctcttgtatatatgtatcaaaagatactggtacttaatgtataaattagaatattaacttttaaaatatgaattgaacttatatggggtttaaaaaaatcaattatttaaaaacatcaccaggttccttttgttgtttaaattctctcctgatagaactaaataggggtctcttaaacagggttcaagaagcagaaacatacataatggtactcaggattcaatgcattaaagattaatattccttgaattagaagagccgaactaagtatccaaacaccagatataggtctagaatagcagatacatctaagtaggtttcaactgtctaagggcacatgcctggtgcagggacatgaacaaattgtgagtaaacagggataaaagccctatgagggatgtttaacattgaaatgtataaagtttttatttaatcacaaagttttctatattggctaaaattttataatgataatgaattattcatgtgaaaattaaaaactgttttttttgtatttttaaagaaaaaagcacaaatacacccatagaacactgtgaaatattatctttcacaatgtacaccaggccaggaaattattgggctaatttgagtcttcaacaaaattttactttgtgaagaaataagacaatgctggagggaccaaggttttcatttgcctgtgctccttctgatgccatctttactctccaggtgaaaggatgtttctgagatcaatattcctctcctttgatagttaccttcttttaaaacctactgaacactgacttactcagctccactctattcttccccgtttcctctgggtcctttgataatagatgctggtatccctgtctgtcattcactcctatatggttctcaggatttgtttgctgttcctccctctgttaacctgagccttgcgggccaaagtaaattactctcccagcaccttttatacagagtggtccatagtagttttcctgacacctatgttattacacatttctctccaagaacatctctaaagctttatgatttatacatttgagttaccttagaccaattgacctaaacacaagatatgctgtcacattttaagctgcttcctcagaatatgttggttgaaatctactgcctctcccttgtccagggtttctaaatacccgtagggtagcttctcaataatatatattactaatagctcagaatgattattatactaacaagaactttttactttcattactgtgtcagaggactcggaatatcattagcaaaacctgtttagaacagccatcttaaatccttgttgaaccaattccagcatgcttttaatttaagtaatcctggcgccgtggctcatgcctgtaatccaatcactttgggaggccgaggcaggcagatcatgaggtcaggagatccagaccttcctggccaacatggtgaaaccccatctctactaaaaatacaaaaatagttgggcatggtggcatgtgcctgtaatcccagctactcaagaggctgaggcaggtgaatctcttgaacccaggaggcagaggttgcagtgagctgagatcgcgccactgcactccagcctggtgacagagtgagaccccatctcaaaaaaaaaaaaaaaaaaaaaaaagaaatcttgagtagtacattccttcccaagatgagcatgcaaacaaagataacatgactttttattctatatgtacgtttgaaagatctctttagtcctttaaaaacttcatgagatgtataattttataaatattgagatgctttgggaaaaatattgaagaaaggccatttgattaggcataaagcacttaaagtgaatgccaagaaagttgcataggtcaaaataggtccacaaaaatgtatagattaatgaaccttccaatgtgaactgactgtttctctgagtgtcttttataattatgggtgaaggctgaggattgggcctggcccagatatggattaggggtaaaataagcagtggcacacaaaagatattttccctgaggcatattgactgaattattgtgatatatgcaagaatgaggagttattccagaagatttcaagagacagaataaaatcttcaagagtatcacagcaactgggagacaaactcattgcaaagaagagagcctgccccaaaagcatggccaactcccttgttcaacacatttctaagattttgaagctgaatagggtgaaatgctaaagggctaagcccaatacccctgaaattaaaatttaatctccaacaacattttttgagactaatgagaagtagttcctaccagctctcaatcaaaagctcaaaaggaacatacttcagaaacagagataagccaaagatgccagtcttactgaaactaaaactgaatcctgactgctccaatatctgattgtattggtaatgactttctcccaacactatctgcttaatagagaaaagtgggaatacattctaaaactactattaccagaatactttattattcttttatacacaatgtccagcatgatacaaaaaacgtctagatatgtgaagtggcaaaaattgtattaatcaaaacacatgtgcacaataagcgcagctcactgattcacagttcagaatttagcagacaaatttagaatgaccgttgctaatataataaaagtaggcaaactggatgaaatgatggagattgcagcaaagatttaaatatctataaaaagtcacacagatattctaaaacagaaacataataattgaacttatgtcactgaataggcttgctttagaataaatgtagtaaaacaagttaacctgaaaagagattcatagaaataatataaattgatctatagaaataatctcaactgaagagatttaataaagcagaacaaaaaagacataaggcactgtcacaacatctactataactaaactggacataaagacaagtgagagagaatggagaagaagcaatatcggaagagccgttggtcaaaaattttgtaaaattgataaagaatatcaacctacttgcaagaaacttaacaaaacctaaggaatataatacaaataaaactttacctatgcagattataagctgctgaaccaaaacaaaactctcaaaagtaagtaaaagagcacaaataagtattccaacaaaaacaatagaagctggagacaatgaaatggcattttaacatgctgaggggcaaatttgccagtctaaaatttaataaccagtgaaaaagcacataaaagtgaagcgcagtaaaatatattcagacaagtaattgttgagagaatgtttgcctaggagaactgaactacagaaatactaaggaaagttcttcagactaagaaaaaattatcccagagagaagcatacaattagaggaagcaatgaaattaactgaaataaaagccttaaaatattggcacaagaagttctaaagatctgagtaagttctgtatgtattatagaaactacatttatgattaacacattttacacacacacacacacacaattccaaccacatgtggattacctggtgaatccttaccaaaacttaaggaactaattgaactagtcttacacaagcattttcaggaaataatacaaaagaaagaacactttaatttttttgtgggaagccagtaatcattgatacaaaaatctgaaagatattaaagaaaagtaatttataaagaatattcaccatgaaaataaacctgagaagtaaggataaatataattaacttgtcttttacaaagtttaaatgttgaataaaatatatgacaaagagtgggagtagctaaatagtgttcaactgctctaaggtccttacattgttggagaagtggaaaaagtacgaacatacttcagaaatagtagtccacaatagttgagaataaatattatatcctctaggataactaaggtacttaaggtagtccacaatagtctagaataaatattctgtaggataactaaaagtactaaaaaggaattacaagtattttaataaaatgaaaaataaataattattctaaaaatggaaaaaaggccaggcgaagtggctcctgcctgtaatcccagcactttgggagtccgaggcgggtggatcacaaggtcaggagttccagaccagcctgaccaacatggtgaaaccccatctctactaaaaaatacaaaaattagccaggcgtggtggcgcatgcctgtaatctcagctactcaggaggctgaggcaggagaatcacttgaacccaagaggcggaggctgcagtgagctgagatggcaccactgcactccagcaggggcaacagagcgattaaaaaaaaaaaagccaaaaaaggaaataagaataaaaaaagatagtacaaatataaaaatattaaatccagaatttgaaagattaaatccagaattttaatacagaagattgtttcagaagattgtttcagaagatgtggaataactaccactcttatagactgttgtgtgaatgtgaatctgaacaaccatcttgaaaattcttttggcgagatctactgaagttaaatgtttgcataccttttgacccagcaattccactcctgggtatatatactcaagatcaatgagtacttcagtctaacaaaagatatatataagatattcaattagcattatttatagtagcccaaaattagaaacagatgaatcatccaataacacagttatatattcataaaatggaatacccctattaaaattataaagtatgaactataggtatatacaagaatctcataaattttgaaaacctaatattgaataaaatcagccatatgcaggagcatatatactgcatgatactatttttatgaagctcattaacagcctattaacattaattcattaatggaatgaatctatataaatagaggtcagtataggagttatctttttttgggttgtagttgactgagttggcaagaagaaggtttatggggtatttgtaagatttttttttttttggaggtggagtctctctctcgtcacccaggctggagtgcagtggcacaatctgggttcactgcaacctctgtctcctgggttcaagcaattcttctatctcagcctcccaagtagctgggattacaggtgcccgccaccacacccagctaatttttgcatttttagtagagacggggtttcatcaggctggccaggctggtcttgaactcctaaactcaggtgatccacccgcctcggcctcccaaagtgctggaattacaggcatgagccaccgcgcccggcctgtaagatattttttatctgagttgttccgtgtatgaagctatgtgaaaattcaatgaggtgtatacttaagatctgtacactctgttatgtgtaaattatacattaatatttaaaagaaaaataagtagattaataaagcacagtttggttttacagatacctatctatgacccaaccattctacatttaagtatatacccaacagatatgactgggaattttttacaccaaaagactttcattataatattatttttatatgcagacactcaaaacagttcaattgtccaccaacagcagaatgtaaaaatattttatggatcattgatagagtggaataaaatacagcaattaaagaactgctgctacatctgtggtgtcacaaatatgcctgcattcatagaaatttcctcaggaaaaatgaatctattgtagaggaagtcagaaaagtgttctattcggtagaagaaaattaatgaggcatgaaagaggcttctgaggtgctcttgtttatggtggtcacatgactgagtccatattgaaagattataaaaattgtacacttatgattgatgcactttttagtctataacaatgtattcatttgcaggagctactctccaaggtaccacaaaccgggtggcttaaaacaactcacatttattgtgtcacggtttgggaagctagaaggctgaaaacaagatgtagtcaaggtagtttcctccagaaggatataagggaggctgtctgtgtctcttgcatctctcccaggatctggtggtttgttggaaatcactggtgtttctgagtttacagatgtgtcagcccagtcttccatatagtgtctgcatatagtcttccctctgtgcatgttccccttgtgttcaattttcccctttttataagaacactagtaatattggattagtacccaccctaatgaccccattttaactagataacctctgtaaagactctatttctatataaggtcacattctaaagtattgggggttagggcattagcatatattttcgggaaaaacacagttcaacccatagcaacatataattccatttttaaaatcccaaaattacatctagcctaaaaaggaatgaaattgaaataaagatcgcagaggcctgcagtaagccttgatgatgtaatacctgtttataaaccaaatgttagaatggcttgaaacagaattgaacatttttgcgctataagacacataggagaaattttaagtactttttttggatgagacattagtctcaacaagactgaatgattttcttttaaggtcacacatttaaatagttaacaggagaaatagcgaccagaatcatagtcaaatacccacctaccccctttccaagacaactaaggtctcaaattgcgcccatttttctcaaattatttctagaatgtttagcaaaagaggcttttaatttggcatatctttgtctacagttttgtagtttatgtaaagaaaggtagactaagggaatttcattttaaaggtgagaatcagaatgacatttgtgaagctatgatgcctgtgccatctggcatacacgagggtgttgtactaaatgggatcagaatgagctccttttggaaggaaacctttaatagactgggaaacattaagggaatcttccctttttatttttatttaattttctttctttctttctttctttctttttttttttttttttttttgagatggagtctcgctctgtcacccaggctggagtgcagtggcgtgatctcgactcactgtaagctccgcctcctgggttcacgcctttctcctgtctcagcctcccgagtagctggggctacaggcgcccaccaccacgcccggctaattttttgtatttttagtagagatggggttttacagtgttagccaggatggtctcgatctcctgaccttgtgatccgcccgcctcagcctcccaaagtgctgggattacaagcgagagccaccatgcccggccttttatttttaatagagcattggaaaatgaattctgcatagctagctaatgaaggaaatccagagtcattgccaaaaccgagttttaaaggaatttgcaatccttcacagttcattcaaggaggcaatggaaattttgaagaagaatttttttaaaatctttcttaaaaggagcccttacattggcattgtatcacgactaaagtcttgctccctccctctctcccttctatgctttttgtttctcttttctatctttcaatgacatcagtttcatggagataaatggttaaaagataatgattacaacacatacagttgagtgacacaaatcttgttgtagtgttagaaatacatcaatacattgggatcataaagataaatggcaagaaaaaaaatctaagttaataacagaaaatgctgattcccacagtccgtgtagaaaatacacgttttttcctgtcagtggagataactgagaccagttaatattgtcaattctgttccttctgactgagccaggtgaggcaaaatttagcagatgacttgagggacaaaactatgaccttggcaacataaaaattaatactgtctacattgtttactaggaaatgcatgcaaaattaatacactcttggtagtacaggttggtttcacttctatagtgtgtagttactagaaagctgattcaacagatgatagattcaacagacgacatagaattgtctaaaatccagccgggcgcagggcctcacgcctgtactcccagcactttgggaggccgaggagggcagatcacaatgttaggagatcgagaccatcctggctaacatggtgaaaccccgtctctactaaaaatacaaaaaaattagccaggagtggtggtgggtgtctgtagccccagacactcggaaggctgaggcagaagaatggcgtgaacccgggaagcggagcttgcagtagtgagcggagatcgcgccactgcactccggcctgggcgacagtgcgagactccagctaaaaaaaaaaaaaaaaaaaagaattgcctgaaattcatcttcaattagtccatggcatgttttggaatttattcacttgtttgcctcaggaacagtagctgttcagatttgttctttgattttggaaatgaggttaccgtgctctgtagtgtcaggaagatgacgtggcataatcaggcaaacggctaggcattttctcagcagtaaattaccagtgcccttgcttgccataatacccacaaaaggcagaggcagtttcctgaggcaatccaggccacaaagaactgtacatttggggaaaacgtatcttcaaatatatatgttaaaatctaaaaaattggttagtatgtattacttttgtggatatttaaacattccctatgcataaagacctagttaaagaggtgcaggcatttggcatgttaaataactccttgatgagaaaccacactatgaataataaatatgacttaataaaaatgaaaaataatgagattagtttctattgaactattcttgcttagaatgcccctgaatttcagtcatagaaattcacttgtacctgggtaagttacaagtacttatttgtgctggtttctgtgtcattggcaattaaaattttggtaagttgaataaaagatctttctaaaaagggagttcttttttttttcttttttgagggggacggagtctcgctctgtcgcccaggctggagtgcagtggcgcgatctcggctcaccgcaaactccacctcccgggtccatgccattctcctgcctcagcctcccgagtagctgggactaccggcgcccgccaccacgcccggctaatttttttttgtatttttagtagagactgggtttcaccgtgttagccaggatggtctccatcttctgacctcgtgatccgccctcctccgccttccaacgtgctgggattacaggtgtgagccaccgcgcccggccaaaagggagttcttacactggcaatgtatcatgattaacgttttcctccctctttctctccctcccacatatgtattttcgtgtcagtatatgtatatgtgatttgtgccatttgtgtgtgtgtaggtaaatgaaagtggcatcaagaaaatctcacattaaaaaaatttgagatagtacaattcttatgcatcatatgttgcataatgtttgactattaagaaatttgcatcacacgtctacttatttcattaaacatgttacaggcaattaatttacttacaccctccatttcttttttcccactctctgggtctcctgctgcagggtcattatatgttccactcacaaaatgtccttgtttttcccttactcctgtcattgatcttctgaatctttctggtgaatttagcatggatgttttgatagaaagctctggcattaactctggagttgttttgcaaggaagattgttctctttttcaccattttttttttaggtccttgaagtgttttcacatagatatttcacaagagccatttcagaactgagaacattcggcgtgcacttttcctcttttggtcccacagtttttatgagtcctacttgaaattatgtttgctcccgtttcaattgtaatattgcacttactcattagtttttagtttgaactctcctgggaggtctaatgtagagtttggacaaagacacagattcataataaacctacccagtcaatttggtataaaggcttagaaggtggaactggccacattttgaattggaggtaagtatcaggaatggtaatggagagacatacaggattttcttatgggaacaagaaacaacctctgggcagtattagagcccagagagtgaaaagcctcttctaacttcaatattctatgtacaaatttacaagacttttttttttctttttttttgagacggagtctcactcagtatcccaggccggagtgcaatggtgcgatctcagctcactgcaagctccgcctcccgggttcacgccattctcctgcctcagcctcgcgagtagctgggactacaggcgcctgccacacccggctaatttttgtatttttagtagagactgggtttcaccgtgttagccaggatggtctccatctcctgacctcgtgagccaccgcgcccggctgagacttttaattgacagactgcattgcataagccaaaggccaacagagaggtgacctttcaaattactggcacaacaggagccgagatcagaaagctccaacttaatgcaaacatcgacaagaaatccgacagaaatgacttctgtgtctggtcaacttaacataacatgacatattgtcaagcgcattttgctttttaggtagaattgtctataacgatttaactgctttagaaaatataaatgtgaagatttgtggtattcgggtttatatataagatatttctacatttaaaagagacagagtggaaaagcttgatataagatttgtaaaatatgtttgtaataatgctaatggaagaggtgagagttgggtggggtggggtgtagatgggaacatggtttggggattggggaaagggaagtcatgctgttaataaaatagtgaggcatgttgtataaagtgtgttttatgtctcaattgaaatgttatagagagaaatttaaaatagatcatgattggttttgaatctgatttctaattttaaaatgttatgagcttttgttgctttcctatttcatacacatttctttatgggtttcacttagactgcatgaaattgcagatgccaattaccttttaataaaattaaattcacatatatgtataatttgcatgtatatattcacggaattttttattctatacgtgatatattattttaaaatggtttatcaatgacataacgtataatttttctatactttcagttttctggtttggattttttctggcaacactaattttcacctacctatactcattgatagtataaagttgtacaagtgcatatttgaccatgattacagttgaatagatgactggaggtacatctatgatgactaatactttctaaacacatatttacctctcatatatctgtgtaaatgattgtaagaggaaggggaaaatagagatgtatcattaggtatactgtcttaaagcacattcagctgctctcatgtttggagaattttgaatgtgatgaatgtttctctttcaccgctaacaggttgtgtgtgtgagccagattttattgcaagtgtttgaaagactattgcaaatatcggatattgccagacagttggtaaaaagcaaattgagtctattgagaaattaattcaccagctgaaggaagcacatttgccttacagtcatcagatattctacccaccagactcatctccgagatagcatcctaatgagcttcctaaaccaactaaacatgagcaggaagcatcagtcgtcaaaactgactcttttcagccaatcagctgactgcacaaactgtatggcattgaggaaaggaagaacattctgaaagtttttttttttcattctgccctcactttgttggtttctcagttttacagatgcagtgtcatgcgcagaaccctgtaaatgagcatagttcattcaagtatataaagtgctttcgtgtattattattcagtggaataaaatgaatgttaacaggcttaagtgattttcctaaaggcacacaattaatgtatggctggaattcaaaatcgggtcttttcctctgttctgattgttctataaataggggtgtagtgattgattttctacccaccatgacagggaataggttcaaaacttaaaaccctgttcattttataattaggtagactcaaatgacaggtcaaggcagggaggggagccagtcatttttattcccatatgggtttgctccttcaaagacaggattggggtagcagggtcagttcctacaggttataacgatcttaatgataaagttaactaaccataactgaatagtcataatgtgctagcacttttcataatgtatcccaaataatactcacaaaaccttccaaataaatgttacctttttgttatctttgttttattttgtttgagacagggtttcagtctgctgcccaggctttagtgcagtgatgcaatcatggttcactgcagcgtcaaactcctgggctcaagcaatcctcccacctcagcctcccaagaagctaagactacaggcatgcaccaccactcccagctccaaataaatattcttatcccattttactgatgcagaaaaacgtatggcccagagaagtaatgttaagtttattgggggatttaagttgtaaaaaattattttatcgaaccctaatgtaaactatggactctgggtgatagtgatgcgtcagtgtaggttcatcgattatagcaaatgcatcattctggtgcaggatgttgacagtgggggaagctgtgtgtgtaagggagtagggagtctaggggaactcttctactttccactcaattttgctgtgagtctaaaactactctaaaaaatgaagcttattaatcaaaaaaaattcttatattttatgaatatatgggacagctattcatgtatgtggtaaaaagagatttgttacaatactcggcaggagtgtgtctaatatgactgatattcatgtgtcacttataaaaactggcttcataatctgtagattcatttcatttgtgtatgttcgcttaagggcgcacacatggaaacactttggtgttattaaaggtctgttgggagggctcctctttggtggaagctatgtctatttcttaaaagtgatttaagagtaagatgtgaaatagcacttgcccccgaggatggagccaacagagcataggggagttatgtgatgctatctctgagagactggagagaggaatataaaaagcttattccttaaaaaagaataggggaggacttccttacctgatatctcagattatgaagctacagttctctccctgctttagggaaaaataataataacatactttttgcaaaaatcaattactgaacatattcctatattttagatttataatgaagcatttttgtacatattcattaaaaaagagtaattaaaatatttttctctggtttatagtaactaggatggcaacacagatatatcttggaagtatttcttgggatgattcttcaacataaaactattcttaaaaacttcttagaagtctccaggtactcaggaataaggtcattttaaattattccttattgaccataagaaaaataattaggcaagaccacaaaactaaatgtttagactgtttctcctgtttcctgattttcaggttatttttttatcccaattttattttgctgtatggtcatacatttcatctttgaaataaagtatataataatcacttttttttttttttttgagacagagtctcgctctgtcgcccaggctggagtgcagtggcacgatctccgctcactgcaagctccgcctcccgggttcatgccattctcctgcctcagcctccccagtagctgggactacaggcgcctgccaccatgtccggctaattttttgtattttttttttttttttttttagtagagacggggtttcaccgtgttagccaggatggcctcgatctcctgacctcgtgattttcaaagctgttcgagggcatttatcaggcttttaactctaggtactctttcccgcagtgtgacggccaagagaagggatcctgggctctcttccctggccccaggacgggaattcagggggaaaattcacctactcttatcccacaaaagaaaacttattcatcagttgtcaagctaaggagcttcagagtccataaagagggaaattgctaagagcttatcagtagtgtccaccccgcatccccacctggggtcacatggagaatgatggtgggggcaccgatcttgtcctgcttcaggtgaaaagcaggggtgtgggggggtttcattgtgaagggctcctttgttaaaattccttccaattccaggaaaaacatgcactccaaaagccattatctcttttactttgtactaggggacttccaggaaagagagagaggagaaagaagagggcaaaacaactgcagtgaatttagtcacctctccaattgcctttcttgttgcagaatatttcacattccaggaatttccttcttgacctctggactgttgatacacccaagatcttaatatgctttcaatcataggttaaagacatcaagcgccagatcgcttgggcctaggagttccagaccggcctggacagaatagtgaaacccagtcacattttttttttaagggggagatttgctcttgttgcccaggctggagtgcagtggcgaggtctcggcttgtgggacctctgcctcccgggtttggatggttctcctgccacagcctcccgagtggctgggattgtgtgagccaccatgcccaactaattccctaactgtgcaactgcaaggtcactaaacaaactcgtcacaaaacatatttttccttaaatagtaaaaaataatataatgtatgtttcaattaaataagtatctttgtttctcgcttctataatatgcttctccctgcacagatctcccccttcgccccacataatgcttgaaaggtaactcttggttcagtactcaatcctttaaatgttaatccgactgggctggtgcacctaaataattaataaatgtcctcctaaaccccatgagtctatctaattccttaaaaatccctctacaggactgcaggtgtgagccaccgcaccccgcccaatttattaatcagagaggaatagatgggcctggcttggtggcttgcgcttgtgatccaaggactttggatggcagagcactggggatcatttgagcctaggagatccagacaggcctgggcaacatggtgaaactcggtctctttttttttttttgaggcggagtttcgctcttgttgcccaggctggagtgcagtggtgcagtctcggctccccgccgcctccgcctcttgggtttgggtggttcttctgcctcaacctccctaatggctgagattgcaggtgtgagccaccatgcctaattttcttttttctttttttttttttttggtacacacagggtttctacctgttggtcaggctggtctcaaactcaggacctcaggttatccgcccgccttggcttccgggggtgctgggattgcaggcgtgagccagcacgcaaagcccaactaattaatcagaaaggaatagatcggcctggcgtggtggctcacgcttgtggtcccaggacgtcggacggccgagcgcgggggatcgatcacttgagcctaggagttccacaccggcctgggcaacatggtgaaacccggtctctcttctcttttttttttggtacagacagggtttctccatgttcatcaggctggtctcaaactcccgacctcaggttatccgcccgcctcctgggcctccgggggtgctgggattgcaggcgtgagccagcgcgcccagcccagtttattaatcagaaaggaatagatcggccttgcatggtggctcacgcttatgatcccaggaatttggacggctgagcgcggcggatcgcttgagcgtaggagttcgttctatacttgcctgggcaacatggtgaaacccggtcactttttgtttgttttgaggcggagattcgcttttgttgcccaggctggagtgcagtggtgaggtcttggctcaacgggcctccgcctcccgggtttgggtggttctcctgccacagcctcccgagtggctgggattgcacgcgtgagccaccatgcccagctcattttgttttttgttcgtttgtttttgttgttggagatggggtttctccatgttcataaggctggtctcaaactccaacctcaggttatccgcccgcctcgggcgtccggaggtgctgggattgcaggcttgagccagcgcccaaggcccaatttataaatcacaaaggaatagcgtgggggatcgcttgagcctaggagttccagacaggccggggcaacatggtgaaacccggtctttttttttttttgaggcagtttcactcttgttgcccggttggagtgcagtggcgcggtctcggctcccggcggcctccgcctattgggtttgggttgttctcctgcctcagcctccggagcggctgggattacaggcgtgagccaccatgcccggctaatttttttttttttttttttggtatagacggggtttctcccttcgtcagggtagtctcaaactcctgacctcaggttacccgcctgcttcggcctcccggggtgctgggattgcaggcgtgagccaccatgcccagctttttattttttttcttttttggtagagacgggtttctccatgttggtcaggctggtctcaaactcccgacctcaggtggtccgcccgcctccgcctcccagggtgctgggattgcaggagggagccaccgcgccgggcccaatttattaatcagaaaggaacagatgggcctggcgtggtggctcacccttgtgatcccgggacttcagatggccgagcgcggcggatcgcttgagcctaggagttccaggccggctggggcaacatggtgaaacccagtccctctttttttttttttttttttgatagggagtttcgctcttgttgcccaggctagagtgcagtggcagggtctcggctccccgcagcctcggcctcccaggtttgggtggttctcctgcctcagcctcccgagtggctgggattgcaggcatgagccaccgtgccctgctaattttgtattttgtatttttttttttttttttggtagagatggggttttctccatgttggtcaggctggcctcaatctgacctcaggttatccgaccgcctcggcctccctgggtgttaggatcgcaggcgttaaccaccacgcccagcccaatttttaatcagacaggaatagatcggcctggtgtcatggctcgcgcttgtgatcccaggactttggacggctgagcgcggtgaatcgcttgagcctaggagatccagacccgcctgggcaacatggtgaaacccgtttttgtttttgttttgttttcgaggcggagtttccctcttgttgcccaggctggagtgcagtggcgtggtctcggcttcccgggcctccgcctcccgggtttgggtgattctcctgcttcagcctcctgagtggctgggattgcaggcgtgagccaccatgcccggctacttttttattatttatttattttggttgagatggggtttctccatgttggtcaggctggtctccagctcctaacctcgggtgatccgccggcctcggccttccggggtgctgcgattgcaggcctgagtcactgcgcctggcccgaaacccagtcccttaattgaaaaacaaaacaaaaaccacaaagattagcggggcctggtgggcccggcgggtagtcccagctactctgaaggctgatgtaggaggattgcttgagccggagaggggtgggggtgaggtggcagtgagccatgttggcgctgctgcagtccaaactgggcgatagagcgggactgtgtctcaggaaaacaggaaaaaaaaaaaagaagaaaaagaaagtacataaaattgctaaatcaaggaacagcttgacagtatattattgagagaaatagaggcaaaggcgagcagacaccaatgttcacttagtggaactgcagttgtccccagacaggaggctgctacttttccaaaagaaatctattattgacaaaaaaaaaaaaaaagggggtttgttacaatatacaaatagctaaactttatatagccacgaccctcttgcagcactgctctaagccttttcctgctctgaaatagctactattgttacctccattgtagagaatacagatgccagaggttgttgtggaaggaccatggaaactgactaggaaattgacttgtaagtttaggacttaaaggttcttcctgttttgctccttacattgccacattttagttaacatacctcctaaaatactggtcctttctatatttggagggactcgtcttgcagtttgaagttttttcttgcactaagcatttggtcagaagatcatgtgcgttttatgtcagtttaagtttagacattgttcagtaaggaatgtaaatatgagcaaacagttacctgattaaatagaaaacctagaagaaaaatcacctatgagaaagtcaagaaaatgtgaactctggatttgtggctattttcagaatattaatttttttggtatttaatggcattgtgaatatatttatttttaaaaattccttgtcttctgcagatacatatacggtaattaaaaaatgatatgatgtatagattttacttcaaaataattcagaggaagaaggaatgcatataaatgaagtgggaatataaatgaaacaaaactggctgtggccaggtgtggtggctcacgcctgtaatcccagcactttgggagactgaggcaggtggatcacctgaggtcaggagttcaagaccagcctggccaacgtggtgaaacatcatctctactaaaaatacaacagttagccggatgtggtgccgggtgcctgtaatcccagctacttgggaggctgaggcaggagaatcgcttgaacctgagaggcagaatttgcagtgagccaagatcatgacactgcactccagcctgggcgaccacagcaaaatcccacctttaaaaacaaacaacaaaaaaccaacaaaaacaaaaaactgtccatgccatgaatgaaaaattgttgatgatgtgtatatgtagggcagttacattatttttctcaactttttttacatctgaaactttttaatgaacacatgcacacgtcccttgataactggggctgcttccccattactctctcaatagcccttctgattttcacttcatcttcattcttagagactctggattttttattttttttggcaagttcaagtatgtcttgatctatgcaaggactagccagcatgtctacctactcagccatattatcagaaacagaaaaagtgtccagattcttgtcttttcctgttaagattttttaaattccaagaacagtcaccttctaccagacactctgatgttggaagacaaagcatatttcgtaagtggcatgatttctgtgctcaagtttagaacaaagccacagatttcaacatctcaaaaataacttactggactcaccaaatttagaaagatggagattattttaaaaaaagaaaaccttaatttactatgtgacctctaagtatctcagctgaaaattgtaaagataggtaaatcaaaagatgcagataatcatgcacttaatgaagcgctaaatcaaagtatttttggcatatgtgagtttcattttatcacattttttactggtactatagctatttgcaagtacatatagaactacagtgttacatataaactaccaaaaagcaactttttaaaaaaattttattattcttatactttaagttttagggtagatgtgcacaaagtacaggttagttccatatgtatacatgtgccatgttggtgtgctgcacccattcacttgtcatttagcattaggtatacctcctaatgctatccctccccctccccccaccccacaacagtccccggtgtgtgatgttccccttcctgtgtctatgtgttctcattcttcaattcccacctatgagtgagaacatgcggtgtttgtttttttgtccttgcgatagtttgctgagaatgatggtttccagtttcatccatgtccctacaaaggacgtgaactcatcatttttttatggctgcatagcattcgttggtgtatatatgccaccttttcttaatccagtctatcattgttagacatttgggttggttccaagtctttgctattgtgaataatgccgcaataaacatatgtgtgcatgtgtctttatagcagcatgatttatagtcctttgggtatatacccagtaatgggatggctgggtcaaatggtatttctagttctagatccctgaggatctagacacactgacttccacagtggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatttcttcatgtgctttttggctgcataaatgtcttcttttgagaagtgtctgttcatatcctttgcccactttttgatggggttgcttgtatttttcttgtaaatttgttggagttcattgtagattctggatattagtcctttgtgagatgagtaggttgcgaaaattttctcccattttgtcaaaaaacagctttttaagaaatgagactaatctagcaactttattgagaggacgtgaagtgtttggttaggaatggtgcaattggtggtggttgtggacatgtgagatgtaagatgcctcaacttccaatgttgttcagaagcaatccagctttctgaattattcttatgaattctggatttgaaacagtaacttcccaaatggcaggggctttcagcagagaggaacctggagggaccctgtccctgacaccttctgggttgttagctccagatcaaaagaactcctgatttggaaaaagcttcttgaaaagaagaggggaggtgaccttggtgaagcctctggggacatgagctatttttagggcttttggcaggaaaagagcttttgaaaacggagataaggcatggtattaaaaaggcttacattggagaaagaaatcataaaactccatacagttagggcaatagttttgttttttactaggacagcatcagtttattggagtatttatataacataagcaaggtctcttgatattttaacaattaacaactggattttattttctactataggtgcagtttatcattctgaatccaaagccaaggaatataaacatgtatgcaaacgagcttgtcagagagtatcaacgcaatgtgtatcatctatgcttttcagttttgaacataaagcagtggctctgagcgcgactcggagggcgacgccgcggccgcagccatgggtgctgggcctgcaggggcgcgggggggagggcgacgctaggacctgcggggccgggcgggagagagggctgccgggaccggccctagacactgagccgcggtgggatccccgccggctctgcgaggccctgcgagcgccagggaggcgcctcgagggagccgggcagccgccggccacttcaggggggcccgccacttcagggcggtcgaaagagccttgggggcacatctcggggtgcggtgacccgcccggcgcatttcgggggtcggggcgcatttgccaggggacatctggagcccggccctgcttctgtcgggctccagggtacccctggatggctgcgctgtgccctcgccggcggcccgggcgccacagcggctgagttcgccgggatcgccgggccgccgccgcccttgccaccggctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgttcgaggacatggaccaggcgctcgtggacctcggcgtgctctccgaccccggctcgggcctttacgatgctgactcggagctcgacgtctttgatgggtacttggagtagggtctcgactgccgttcccctcttccctccacgatccgcaacccacgccctggaccagccgcccagatcatggcgccgcagcagctggttgggggcaccatctggacggggatggttccccaggaggagaccctcccctgcctccgaggcctgcctgctaccctcaaaagcttcgtgccaacagagaggttcctgtttggacccaggagagtggaagagagattgggactgagtgctgagattgggaaggcacctgctcccacagaagggggaacgcaaggggcgtcccaagacctcatctgcctgcagcgtcacaccgatggcctggcctcggcttctcattatttgcaactgccatggatgtttacaggaacccagccagagtttgcctccctgcacttcatcccagagcgcacctgcttcctccacttcaccttcggagaggacacttcaaactgcggacacacgcaaaagcaactcccagctctgtttgatgtgagttgagccttcaggccagctgggtttagcccgaggctggtcttagatgcagcgactgtttcagggagtgactcagaataaaaagaagctgaggaagctgttggggggctgaggatgagattctcgcttcttcatttcaggttactcgttcctcagcaagttggcaaaacagatatcatgctggtgagtgccacgttactcccctggctgcaaatgcttttctgaaagtatgagtgtcgtgcctacttaattctgataaacctgtttaagcaatacttaggaggctgacttctttggattaaaaaaatgtatgcaactccaaaaaaaaaaaaaaaaaaaagaaattcaacatttaaaagtttcatttctagggcagtcttccggtttggactacaaaattattttgcttgtttttgtaggggatcgttttgtgttgttttgtgtctttctccacatgatgcttagctctttccccacgtcccagattaaagtctgtatttttgtaattgtgggcacacaatcatatctcttttaatctttgcaacgatgttgaacttctgtagacagaaggatagagaaaacagcttgaaggcagtcagtgtgtttttccatgaagggaaaaaaataaataaaaaaattaaaatgggtgcttttttaagagagattgtcctatactttttcattctgtttttcatcacgtagtttgtatcatagcaagttcattgtcattccagagttcagctttgcccttgtactcagttgtgcttttttcccattggtttttgaggttttgctaaactgttgaatatttaatgtggggacaggaatggactcagaagaaatgttttttattttgattcttactagtcttgtaggcaaaccttccattactttttatgcaaataggatctagttgaatattgtatatcgagtaaatatgcgtctctctctgctcttttcgttgatatttacataacattaaaaagattatactttatcagagattcaagctttttcttatgaatgaagccctataaataagaatattttgttacagggattttgttcttttgaaatttataacaataaagctaaaagttctctaagctgttttatattttttcttatttttcaaagtgtgaaatttttctatcatctgaaaataaattttatgtaactatagtcttagaaatttaatacatttgaattgtatatttagcctctttaatatttccaatgaatacacttcttaaaagtttaattaggaatacagttcttagtttttgagctttctctttgttgactaaattgaaatgttaataaatcatttataaatgacttttccttctctctcttttcctctcctaatttatgctcaaggccaggtgattttatagacctttattctgtgtagtttatattacaaaataatatgttacatcttgatttagaatttacattatagtatccaaaatgtttttgtcaaatgtgtgcttttatcctcagattccggcgcccctgtgactcagagtcacttctttttaggtatggagagtattaacggggaggagaaatgattcgtttgagatttagttatctatataaaatacgaattgtcaggatatttgaaccaaactgggtcatacaatttctgtggctattttgaatagccttacaatgaattaagcttactaaattccttgtacttttcatttaatagctagatgttattgttttaatttgaataatattaagtgagccatattaccaattaacctgaatataaacacttgcttgtttttaatctgagtagtttatgtcttaaagtatggaatggaactagtggtcaatttttattaatctaagtgtctcccatacttctttaagcttttggaaagtttgggaagttgtgattttgcaatgaataatctctccccttggtttcataggcaattgaaaagctgcaggcgggtgctcttgcaactgacgcagtcactgcagcactggtggaacttgaggtatttcttttctctgttttattgaaaatacttgtgagtttatctttattgttcttaaatgacatgaaactgttgagttagtcaaccataaattatatgaccagtgttgcccaccaatattagcacagttatgaagaagcctatgatattgttgttttcattggtgacttttctgagtaatatgaaagttggttaaattccttccttttcttgatttttttttttttgtgagattcatgaatacaaaagttagtgactggatactgaagtttctcattttcagtaggaaaatccttgaagttaacccccaaaaagtgatgtatgttctgttgtttaaaaataaattccaactgtctagaagtgcctaaagtagaaggggaagattcttcacgaacctaacagttagatatataccctgaaattgtgtgctgtgaagtgtgccttgtcccagtgttatggttaggtttgtccccagtttactgtggacatcgaataattgagtggggaggctctcacgtttgccataattttttatactctagagtgaggtcctctcagttctcttgatttggacccttgatgaatttgtgcaggggatattgaggtcttcagaagattgacttgctgctcgaacttggagaagatagatttgtatctatcagttgagaggattatcgtgaaaaatatttttctggttgagaatactccttagggaatcaagtaagacatgatgacgaaacaatgatgagtttgagggaggagatgatagttaaaggcgacatttccaggttgactgggttgtggcccttgtattcaggcgctcataccagggcacgcaccctttcatgcctttccttgtgaaaattgcccaggtgtttaccaaaagtcctagccgtgttttctgtatattctcatgcttaattgtggacctgagcttttgatcatgctttgtagattttaatttctcttggtaatgtcagattggtcctaatgtagtcaaggaaggtgaaagaatatggtgagcacctagttctattgaatcttacatggggatgtgtgatgccctcctaatatgactgatacatttcatgccagctctaccagtcattagccatgtgtccatgggtgtggcacagtctgtccttgactcagtttccctatttatgaggataataattcccacttcacagagttgtgaagattaactgagttcatatatgactaatacaggacagtctcttagaacagtgtgtggtacgtagtaagcacccataactgttagcaattattacagttatgaggtgctttggaagtggtatgtatgagatgaatatttatggtaactattaatgacaagttttacagcatcaaagaaagtttaattatatgttgaggatcagaggagaaaaatgacataagaaagaagatagatgtatttaccaccaaatgttacctttactcaaaacagacacacaaagagggcttcatctaacttaactaattcaattgttagttggaaattacttgcatggaatcagcataggtttgggaaagaaggttattgagtagctggagaatatactagaatggcaaccatgaatgcaaaactgaataaaattaagtttctctttttatcttagaataactttaattttcctaagtcatacttatatatcatgtttaatatttcattctattttcccctagtgttgaatctgacttttaagggatttacttatttatacttaaaaatgataagaatacattttgaaataatgagtttctcctgagtaagtggacttatagttttggataacttgtgtttttttaagagtgtggatatgaatttaaaggaaaaaaatttcttgttctattatttttgattggaataagtcataaggataatggtagcatagaattcttccccaagtgactttagagcatcccacacctcaacttttagttattttattttatatatatatatatttttgagatggattctcactctgtagcccaagctggagtgcagtggtgcgatcttggctcactgcaacctctgcctcccaggctgaagtgattcttgtgcctcagcttcccatgtagctgggactacaggcatgcaccaccacacccagctaatttttgtatttttttttttttttagtagagatggggtttcaccatgttgaccagggtggtcttgaactcctgagctcaggtgatccacctacctcggcctcccaaagtgctgcgattacaggtgagagccactgtgcctggcctcaacttttgattattaaatttgtggaagaatttcaattatctttaacaattaacttttctatggactctttgattgaaatacatgttaatagtttaaggttaagcttacactaacaggaagaattttcctaaatcttaagaattatgttggaaatcatgcttatactgccccctgcagtttctctcaccttgaataattgtgattcattaccttaaaacaggataggttttcagatggacttcagttggggaagtattgtaatagcttgggtcaatggaaagacgtaagaagattggattctaatatttttgtacttagaaaaatataagtagcagtattgagtcctttcagaatactgaaaagtgctgagaaaaattctggagagccttattaataatgcattatgtttaatttgagaataaatacttatcttagttttggtcagtctattcagttaagtcatgtctggattattgaacagatgcaaacagtcattgttctcttctctttagactttgggatatactttttgatttaaaaaatgatgttcttgccactgagcttaaggaaacaatacataaacatatttttaaaacttgcccgttatattattacttaggcagatattaaaattgatatgaattccttaaatactaattgtggattgaaatgactgaaatgttttaatggtctttattgcctagaaagagtatctggctgtatattttaaaaatgtgataatttgtattttcccaaatagtgaaaagtatactgatcttaactccatgcagtgaaggaggaagagacaaggcaaaagaaatatgtgtgtgtgtgtgtgtgtgtgtgtgtagtagtgtgttccacacacactaaagggaattatgcagacatatcattttttagcttttcttagagactgataattttgtgtcgttttatttttctttaccaccgctacagacaagtgatgtcatcttaagactgtcacttctggacaacagaatgaggtgttttcttcatttaagtaaaggaggagcaggtgcaaaagttcctatctattaaattgaccaccttctccctttagagttttgggagggaaggtggctgcttctgtatgagaggttttctgcagtgtggaaatgcaaatgatattactccaaagtatattttgtttatcttcaaaatgtagggaaggaaatggaaaggtcagtttatagatcatattttaatgatttattggtaagttgattcattcctgttgtttcgtatagcttttttgagattatcttaataactgatgagaaagtgaattctgttcactggatggtacaactctggtttcactcacagcagagaagattaatattgtgaaagaatttggtcttcatatttgggactatacatttggatgccagttgcttttttggctgcttttgaaatagttttggatcaagtagtgacagtggatttaagattccagaccataattttgcatatttcaaatggtaaaacttctaatgtgaatttcttttttgagaaaagtggatatagaactgggtgagtcatgatgctaccattttcttaggattgtttctaaaatagaaagtgtttcatggattctgatagaaaatgaactatctataaaatactgcctgaagctccttttgcacaatggtgtttttcttaaaaagtacaaagacctggtttaaaaaagtctaatgagtaataataggtgcaatatgaatgacagacttttggaaggtaatttataatcttttgtgagaaaactgatgaatttcgcagaggttttgaagatcttgttgtaacctttgagaaattttggttaattcattctgaaaactgattattttggtaggtagaataccgtgtattaagaatagtgataggggctgggcacagtggctcacgcctgtaatcccagcactttgggaggccgaagcggacgcatcacgaggtcaggagatcaagaccagcctggccaatatggtgaaaccccatctctaataaaaatacaaaaattagctgggcatggtggcgcgttcctgtaatcccagctagttgagaggctgaggcagaagaattgcttgaactgggacccaggaggcagaggttgcagtgagctgagactgcactgagactgcaccactgcactccagcttgggctacggactgagactccgtctaaaagaaaaaaaaaaaaaagaatagtgataggaatagcttttacgttttatgtagtaaaaggcaaattatacaggttcctttgttaaaaatcttttgttgaacttctgttattaaaaatggactgtgaagttttttattcacttaattcatgctttaaagctccctatggtcaggggagatgctaattcatggttaaaactcgtttcttgtccaaatgctttagcgtttatagggcagattatattgggccaagtttttagtcattctgttaaaaacagttcgtcgtctttggatctctgtgtaatacaaatattgcttgcttgtaaactctagggaagtcctttaagaataacttgttcagatgactgatattttggtatgtaagagaaagaaagtaggtattttcattatatatttatattatatataatactgttatacatttgtctgtatctttgttgttgttgagacagattcttgctctgtcgcccaggctggagtgcagtggtatgatctcggctcactgcaatctctacctcccaggttcaaacgattttcatgcctcagcctcctgagtagttgggactacaggtgtgcgccaccacacctggctaattttttttgtgtttttagtagagacggggttttgccacgttgcccaggctggcctcaagctcctggcctcaagtgatccatctgccttggcctcccaaagtgctggggtgacaggtgtgagccaccgtgcccagccaggtctgcatttctttaaggcagggatctccagaatgggaatgttggtcacacttgagtagttcattgtgagtggaccccagcgcaggcctcttgcgcagctgcaggaataggccatattctctcccctgggctttatacttccggctggaattgtctgtgtgcctcagggggatagaagaaacttctacggcctgccagtccttgaaatgcctagtggtcatggagatggtgtggcttcctgatggcatatgggcatacctaggatggaaggggacattgggaagagctgatacatttcccttttccctcaccaaacttataacaagttttcttgtgagcagatgcttaaccacaccctgctccctaccctacttcagtcatttggtttttattgcaaaaaaggaggggcatctactttaaggtcatttctgtgatttgggaagtttaaaattatttaaataaacgagcatctcatttcctgtacgtttttatttttgtagaaattatattttcataagcagagtggtcccttgctctttccccagcaccccctgccccccagtagagctgaccacactggaacgacagcttgatgcatttagctcacatttacgtaagtgctcattaactataatgtggctggtgagtctaattttagacctaccacccttgaaaatctcatttttcttttccattgataatatcttttattctctgtaaggggagtgggatgtgtttctatgtatgtgaagtagaatatttaccttttttcttttgtagtacttacaatgttttcattgcatgaaattggagttttgaccttaggtgctcttttttcctttttttttttcttaacttggtattattgatgatttcaaagatcctattttgcctgtctgtttagcagtattcccagtggtgcttcagtatttctgtgtattccagctgtttatggagtctttatgtttctctgcattttttattttttgaggtgtacacacacagttacgcttcatggagttgcatccagccaagtatccatgttcttcttgtgaagaggcagagaaaatcacctctcccaagaatttccaccttctgaacaagggaaatgtatccttaagagctgtatgcagatgggaggcaacttgtttgcttgttctgctgctagagcattggtttaattagaagacaggctgtgggtggccatgtgcagacaaagaagcaccagacagagcccgtttagcctgggtcagtaagagtaagttacactctttttaaaacacttttttgagtactgatgctgattcttgccttcagtactaaggggcaacttgtaacttactgtttgtgtttacacatagatacatctgttctttttctgagaccctagaaatgacacatgctctctagcacaaagtacctgcgcaatggaaaagcagtgatttcttccccaaccaccctttttttttttaagaataaaaagaaaatggaatcaatgattacattctagattaattttacactgtagcaaacccggtgttagcgtttgaccaagtcaaaacacttaagtatagagcttgtcatgcttttactttgtagtaatgggaacatgagaaacgattttagccttttccagccatttcttgataaggtatgtgggtctcatcagatacattcatccaggccgaacctagtagaagagagggtccaagatcagacctagcagttcctgaggagcatggaactctatatgtgtgcccttgtttttctctgggagttgttactctcaaaaatatacttcattttggaattcagttttgagctacctaaagccacatatggtagtgtggtggagttagtggaaatcctgtgtttttgactatgtgaaagcaatttagacttttggatttttgagtgtacaatgtcttctagtcctatattaatagggatattacacaaaagggatttaattagattcattggtcctaggatttatagtgttgtgatttttgaatctgtgtgtgtgtgtgtgtgtatttgtgtttgtttggatctgtatcatttgtggcatcaggtttataccttagcatctactgttttggtttgttttgctcttggtaatgaaggaagtaggctaaaaagatttttctatgtttggaaaatcacaggctggtatgatggtgtttaatttcaaagactaccttttgattttaagtttttttccatctctcaaacccacccctttattcagaatctggaaaagaatgaggaagaaacttaagttacataatttttaagattctcggcctggcacggtggctcacacctgtaatcccagcactttgggaggctgagacgggcagatcatgaggtcaggagatcgagaccatcctggctaacacggtgaaaccccgtctctactaaaaatacaaaaaattagccaggtgtggtggtgggtgcctgtagtcccagctacttgggaggctgaggcaggagaatggcatgaacccaggaagtggagcttgcagtgagccgagatcgcgccactgcattccagcctgggcgacagagcaagactccgtctcaaaacaaaacaaacaaaaaaccagattctcatcaagattctaaatcttgctcttctctctttctttctctttcatgtgttcattacctaagtgttagaataatgaaggattgtacctcactatagaaatcagcttaaagttgaatcttagacataccaattgacaaaagttctttggccattcccattgccaggcagtttttactggcagtcattctcactcagggtccagcctcctgcatggtgtacacatttcctgacagctcatgacacgcatgtactgtaacacaggacatcaacactataacacattcatagtggggaatttatttatgtttagtttttctggagtatgtgcaaatgtaagcatattttctagtgggttggaagtctttttattaaaaaaaccttagtagaggacttaaaagttactagtatccctctttcctctccagttctgaccatgtcatttgataaaaggatggtttaaattattataattccatggtctgttaggttcttcttgagtgatatttccatattattgtcaatatggttaaaaggtataattatttaggttgaagggaagtataagtagatgtatacagcagatggtagcctctagctgagatcccaaggagaatatcctgttactgggaaagggtgattatgtgtttatttagcaaacacaaagtgtttaccatgtgccaggtactctttaagcactttacaaatattggctcattagttttcacaagtgccctgagatgggtactgttgttagccctgtttgatgaggatactgatgcacagagtggttaagtaatttcctcaaggtcacatagctaggaagtgttggagccagaaatggaatcctgctgccgtgacccactcagtcaattttttttttttttttgagaccgagtcttgctctattgcccaggctgcagtgcagtggtgcaatctcggctcactgcaacctccgcctcctgggttcagacgattcttctgtctcagcctccccagtagctgggactacaggctcctaccattacactggctaatttttgtatttttagtagagatggggtttctccaagttggccagactggtcttgaactcatgacctcaggtgaggcacctgcctcagcctcccaaagtgctgggattacaggccttagccactgctcccggcccctcattcagtttaatcaacaaatgaacagcgtcactaaagatccctcaaactcagtgatgaacacatctgaaaaagttaaagaaaattaagttcaaagaagaaacttttcattgtcaccattgtcggtgaatgtagtgatctaaaaattctctttatcattgtgctttaaatagtgatttagttttgatctttaaatgtcaatagactattgatattttgatctttaaatatcaaatatgtatggactatgtgaatattgaaaagaaaatatgaacagtcacttttacagttcgggtttttgtcttaaaattttgttgtaatttctcttcctaatcttagatctgtttgaggagatggtgcctgtgtcagtgtggcagtctttggctgcctgtgatcagaggaaagccgatttgttaacagatcaattgctcagatgagagaagccaccactttggcaaatgggtaggtagagcttaattttagagcctaaagttttccgtttggttgttctttagtttgtgaacattttagtttctgagcttagagctaaatgtcaagagtatataaaatagaaaatgtagacacacacaactatttttggtggacactgtatttgtgaagctctagcaaatatagttggaagaaattatagaaacaaggtgaggatgtttgactaaaaatttgtattttaagagatatttatttgggggaaatgagaagtagaaatgaactcagatacatggtacgtttagtgttctgaaccaatttttgtttctgatggattggatactaagaaaataattcattggtttaaaaaatttttaggtatattttgcacacacaaaatacacctattctaagtacacagttcaattattattatatgtatatatatgtttatgtgtgtgtatatatatatttttttgtttgttttgttttgttttttgggacagggtcttattgtcaccaggctggagtgcagtggtgtaaacattaaacatggctcactgcaatctcaaccttctgggctcaggtgatcctcctgcctcagcctcctgtgtagctgaggccacaggtgcaagccaccgcacctggctaattttttcatttttttatagagacgagatctcgctttgttgcccaggctggtcttgaactcctgggctcctggtcttgaactcctgggctcaagtgatcctcttgccttgacctcccaaagtgctgggattacaggcatgagccaccatgcctggctatttagttagttttgataaatgtatgtacccatgtaaccggcactatgattaagatagagaacattactgttaccctaaaaaaattctctcatgcccctttcccagtccttcttctcctggcccctggccactattgatctgctccctgtcttaagtttagttttactttttatacaatttaaaatacatgtaatcattctagcatatacatatacagtacttacagtatgtacagtatatacttagaatgtgttttgctttttttcacttagttactgtttttgagattcatctatattatgtgtatcagtttgagtcttttctgtggctgagcagtattccattttatggttatggagtagtattccattttatggttatagagcagtttgttaactctttcacctgttaatggacatttcagtttctatgaacattcgtgtataaagcttcatgtggacatattttagttctcttgggtaaatacttaggagtggaattgttaggttgtgtggttagcatatttaattttacatgaaattgccaggttgttttccaaagtggttgttccattttatatcctatctgcactgtttgagaaatacagttgttctgcatcctcaccaatacttggtaccgtcagtctttttagttttagctgctttcgtgtgtgtgtagcagaatctcactgtgatttaatttgcattctcctaattactaatgatactgaacagcttttcatgtgcttactagccattcatatcttttctgtaaagtgtctattgaaatctttttctcagtttttaaaactgagttttcttaatatttaaagagttctttacctattttggaggcaagtcctttgtcagatacatacgattgagaatatagttgaccctgaacaacataggggttatgggtgctgacccccctgcacagccaaatctgcatataacttctgagtccccaaaacttaactactaatagcctgctgttgaccagaagccttactgataacataaacagtcaattaacacatattttgtatatgtattgtatagtatattcttataataaataagctagagaaaaaatgctattaagaaaatcataaggaagagaaaatatatttactatgattaaatggaagtggatcatcataaaggtcttcgtccttgtctatttcatgtttgagtaggctgaagaagaggaggaaggagggttggtcttgctgtcttagaggtggcaaaggtgaaagaggtgaaagtccacatatacatggactcacgtagttcaaatctgtgttgttcaggggccagctgtatttctctcgtggttggcttgccttttcatgtttttagttttgattaatgcatggattttaccatcatttttcttgaacaagaaaggaatgtaagtttactctagcatatgataaacaggcagtctgagattttacagagcttcttttctgaggagttcattgtattccatcatttcatttgccttttttctttacatagtaggtagggatatgtacctcccttccccatcatgtaaatgaaataactgaggaatcgttagtgtgctacaaaaccgagagcagatgaagattctgtaatgaagacttagatcatctatcttctgttgacattttgcctagatgatgtgaaattataattattgattctgttgaaagagagcaaaaaagaaaaaaatacctattttgtgtattgtttctgactcgttagagatgctgtaacaatcaaaagtataaaagactgcttttttaggatagaatttttgacttttaattacttagactgaaacaagtttgaactgtaagccaacgatacctaatatattttaatgcggtcataatttttcggcttttttttttttgtttttccagactgagtcttactctgtcgcccaggctggagtgcagtggtgagatctcagctcactgcaaccttcgtctcctggcttcaggtgattcttgtgcctcagcctcccaagtagctgggattataggtgctcaccactacgcctgactaatttttgtatttttagtagagatggggtttcaccgtgttggccaggctggccttgaattcctgacctcaggtgatccgcctgccttggcctcccaagtgctgggattacaggtgtgagccactgcaccagcctattttttggcttttaattctgaattgtgaacttaattttttaatgattttggtttaattgtatcaatcactgatttttttgtttttctgttaatctttgctttgtttttcattgatagggcttatccagtttttctgggtgctaactccattgctgttgatttggttatagaagattaaattaaataaagtaaatattgatgagttaaattgttttagacttcaatataacatagtatctcattttttcagagtgctagcttcccttaatcttccagcagcaattgaagatgtgtctggagacactgtacctcagtctatattgactaaatcaagatctgtgattgaacagggaggcatccagactgttgatcagttgactaaagaactgcctgaattactgcaatgaaatagagaaatcctagatgaggtatgttttataagatttgcttttcaagtataaacactgtgatcccttgatgtccagcagggattgggactggagacttcctcatgctagtgctcacagtgtagttagtattcatcactttggtgaatttactgtggcccagagccgcctctttagcataagagtaattctggttgagtgagaatgggtttcattcttatcttaagggtaagtaagtacacattaatgaaactcaaatgaccactgtgtaaaactagtatactatgagaaatcaactatcatatgaaccgttcagtctttgtaattattgatttattttatacatagcgtgtagcaagatttttctttttaatttaatttgtcttaacctggaaggttaaaccctttaatttatccctaatttcttgaaatatattaagtatatttattttatattatttatcttataattccaatgtctgtggtttctgtgggtttgattctatgatttgtaatttttgctgattcttgcttatggtggcttgttttctcttgtgttcagtttttttgttactgttttttaaaactttaaaaaatagtttcagatttacagagactttgcaaatttagtgtggaaagttcctgtatatttttcacctagcttccctgaaagttaaaatcttacgcggtcgtggcacattgttaaaactaggaaattgacattggtacagtattattactcagattttaccagttattccaccaacgttcctccttctgttccaagatccagtacagaatactgaattgcatttagtgttcagtgagttttgattgtgcattcatatttcctgtaatttatttgtgggaattcattgagatctgggtttaaggtgaattctagaaagaatttgtgtttgcttctgccataaaaaggcattatatacctggcacctcctcaaacttaagaggctttttcctttcttttataatcttttaattatagtagtaatttatcttaggactttgtgtcacacaaatagtgtggtttctagtcccaaattcaggcttttgatcaggaatctcagataatacttctttttttttttcttttttctttagagccaaggtccagacaggcatgttttcttctgtagggccgttttctgttttaaaaattcatccactgagaatcatctatttggaagtataccagtttgagtgtggagagtgcttttgatctgacctctcaccttttattgtccctacctatgtttcttgttgacttttcatgttctaaattcacaatgcaagtcaatggtgaactacacagctggtgaactatggatggtgggctagtgctggcttgtggcctacttttgtgtggttcactagttaaggataatttttatcttttttagagcattgtcaaaaaagaagaattctatgtgccatagactgtggcccacaaagcctaaaatatttactctgtggtgtttgacagaagtttgctattctttgtcctaagctatcagggattgtcatgtattgttggtgctagcactgtgtctactggtagattagtattttcttgtgtttctggccccctactatcctgtcatcttatctacacattaaaaggcatttaaaaatatattaaacataattttctgttcgttgtattggaatgaaattctaaatcttttattttttaatgtaattgatcagtttttcccctttgtttatggcttctatttatctattttaatcttaaaactttctttaaattgatacatggatgtaaatagtctcatgtattcttcctttttttttttactgagaaaggtgatagctaattcagccttaaatttataagactttttgttaaatgcattataacttagatgtctgcaagaaaaaagtcgatttatattctaacctagtattcccatctcaccaaattctcccttatattgtgtatgaacatttaataattgcattaaattttttaatccagaaatgacatttcagggttctttttgcttccttttaaagtcattaaggtttttggatgaagaagaagcaaccgataatgatttatgagcaaaatttaaggaacgctggcaaaggacatcatccaatgaactgtataagcctttaaaagcaggtaaaaatgtgtataaatgaccttcatttgaataaattcccaatttggacccacatttttacttgattaaattaggctcagttgtaaattcgtttttaccgaaattgtttttcctcagttttagtataaagattaaaaaagttcacaaaagtaatctgccaattgtcagaagtacagattcttaagaacagtataaagggaaaagttaaaatggtcctccaactttcattttctgttccaagctctgtgcatattttattttatttattttttttttgagacaaggtctcgctctgtcacttaggctggagtgcagtggcaggatcacagctcgctgcagccccaacctccagggctcagtcaatgcttctacctcagcctcctgagtagctgacaccgtagacatgtgctaccacgcctggctaatttttgtattttttgcagagacgaggttttaccgtgttgccctggctcgtcttgaactcctgggctcaagtgatccacctgcctccacttcccaaagtgatgagattacaggcttgaatcaccatgcctggcccctgcgcatattttaaaaacataaatgagagcatattatatttatggctttgtaatttttttttcatttagtagtgaatcctgggtggtaaaacgaaaatgagctttaagttattttgaggccaaatttatgcttcttaagactttgattatgaagattttgtgcttgctgagataaatgctgtcttcatggtggctggagattagttttatttatctttgtaaaaagtttgtatattattgagatttttctaaaaatctttttttttttaagtcacattgctcttttgagagaggaatacttttaaaataaatggaccaatttttggagagaatgatttcttcctacattcatgagttgtaggaaaagattaatattaattagcttttatttggcagatagtaaccaccaaatgtattttaaggtatagctatgcttttgattttataagtgattttgtcatctttccaaaaacgagaacgcaaagactgttaggagctgtttttatgattaagtgaattggggtctagagaaggggaagataagtaaagttggagactagaactcaacatataaccaggccatacacgttgctgttagaatcacttctgtgctctgcaaacctattttctcccagagggaaccagcttcagaacagttttagataaagctgtgcaagcagatggacacgtgaaagaatgttacccgtctcatcgtgaccccatcgtgcttttgtgtaagccagagcctgagctgaatgctgccatcccttctgctaatccagcaaagaccatgcagggcagtgaggtgagaagggcactttgatgtgggttgtcatctgcttaagaaaaccacattcaagccattttatataatgcactgccaattccttattgtcatctttaaaaaaatgcagaaataaattggggttgttatatttaaagtagtatatagactgtgtaataggaaattatactaatattaactatcctgtaatagtcacttccatttattgaatgcccttttttgaactaaattttagatacttcataggtcaacagtatttaatttgggttttataaaagagagaagcttggaagtatagaaatttcctgaaatgaaaggactgggtatggccagatacacaaattctttatttcttccattgttctctactcccttccaccttgtttccccgggactacctttgaaaggaagattggcaaggtgtgcgtgttaataaatggatagctccgtcatggtgtttctactgatgacaggaaagagaaaattgaatagtagggcatctgatttggaaagtcctaagagaaagtgcaactataatttaatggcctatcatggggaggtagggtaagttagtaggaaaagatagaggtcccaaatctctgcacaggaaaacaagccaaagggcaagaaatactgctgaaaacttcttgaaaaaagtgaatttcctgggatagtaagttctgaaaagtatgagttttgtttcttatttgtctttccacagatgcattttatatgtttcatatatgtattccaagacctactggatatctgctctgtgtaaggcactatggtaggtacattggaaaattaacatacaaattatacacaggctttaccctcaatttatgatccattgtggaatattagtcatgtacaaggatgactgtaatatagggaagaagtttaaaaatgtcacagggaaagtatagaagtatgttatgaggatttagatgaagtacttaaatttcagtaatttggagtagttctcttcagaggcttcttaagagattggcacattatgaggacagagtggataggcagaaaaagtaaacgtgtaggatcggagaagggctgagtagtggctgtgtctagagagttatccgaggcacagaggatctgcaaacacagcttttactcctgatttctcatgacagaaggtttacagacatgttgagaatggctggaatctgcttgtttatttatttattcaccaagtgtttgaaggcctgctattccagagcagtgctgagcaccttggtccctaacataaagagacaaaaaactgctctgggttacctttagtgtagggtaaatgcacaggtaccgggcacctctcaaagggaagagaaggctacgtagttgaatgtgcattgaacctgaatctaacgggggaacccagtggaacagggaatgtgagttgttgctttgaggacatagcggagaaaagggaggtggtcagaagattaacttgtgagcaacaaagaacccgaagaagaaactgtagacccttggaagagcaatacattctggtaccttttttattttagaaaaagatctctgtttagtactctctttgtattctttttggtgtcttgtacgtgactcagaattatgtggcttttgccctttgattcttctgctttcagtagaaaagtaaaaatggtttgtgctaagcaaaatctgcattagtatgcactgatttgttgatattttattcagttgtatcagttttattaatccttacttgtgttacacaggagaaaggaacttttatagtcaatatgaagtaattttttggaagctagagttcttgatggggtaaccacaaaatttcagtactctctatatattcgtttgtcgtgtgccttaatcaaataaggcaagcatcaggtttatcagagctatttcagatggttgtcataatagttgatgacgcattttagccagaatttttatgataaaaactcagttttttgattgctgattagagtgatgcaatgtatatgttttattaaaaagtccaagtttgatggtagggctgttttttcttttattgtgaagtagcctactttctagttacttattttcagtctctttgggcatctggttttagatattgagatactctgaaaaattttgcagactagtggtcatttgtatttcaagatttttgtattaaatacctaggatcactgcttgtgattggttgcctatgatctactgtggcctgaagtctggtctgtggttggctggccaagccttggccctaatgtatatggggctgagtctagccaggggaaggaacatctatttttttgcacaaggatgatgttcaattttactcaaagtgttacatctgctggaagtaacggagggggtacctttaaaaaaaaaaaaaaaccctttatctccttagaggtagagcataaagagaactgtttaaaactgtgtgccctcccagaggagtgccttttttggattcacagactagtggaggatctgcaaacacagcttttactcctgatttctcatgacagaaagtttatagacatgttgagaatggctggaatctgtttatttatttactcaccaagtgttttttgaaggcctgctattccagaactgtgctgagtaccttggtccctaacatagagagacaaaaaactcctctaggttacctttagtgtagggtaaatgtatcaagtttctgctttcgttggtgtagacatagttgcttatttgccttttctgaaaataaaatgacaaggttataaaagtaaaatagaagatttcattgagggcatttctttctttctttttttttttggccgtggggggacggagtcttgctctgtcacccaggctggagtgcagtggtgcaatcttggctcactgcaacctctgcctcctgggttcaagcaattctcctgcctcagcctcccgagtagctgggactgtaggcatgcgctactatgcccagctaattttcgtatatttagtagagacagggtttcaccatgttggccagggtggtctcgatctcttgacctcgtgatccacttgccttggcctcccaaagtgctgggattacaggcatgagccaccgcgcccggcccattgagggcatttcttacggcttatattgtacttggtgctgttaaatgccacagagggttttaaatctaaaactcgggtcaggaacctgtggcttgtgggccgaatcctctgcctcttctctttgtatggcctgggagctaaaaatgagttttacattttttaaatataaaactctactttctacttcattttttaaatggctaaaaaaaagtcaaacgaatgttttaatatgtgggcattatataaaattcagatttcagtgttaatacatttttgttgaaacatagctgcgctcattcatttacacattgtctttcatactacaaagcagagttaaagagttggaacagagactgtggcctactgaggcaaaaatattttctgtttggtcctttaccaaaaaagtttgtaagttcctgatctgaaagacaaagtattgacagcctaggtgatgccgttcctgccattctgtttgacctcatctcctgttctgccttttgtttactatgcttcagccagagtggcctttttttctttcctttgatcctgccaagcttgtgcctgccacaggactgttatatttgcgtttccttctgtgcagggctttcttcccatttccatggctattacctctttttcattagtctcagatgtcacctcttctccatctttgtcattgtctacccacattattctatttttgtgtatttgtttaatcctcccctttccatatttatttaatcctctctggtccccaaatgaaggaaaagactgtttttgttagtagtcgtgtccatggcatctagaatggtcccaaaacaaaaagcatttgtttgaatggtcatcgctggcagccttaacttaataaagggatacatttaattgcagttgaaaggtagctggagctgtgtataagaaataaatatgctaggattctaattatttatatactttgataacatgttaaacctcaaatttgaatttagaagaaaatttaggcagtggttttcttattatcgtggtcattcatttgtggaagcagtttaattcattttctacttcatttactctgttaaaatgaggcgagtgtcatataatctgaaatatgttaaactagtgcactgcatatgaatttttttaaaagatgttcgtaatataagggatctctatctttgtgtggtagtccacaagtttgttcataaattcgttgtttgaaatggcatttttttccccagaaagttagaattattgcatttttgaatatcacaggatttgttaactatttggccctctgtatcagtctggttagaaagcttctgtatcagtctggttggataccatggaagttgcggtaagcttttcttcctaatctaggtaatatgactgaatacttaccctttgttagaagttatgttgagcactttatatagattatctcagtcttcacaacagtcctgaaataggtactattatgcccattttgcagctgcgaaaattgagttttctaagtagtaacctgtccttgattgcacagtcactaagcccattatggtctctaagggagtatagtcagagttgaagtgtttttaattttctatgtaattacgttttttttgtgtaattacgtttcactttgatagaccattagttcatttgtttccatattcaagttttgacttaatcttgttttctgagtgtgtaaaaaatgttcatgattcaaaaggtacatgcagagtaagcctcattccttttccttctacttctttcctgtatacttcctgtaagtaatcatatccgttagtttctggtttgtccttactgattttctttttggaagaacaacaacaaacaaaaaacccaacctcccccaaaattatgcatacatatgtatacatatgtacatattatgtatgtgtatatttattttctgattttccttctgtcttactcaaaatgcagcacactatatatgcttttgtaccctttttttctcatttaataatatgtcctggaagtcacttggaaggaaacttttattcacatcgtctgatatcaagttctactaggtctttaaacagactttgtcatatccacccacgtatgattctttctcctcctccttccttttagagtttctgtggtttgatgctttctagactctaggaatcatatttctttccctttccacagccttctcccctgtaccctcttctttctctccctccctctctccttcccttcccccttccttcctctcttgtccccctcccccttctcttcctttcctttccttccattttaaaattaggatgtttagaagatatagatgtaaatgaggccaaaaaggaaattcgcctacatttagcagaaacctcgagtctctggtcttcacaaagggatgttactttggacgttcctatcaaggagttaactaagactgtggaagaaagagtagggtaggaatttttagaaacaggcagttggtagggggatcatgggaactggacttgctgctggtaatgagaaagacaggggtggagacagggctcatgatgtcctcttcttccctttgtctttccccctgttttctttctatgagcatcattggggcaagcagaatagggagattgggttgatgttcttggtggtcctagcaaagtatgaagagatgagtgaaaggggcagcttgaaagtgctcattagaaggcacttgaacactatgaatataaaggggtatttatgaatcaggtgggtataagtcagagagtgtcttgactgaatacaagagataaatctctgttttgtttttgtattttgttttgagacagggtttctctctgtcacccaggctggagtgcagtggcatgatcatggctcactgcagccttgaccccctgggctgaagcaatcctcctgcctcagcctctggagtagctgtgactgcaggtacacaccattgcacccaactaatttttttttaatgtagaaatgggggtctcactttgttgcctaggctggtctcgaactcctaggctcaggtgatcctcctaaagtgctgggattgcaggtatgaacctctacatctggcctaaaactcttaatgctatgaagagaggcacaagaaccctctttccttttcctctcccggtgtataaaataaatgtggtatatacctttatatctgtgtctttctctatttctttctccatctaccatgcttgcttcataactatctctatttctatcttcacctctatttctctatatctctgtctgtcagtctctctaggcaaaataggatatctacttacgtagcaaaatcataccttcccctgcttcacagccatgattgggagggagtagagtgtagagtggctaagagattggttttggaactagtcagacttaggtctcaaatttcacctctgccccttagtaactgtataaccatgtcacttaatttttttgagactcgttatccctatctttggaagagaggtcataaatatatataccccatggggtattgtaaggaatacataaaattatatttctgaagtgtttagcatggtgcctaacacataggagttcagtaaattgtagctgttggctactgttattaatgctgcttttgttttaatatgagtcaactgaaggtacagtgtctatctacataaacctgatgttcaatttatatttggctctctgagaactcatctctctctcagcccaaatgaacctttatatattatttccttcttgaaattggctttttttttcagttaaactaaagtgtcttttttattgtttaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggcatgataaatgaagaagctctttctgttactgaactagatcgagtctatggaggtcttacaactaaagtccaagaatctctaaagaaacaggagggacttcttaaaaatattcaggtgaaatttatgtatttaataacatctatgttttaaaaattacagaaaagatatgtctggactaaacctatattcaattagaaaaatgacattggagaatatctgtagttgagagtagaacttaatacatatatattttgtaaaattaaacttggcatatcagttttatttgtgtctatgaaaccaagtcactccttgtttttttttttttttttttttttttgagatggagtctcgttctgtcgcccaggctggagtgcagtggtgcgatcttggctcactgcaagctccgcctcccgggttcacaccattctcccgcctcagccgcccgagtagctgggactacaggcgcccgccaccacgccctgctaattttttgtatttttagtagagacgggatttcaccgtgttagccaggatggtctccatctcctgacctcctgatcctccctccttggcctcccaaagtgctgggattacagacgtgagccaccacgcccggcagaaacaaagtcatttctatggctaaaatgttgcatattacttaggagtgcttgatacttctgatatttttcatggtttcaagtttttaatagctttgttttttttttccatacgggaggaaaatcgaaattagttggaattactgatacctttaattatacggctaacatacatacagacttcagtcattttttaaaaaaataatgcaaactaaatatgttgagaagtttgaagttagttttcgtgtttacagataggtagtttggactaacaaagacttgaaagtttgcccttttcatagttaatgtgcaaaattaaacatatatttctactcctaaacattgtatctatatatgatataaaatattccaaaaggtaaaataattttcatgttatattttttgcaagtgttatatactaatagaaatctgtgatcattattggttgttttgacttctattggatttttgaaatttttacttaagaaagatttaaagcataatgaggcttcaaaagagtatactaggtatttctagtaattttgcatatgtatttaattacatatgattttcataattggaaaagatcaataaaaatgttatgagccatattttataagtaaatgtaaatacataaatctttcttttaacaaggtctcacatcaggaattttcgaaaatgaagcaatctaataatgaagctaacttaagagaagaagttttgaagaatttagctactgcatgtgacaactttgttgaacttgtagctaattcgaaggaaggcacaaaggtatgaagtacatgcaaaaggaaccatagctagcaagtacagatgtgaacgtataggttggaagttaaatggtatttccagttgaaccaaattactctttgcctggaatgttagctttaatgccattgcctctgcgaagtttgttacaggagggagaaagcttaatgaaggtggcaacatttcatgggaaccttgaagaatgaattgcatatttcaactggcagaaaaggggtacaaatattccaggtagcaggaattagcagagatgtcaatgacacctttttaagggataggaagttgattaatttgatgaattttgaggggacaggagtagtcaaagctgatttgtgatggaaaagctgggcgggcatgacttttatattctgtgtggtggtttgctgaggacagacttgtggcctgcccaagtgtcagaaggcttgctgaatatgtaagtactttcttgccttgtcctttaaaaagtttagggaattcacttatatttgtttttaccaatttgtttttgagggaacagtgatttttaagttttctcagatgcataattccttttggtacttaacttcataataatcactgaataaagttaccttgatataaatacagtagctaaaatgtaaaaccctctgaagagagggtgaaaatactgcaaagccttccaaatagagaggatggtaaaatgccattttaacttggtttaaaatgctttgtttaaataggtaagctgagaaaaccctccagagagcctttagaaattcttttaagggtttctgaagtatgcttgcatttctttttttttttttttttatactttaagttttagggtacatgtgcacaacgtgcaggtttgttacatatgtatacatgtgccatgttggtgtgctgcacccattaactcgtcatttagcattaggtatatctcctaatgctatccctcccccctccccccatcccacaacagtccccggtgtgtgatgttccctttcctgtgtccatgtattctcattgttcaattcccacctatgagtgagaacgtgcagtgtttggttttttgtccttgcaatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcagtaaacatatgagtgcatgtgtctttatagcagcatgatttataatcctttgggtatatacccagtaatgggatggctgggtcaaatggtatttctagttctagatccctgaggaatcaccacaccgacttccacaatggttgaactagtttacagtcccaccaacagtgtaaaagtgttcctatttctccacatcctctccagcacttgttgtttcctgactttttaatgatcgccgttctaactggtgtgagatggtatctcactgtggttttgatttgcatttctttgatggccagtgatgatgagcattttttcatgtgtttttggctgcataaatgtcttcttttgagaagtgtctgttcatatcctttgcccactttttgatggggagtatgcttgcatttctgtagtgaatttgaaaacctaatccttccacttaaataggtttcatgttattaaacaattgacttttctctaggaattaggaagattttcatgatcatgaaacttttaacttgttacatttttgatgataatgttctataaaaatgattttattatttttattttctttaggagtcttagatcatatttaatattaagttgttgggcctagtaaattgtatggatgtatctcatgcagatctcagttcttcggctttaactgtcattgacaaattagctttagatcacattactctctggattaaaaaattgttcttgttcattacttgtatttgttctttgcttatagttttacaatgagttgactgaaatcctggtcaggttccagaacaaatgcagcgatatagttttggcatggaagacagaaagagatgaactcttaaagtaagtctgttttgtgtatcaaattgtacttaagaattttcttttaaaaaatcatgtggagacttttggtgtgaacttggtagtatgagagcagtttccctccttttctcatggaagaaggaactagatagagtattttacaaagcaacaagtaaacagctgcacagtctgggaatgaaaggatgaaaagaagcagaaactctagatgcaggaagtacagtgaggtcacagaaatgataaaacagttcaggtggcagatctcaggaagtgccagtaaatacaagcaatttattttgaagtggcaaataggttccttacataaaactagagctatagaacatggaggagacgccgtgaatagctcagagaataccagcaaaatcactttcagaggaggctgctgagaaagcagggccagttaacatacgactcatttcctgctgagtaatcaacacggagtagcacagcgctgataaaaggtgaaaaacattaacaaaatttaataaaacttcatagatgaagaatatttaccaaaataatattgtcacagaataggtgaaaattatgagcaaacgtctgaccatgaactaaacaaaaagaacaacaacaacaaatgtaagaaggcagtcattctaaggccggggtccccagtcctggggccatggactggtactggttcgtggcctgttaggaactgggctgcacagcaggaggtgggtggcagacaggccggcggctgggcgagtattactgcctgagccccacctcctgtcaggtcagcctcagcattagattctcataggagcgcaaaccctattgtgaactgcccgtgtaagggatctaggttgtgcgttgcttaggagactctgactaatgcctgatgatctgaggtggaacagtttcatcctgaaatcatcttccgctcccctgtggaaaaattgtcttgcatgagaccggtccctgatgccataaaggtttggggactgctcctctaaggaacacttggagcagaaattccagaactgcaggaatatggtaagaaaacaggaagtggtaagatgtgaggtgtcagaattcaggaaagaagtagaagggaagaatcaaaccacgacatgggaaagagcacaaagggcgagtaaacactgaagaacacacaggaacacagagtagaaatgaggaaattaaaatgaaaccaaagtcaagaaagaatgagaaaggattagagagaagatgggcacagaagatctaatatgggcaaaactgaatttctctcaaagaagaaaaaccagacagaacagttatttaactttctgtaaacagagcacttatttcatgatactcaagaacattttcttaaaacaagtgaaggttgttgaaagaggatatcacatggtaggggaaattgatcaagaactgtcagcatcaaggcatataaattattggccttaaaaggtaatggcagaatcctttaggcagtcaggcaaaacaatcaaaccagtatataaaaaggtgaaaaaaattaggctggcagctctgtatgccagaagagagtggagtgattgctgtaatctcaaggatagtaaatatgagctaaagattttatatcatatagtaaatacatgctaaagattttatatccaaactgtccttcgggtgcataaaaagccatatattcattagtaataaatataaagagctgaaagagtcttataccgatgaccctttcagccaactagatctttattcatctctctgttcatgttcatgttcattcacctctctgctcatgttcatgagagaagttattttcttctacctctaagaaagagcaggtgagttgtttttagaatatttctactaaacctataaaaagcaaataattagaatgttttaaaaatggttctaaatgttttaaaaaaggtgacttttttttagatagagttttgctctgtcgcccaggctggagtgcaatgatgcaatcttcgctcactgcaacctccgcctcccgggttcaagcaattcttctgcctcagcttcccaagtagctggcattacaggtgtgcaccaccacgcctggctaatttttgtatttttagtagagacagggttttgccatgttggccaggctggtctcgaactcctgacctcaggtgattggaattacaggtgtgagccacccccccagcctaaaaaaagatgagtattctccatattagtcttaaagataaaaaaaacctaacaaagattaatacaaaacagtctacagaccagtttcagttatgaatatggatgcaaaagtcctaaataaagtatttgccagtaatagtcaccaggacgttaaaaaataattattgaccaaggggaggggggcatttattccagtattcagtattcagtgttttcatgtcaaaggaaagattacaggcttgtcttaatagatgaggcagaagcatttaagaaaatgagtgttctgatactcagtaaaataagaatagatagaagatagatgcttccgtaacatgaaaaaatatatatgtatgtgtgtgtatatatttctgcccaaaactcagtacagtgattaatggagaagcactataaacagttccctctgaagtcaagaacagacaacaaatgtcactgtcagcactatttttaaatactatactgcagtaccagccaagacaatcacgtgagagagaaatttaaaaattggaaaggaagaagtaaaactagcactatttacagacattatgattgtacaactacttgaaaacccaagagaaccccaaaactctgcaaataataaaataattattactgaagttgttgatcataaaaataatttgtagaaatcagtggctttcatgtaaataaacctatagaggataagatgaagagacccacttacggtagcaacaaaaaggataaaatataaaatataagtttgtcatatatgagacctgtgtgaagaaaaaactatttcaaggacacaaaagaaggcttgagcaagttaaaaagcatgttcttggataggatgactcaacttcatcaagatgtcaactctcagttaacttatgtatcaactgggcgtgatggcatgcacttctagtcccatctacttgggagattgaagtgggaggatggtttgagccctggaattctaggttgtagtgcgctatgattgtacctataaatagccacggtactccagtctgggcagcagtgagaccctatctctaataacaaacataaataaagaaataaacatatacggccgggcgcagtggctcacgcctgtaatcccagcactttgggaggccgaggcaggcggatcacgaggtcaggagatcgagaccatcctggctaacacggtgaaaccccgtctctactaaaaataaaaaaaattagccgggcgtggtggtgggcgcctgtagttccagctactcgggaggctgagacaggagaatggtgtgaacccgggaggcagagcttgcagtgagccgagatcgtgccactgtactccggcctgggcgacacagtgagactccgtctcaaaaaaaataaataaataaaaagaaataaacatatgcattcaacatgcttttgattaaaaaaaaatcagcttttcatttggaattagacaagttgatcctaaagttcaagtagaaaaagaaacaaggtcagccaggaaaacaataaaaagagtagtgaagggatactagttctaccagataataaggtatataataccatctttaattaaaacacagtggtactggtacatgattagacaaagacagaatagaaaatagaaatagattcaaatacatgtgtgaatttagtgtaaaagatcttcaaccaaccagaagaggttgtagtcaactgcccagccatttagaaaataaaagttatctttataccagagtaagttctgagtggaccaaacttgaaatttgtaaatgaaatataaagtataaaatagaatggaggagaattccttaataaagctgggatgggcaggatctaataactcctacttaaaatccagaagccattaaaaaaaagaaaagaataagtttctcatagaaatatgataaacagagtcaggatatgacaaattggggatccaatatttgaaacttattcacaggcaaaaggctaatttactttatttagaaaagaactcctagaaatgaacaagaagaaaacccaatagacaactgaggaaaagacgcaaatagaattttgcagacaaggaaatacaaatagctcttaaataaatgaaaaaaaatgaataccctcattcattataaaatacaaatcaaaattagtctgaagtaatatttttcagattggcaagaatctgaaagtttgtttaaagcctgttctgggtcttccacattcattattctctacggtcaatcacattccaaggattgttgcctccaatgcatgcctttttctcaattttattttctcccatcagagtcatgcacagattagctcccaagtgagctattataatggcctcctagcatctaaactctccttttttccaattgatagttctgccagagttgtcttcttaaagcagaggttagaccgcatttctcttaagtaaattccaatgacaccaaaacagtgattcttaataagaattacaagtagggaaatacagatgggagagtttgcttagtaaataagttcataaaatctaggttaaacaaagttaaatggggtttgctttttgctgttgctttgttaatgtgcatttgaaatttctaaagtggcattacatatccataatttcccttatctatttgacaaaggaatctggtttgtttagaagcattttttcagaactgtgataggtcaacctttcagaaattcctcattatcaacagtcaaatccagatgtattttctttggctctcacaacaggcttagaggaatttctagtctgttctcctgatgtttcattatgtgcatcttttgcttaggcctgttaaacctactcaatgtgtgtatcttctactccatgtctttattcctactgttgtcttaacaggaaatccttgcaacccaattcatagtttttgttctttggaaaaatccaaatcatgtatcatgaatacatattttttctctattgggatttgcctgtttttatgtatcacagccagaagtaatcactgcatagtgtatttctgtagaaagatagaagagttctattttaacacaatatttcctatatacccagcaaaggtctaggtatttatacatactattgtatttattcatctcatcaatgcaatgaagaaatattaataaatccattatatatgctaaaaggtagcgacacatatatgctacatgtgcaggttttctcaggtattattagctagggaagctgtgttgtaacaatcttcaaaaacttctttctattgtttacatgctattccacatcattttgttttcatttcttttgtagtatctaatgtattctactaaaaaaaaaagtagagtagttggaaaacttgtgaaaaaaacatatgtattacatatataccattcttcatgattctcaaaattttcatcattattaatgttttgtgtatatatatatatatattgtgtgtgtatgtatgcatgttagatatataatttaaaagaaaacaataagttggtggcttatggcaaattgttccttaagtcctgcatttgaaacatagacactgagtgaatcagcacatttgatcatcttttaactacaatagatgattatacattaaaaatacattaaccatccaaatacatcttttttcttatttatgtatgtatgtatgtatgtatgtatgtatgtatttttatttttttgagatggagtctctttctgtcgcccaggctgaagtgcagtggcgcaatctcagctcactgcaagctccacctcccaggttcccgccattctcctgcctcagcctcccgaatagctgggactacaagcgcccgccaccacgcctagctaatttttttgtacttttagtagagatgggttttcaccacgttagccaggatggtctcgatctcctgacctcgtgatccgcctgccttggccttccaaagtgctgggattacaggcctgagcctcggcgcccggcccaaatgcatctttaggaaaattatatttaagctcttcatggagacattaaaaaaccaagctgcattaataataaataattatatcattcattagtaaggagtaaatagctgttttctatttgagaagtattaattggattgtccatctgtatgcaggaacatctgttttctgacatgctttaatcaccatttgttttgtacttgtaccataattacacttgtttgtaatattgaaccgagacaatgattaaaatcaacttatgaatacgattcttttatgcttttgtatttcattagaaaatgtgtaattctggtatgacatttataagtatatataaaagaaagtatttgattaacaaaatgcctcaacagattatgtcagtaaaatgagtgttatatcatgcagtctatgttactattttggcatttttaaggaaagtttattgcttcacggaagcttttttttaactgaccatctatgaattttctgtattctttatttcattgtgatcacatggtcatagaagagacatttttagatcatcagaagttgacagttttcagtgtagtgtatgtgcttagtataagatggaattaagtttgttgtatgggtgattgatgaatttttactgaatcatggataactgctgttctattaatgacatttcatcaattaactcttttggatatggtttatcacaaaatgttgctgatttaatgtttgtggattaactgaggtgaaagtgatacctggtagaagtttcattaatacaaattttcctctcttaggagtaggatggattatattatttgtcgaaatgcctttgcatgtaagttcttaactgtcagctttcttgtcctgtgaatcatatcttttctgtatttgctgaaatagagacttaacattgttaaatgatttttccatgtcatggaaaatgtatgcctctaaatctgcgttccttcctacaaattacaagttcaaaatgactttttttaagaaacaaaaaaaaaagatggatttctcgtattttgtggcaggataagctccctgtagcctatcttaaatgttgattacgactaaaactatgaaaagtacaataagcaactaactgaggaatctgaaaagtaaataaaagtagaattatgagtgataggcaaaatctggagaagcaccctgcagtagtgtgagcttccattgttgtatttctttcaatcaaaaccaaaacaaacaaacaaaacaaataaaaaccagaaaagaaccaccaccaacaagaaaacactcaaggaaaatagatattgtgatagaaacagcagaaatgtcgagaaacaaaaccagaaggttagaattattagagaaaataatataaaaagtaattttaaatatctaaacaaaattttaaaaaggaatttaaaaaaataagcaaggagaagacaataaaaataggttgataattcatttgttagcatttgtctgtttggtatttgttgaccattttatttttaaaaaatttggctatatttgcttttggtgtatttcttgtatatgtattgtaaaatttagtatttattattattaaatattttatattgttaaatgataatttatttttattgataagaaagatgtagttttctggttgttatttttgtaattttacctgcatttatatttttctccatttatttagataatacctaatggttccccacaatgagtggcaattaaattagactctgtgctattttcactttctcaacttctcctgaactatttgatttttgtggcaggatatttcttaatatttgcctttgtgccacttaatgttttcatactattatgggcaaattttgagatttaaaatgaacccattactctcagctattatagacgaggcaatcagggagctaattcctactttcccctttcttttactctctcctcctggttgttacagttgaatcatttgtacattatcagaatcatcagtaaaatatctttttacatcttctacaccatgtatcccttaaatctatatatgacgcattgaatgcttacctcttgccttactggtagtattttacctactcagaactaggttgattgaactttgtcctgtggtaactctcttaataagaactttctgtaaagtgttccctgaattatgggtgcttataactgtacactttatagctgatagatatcttgcaaggataaggataaccatttgcttctcccttctcttctttctcaatatttccccccattttctggtgttaacttttgctgtggaaaactctgatgccaaaatgattttctttttctctaagttgacaatttttgcttaagccctcacataatgctttcttaatctttaaagtcctagtcccatacacagatatatcttggtgttgaacattctaataacatacataagcatatactacacagtaatgtaaatatatgtgcttatgatgatctatcttgtcttaatataggcaataacttttttctaattctatcctatgttttacagtttttggatttttggacggggagaggacttactacatattcttctctcacaccctttacgacccttacattatttggggttcagtctcccttgttctctttacaatttagtttttttttttttttctacaatgattttgtttttaaatcctatttctttcatggattctgccagttgctattgcactttctggctatctcttccccattctcttgcatttcacttcatggtctctttatgttttattacacccttaaaatttatgttggaatgtataaatgttcattccttttttcatctgttttgtagcaacatgtttctagttattacaagagttgatatattccttttttatctttattcttaagagtatttttatgtgaatgctgagaaaattcctttagtatttctcatatgtgaaagttgaatttcctacaggacaaaggaaaggggttgtagaatgtgccccagcctgctagctcaagggccctctcatcatttgctacagtgacagactgttgcctcattttggggacattatggagtcaccgctcgttctccataagagcataaatgattaccaggtagttgttactgtcttctctccttgatactcatacataactcatagcacatatggaagcaaccttctaaatacccatgttttatctttaaaatgttctttgtgtgtagctgcccatttgttttgtgctaactgactgaccctattaccttcagttgtaacaacccatttaaggtagaaacgaaggacactcatctccatgtgttttcagaatttaaatgaaaaaataaaaagaggctgatgtcacttcccagtttaacgcaggggttttatttatttatgtacactcaatcaaactatgactattacaaatggttttaccgctacaataaagatagttaattcataactcaataaaaatgaagagtgaaagattaaaaaaggaaagcaacaattctaaactataaaatctacttcagaaagctacatacagcaaagctcaataaataaattatgaaaaaaagaataatatgggataagttttatggtttaggagataccttcctataagccaaaaacctaaaaaaaaatgctaaaggtatagcttgctatagtacgtggtaggagaaattaacatgtataaaatcaataacactcacattatgtgatagtctacagccaaagaataatagaaagcaagtgaaatgcttagcatagctatttagtctactaaattaggtttgtgaaaatgggaatgccaaatgccttaaggcttatggcaggtgcaaaagcaaaacatcagaggtcaacctaaggatatttttaatataaaattaatgtacctgcattgtaagcattattttttttgtatggtagaaaggaaaaaattcttgtattattctactataaatgtgtattctttgctctactaaatttgcatgtcatcgtcagcctttcactttgtcttcagctaacaagaacctcttgggttcatcctttggagaacctgatatggaaaatggactgaactaggagaagagcctttgtttagaccacatgctgaggtctagtggcttcaattaaaaatatataaatgtggccgggcacagtggctcacgcctgtaactccagcactttgggattctgaggcgggcagatcacgaggtcaggagttcaagaccagcctgaccaacgtgatgaaatcccgtctctactaaaaatacaaaaattagctaggcatggtggcacgtgcctgtaatcccagctactcaggaggctgacgcaggagaatcgcttgaatcctggaggcggaagctgtagtgagccaagatcatgccattgcactctagcctgggacgacagagcgagactccgtctcaaaaaaaaaaaaaaattatgtatatatatatatgcttaatctctaagctttggaaggaacagcctatctacagaaaaatttaaaacttggtcatgacaggtacagagttgggccccattaattttgttgacattgaggtcagcagattctgtaaattttcactatacctctcatatgatctgccgccacaccattcatactcttaactttatttctcctcacaccagtaaattactaaaactgccaagtttttttttcacaaattaatatctttagcattctcctccttcagcctgcaatgaaattatctactcccctccctcctccttcctccttgactcccgctaatgcacatttgtgtttggtttccacaccaaatgagctaccttcaataagcatcccacaactccacagggaacttttgtttctctaccttctgtgctgtcaaagcgcttggctcagaatgagagatctgtctgcatttcagatctacaaattactcattgtgtgaccttggacatatccctaatatttttgagcctcagtttctcaaaaattagaataaagataccaaactcctggggttttgtgagagtaaaatgagacgatgtgtgtaagagactcagtgcagtgtcagtatctaccatgtgctatgcactctgcgttttctttttcttttttttttttttgagacggagtctcgctctgtcacccaggctggagtgcagtggcgtgatctcggctcattgcaacctctgcctcttgggttcaagagattctcctgtctcagcctgcgagtagctgggactacaggcccatgccaccacgcctggctaatttttgtatttttagtaaagacagcgtttcaccatactggtcaggctggtcttgaactcctgacctcaggtgatgcacccacctcggcatccgaaagtgctgggattacaggtgtgagccaccatgcccgggccaacccatagccttttggtcttctctcagccaaggcatccagtgaaaatgcaatttatttttcagattcctctggagaattaaaaagtctcttttgcggctggacacagcaactcacacctgtaatcccagcactttgggaggctgaggcaggcagatcacaaggtcaagagatcgagaccatcctggccatggccaacatggtgaaaccctgtctctactaaaaatacaaaaattagctgggtgtggtggcacaggcctattgtcccagctacatgggaggctgaggcaggagaattgcttgaacccaggaggcggaggttgcagtgggccaagattgagccactgcacttgctctggtgaaagagcaagactccgtctcaaaaaaaaaaaaaaaaaaaaaaaaaaagtctcttttgcatcaaattgccatactctctgctcttggtcctcttttccatgtactcattcttcaagcatttattttctcattgcctgatccagatcattgcaatgaccaaaaaattttcgaatgctatgatttttgtgatattcttttagcaagttaatcacgatgttgcattcttgagtgtgcaagtgtggaggtaagtcaggatgcatctttaagacaaaaagatgggtcacggcagtgccacaccactcacggccacaccaggagagctgaaggggcagtcaccaacgaagatgcctgacccagaagctggctgccagggagccaagagccaggtcactccacaggtggccaatgcccgggggtggccctccaccgccgaagctgctgctgctgctgctgctgctgcttattattattttgagacggagtctggctctgcctcccaggctggagtgcggtagcacgatctcggctcactgcaacctccgcctctggggttcaagcgattctcctgcctcagcctcccgagtagctgggaccacaggcacgtgccacctcacctggctaattttattttttgaatagacagggtcttgttatgttgcccaggctggtcttgaactcccgggctcaagcgatcctcccacttcagcctcccaaagtgccaagactacaggtgtgagccaccacacctggccaagttctacttttctaatatttaaaatatgaaataggccgggcacggtggctcacacctgtaatcccagaactttgggaggctgaggcgggcagatcaccagaggtcaggagttcgtgaccagcctggccaacatgatgaaaccccgtcactactgaaagtacaaaaattagccgggtgtggtgacagatgcctgtaatcccagctactcggaaggctgaggcacctaaacccgggaggtggaggttgtagtgagccgataccatgccactgcactccagtctcggcgacgcaatgagactctgtctcaaaaaaaaaaatagatgatgtcagtgatttctattacatgagatctggaagcactctgtacctgattgctccacgtttagtggtgctaagttcaaataattcaggtggtgagaaactgacttccgtaggagtgcgggtgtgcgtgcgtgccgcggaaatcccgccttctggcgcctgcggttgccccctggcctcagccggtaggctcccaagtaggaagataaaccgcattgcacgaagcgggagagtccagaggagcggcgaagcgctcctcttccccattggctgcgcccacggagccgccttgcgattggccctaagcgcgggtggctggggttgcgagaggcatcaggatccctggcggcgcctgagccagcggctgctaggaggctgtgtccgcaagccagcggggcgaggcgcctgggccctgcgcgtcaggtcccggcctggggcaccggggctgccagcgtcggaggaggtgcgggcgcggggttggcgggcggccgaacgggggcctgcgcggaccgcccgcggctcagcctccggtctctctccgtctctaagtggtggtggctgtgggtttttctgcaggtgatccttttgagtaatttgtttcacgcaggcgccctgctgtagggtaaagcggcagattcatgctgctgtcatttgtcgttcaaactgtgggcttcttggccaggcgcggtggctcaagcctgtaatcccagcactttgggaggccgaggcgggcggatcacgaggccaggagatcgagatcatcctggctaacacggcgaaacgctgtctctactaaaaatacaaaaaattagttgggcgtggtggtgggcgcctgcagtcccagctactcgggaggctgaggcaggacaatggtgtgaacccgggaggtggtgcttgcagtgagctgagattccgccactgcactcaagcctgggtgacagagggagactccatctcaaaacaaaacaaaaaacgatgggctttctgtcgtgtgtgtgtaccttttggatttgagggcagggggatgacattgtgatctggcctcctgagaaaccaggcacaccctgcctaccttggaaggcggctttcccttccccacctccctctccctccatctgttccctctttccctctctccacttcactcccgtcccccagctcttctctcccatctttttgttctctgtctcttttttttttcctgcattaaacctttcgggagtgtctttgtaaaatattaagaagcgttaggtcttcaacatgtgtgtttacttgcaggcctgagacctgggaggaagctggagaaaagatgccctctgaatctttgtgtttggctgcccaggctcgccttgacaccgaatggttgaaaacagatatacaggtggggtttgacatgtctctttcttggtgtatttctgcttccatgtttaaatttctcgtgtaaggcttttttttagggtatgtaaggggaagtcagttgtatcttgctatattagaggagcaggtttgtttcctgtaacttaaaatgtaacagtctttatggctgtttttgtagatcgtgcgcggctgccttttaattagtttcttgcaagtgcaggaaatgagatttattaatagggaaaatttttttcttaattattattactggttgagaaatctgctacactcctaaccatatcatggtgactgttgtttgttactgatagtttttgagctgttgagttaactgtcgaggggaaaattggagaagtaagttgcagtaattatggctgctagaaactcactccttttatgaggtcttgtgtttgtgtttctggagagaaaagagttagttcagttgagctgtttgttttgtatttgtaaccaatacaaggactaaggacaattgtgttgaaactgaggtcataatgttgggatcttaagggccgaaggttccaaacaaatggtatgtatagagttctctctgacttgaaattttccctttctggacctccggatgctgaggctgggagtgtccatatgacagtgccttccatgacaggagtcagcaacctttttttttttttttttttaacacgtatcagtaattcattctgtatattttgaaaagttttaacctcttcttcctagccctccagtatttgttaataaattaaaacgtttcccaaagtgttttttgtgaaacaataattctaaaagatgctctaagaaaagctaagtacatggaaaaatccaaagtgtatattttatttattacatttcatgaatttttgtttctgttttttcctcttgagagggagtcttgctctgtctctcaggctggagtgcagtggcatgatcttggctcactgcaacctccgcctcctgggttcaagcagttctctgccttagcctccagagtagttaggattacaggtgccctccaccacggccagctaatttttgtatttttagtagagacagagtttcaccatagtggccagactggtcttgaactcctgacctcatgatccaccctcggcctcccaaagtgctgggattacaggtgtgagccactgtgcctggaccacatttgatgactttttttgtcctttgttcttttaaaaatcatggttagaaagcagagcataattgttctttatgtagaatccaactgattggggtttttagggagatgttttgacattcagtaaatgtttttgttttccattattaagactatgaattttttattttactttctgagacagggtcttgctctgttgcccaggctggagtgcagtggcgtgatcttggctcactgcaacctctgcctcctgggttcaagcagttctcctgcctcagcctcctgagtagctagcattagaggtgcccgccaccactaccctccgcctttcaggttcaagcgatcctctgcctcagcctcctgagtagctgggattacaggtgcacgccagcatgcccggcaaatttttgaatttttagtagagacgaggtttcaccatgttggtcaggctggtctcgaattcctgaccttgtgatccacccgcctcggtctcccaaagtgctgggattacaggtgtgagccacatttttagtagagatggggtatcactatgttggccaggctgctgtggaactcctgacctcaagtgatcccctcaccttggcttcccaaagtgctaggattacagatgtgagctaccacgcctagccgtattttgtatttttagtagagatggggttttgctgtgttggccaggctggtcttgatctcctgggtgcaagtgatcctcccacattggcctctcaaagtgctgggattacaggcatgagccaccacacctggccaatgggaggtctcgcttcccttctctgcagcattccataagcaatgtgtttgggtagtatgtgttcgattttctctatgtatactttgaaccctacagtagtgaaaggaagagtagacaactttgaagttgatgtggtgtggtctttgagctggtggtgctaattactcttggttgttttcgtggcctccagtgacttcatcctgcttttgctgttgtaaagtgttgtaatttatgctcctgagaataactcttgaggtgtacttagggttcttgtctgcttcctggtgactgtcgaagcttttcatcttgaagaagggagatgagcagtgttccagtgtactgagattaaaattaagaatgttgcatttttttaatatgtaaaatttatagccagctgtagggtaggggtggcctactttctctaaagggccagatagtaaatattttaaggtctcactggaccctatggtctctgtcatagccatgagaccttgcagatttagtgccaaagtagccacagacaataccacgtcagcgggcaggggacgttcattctgtaaagtgtatttatggacaccaaaagatgaagtccacagaatgtttgcaagtcacaaaatactgtttttcttttgattgtttttcagttattaaaaaatataaaatacagtggccgggcgtggtggctcacatctgtaatcccagcacttttagaggctgaggcaggcggatcacctgaggtcaggagttcgagaccagcctggccaacatggtgaaaccccatctctactaaaaacaaaaaattagccgggcatggtgatgcacgcctgtaatcccagctcctcggaggctgaggcaggagaatcacttgaacctgggagaatcgtttgagcctgggaggcagaggttgtgatgagccaagactctgtctcaaaagaacaacaaaaataaaatactttctctgcgttcagaccatacacaaagaggctgtgggctgggtttggcccctgggctgtggttagtgaccccaaacacacacacacatacacacacgtagggcagagtctggcatttagagccagcacctgtgttctcacctgagctgtgttcctggctgggttctgctgtgtattctgtgacccaagatgtctatctaccttggtaaactggagacaacaaagcctgcctccttcaaggttgtttgtaaagatttaaaagggtaatgtattgttgttaggccagatgctttgcatagtacatgttaggttattttcactttttttttttttttttgagacagagtcctactctgttgtacaggctggagtccagtggcgagattccagctcactgcaacctctgcctcccaggttcaagcaattctcctgcctcagcctctcgggctgctgggattacaggtggctgccaccatgccgggccaattttgatatttttagtagagatcgggtttcaccatgttggccaggccagtctcaaactcctgacctcaagtgatccgcccacctcggcctcccaacgtggtgggattacaggagtgagccaccacatctggcccattttcactttccattagctgcttttttcccccattcatttcctacctttctgtgtatgatttctgaattaaatgtatttcatgtcttaaccttctgaattgtttgtcctctcattttccatgctgttaaggaaaataagaggctaagtgagacgtattaaatttgcatgtagtttctcagatcaggataaatgctcacctgttgcagaacgggactctgctcttgcttcacccaggatgcctttcctagttccttcctagagtggggccgcaccctgctccagccctccagacccagctccctgctctgacatgattccaccagactgtattccagctgtcctccctggacctagatattttccttcttcttctttttttttttttttttttcctgagatgaagtctcactcggtggtccaggctggagtgcaatggtgtgatctcggctcactgcaacctccgccttccaggttcaagccattctcctgcctcagcctcccaagtagctgggattacaggcacgtgccaccaagcctgggtaatttttgtatttttagtagagacagggtttcaccatgttggccaggctggtgtcgaactcctgaccttgtgatccacccgcctcggcctcccaaagtgctgggattacaggtgtgagccaccgcacccccccagccaacatatttttattaaaaaacttatatgaaatttattttattgtggtatgtagttcagtaaattttgacctctatagattcatgtaacccccatcatcatcaggatggagaattttcttcaccccaaaagctcccttgtgctgctcctttttatcacgtgttccctggtctcataccctggcaaccacggatctgttctccatcagtatggggtattctttttgagaatgtcatgtgagtggaaccatattttaagtaacattttgaaaccatcttcatttactcccagttatatgtttgagatttatgtgctgttctgtgtattaatagttctttttattgctgaatggtatttcatcatttggatgtaccacatggtgtttatccattctgccattgtaggaccttgtggttgtttccatttttctttcccaattgtaatcctgctgtgagcattactatacagattttatgtgaatatagtttccatttccctaggataaagacctagtagtgtgaaagttgggtcatgtgctgaactgttttccgaagtggctgttttagtttgcattcccactggcaatctgtcacgtttctgttgctctgtgtctttgttagcacttggtgttatcagtgttttttagttgagccattctaacaagtctagtgggatctcattgtggttttaatttgcacttccgtaatggctaagaatgctgaatatcgtgttcttctttgccactcttgtatcctctgtgaagtttctgttcagatcttttgcacggaaaaagctgtatcatggaaccagtaaaataaccaaggagaggttgattaaagttctgtttataaccctagaagattcctgccctagggatatgggatggctgaacgtaggacaccgacactggacagatgaaatagcagtttattagtcacgcatgctcacagccctggggtgggggacaccgcatgccattcagttaatcatgtgtgttgtaacttttcggggagggacatttgcagagactaatggtatgacattctgaaaagcggtgacagattaagaaattttttaattctgcagatggtagtgtcgaaccaagtggaacaaagaaagaagatctgaatgacaaagagaaaaaaaatgaagacgaaactcctgcacctgtatatagggccaagtcaattctggagacctgggtgtgggtcaagcaaccaggtaatctgagttttggcactttggaaagcttgatctgacgctccttttctaaataacttggatggattattcgtattttttggtaacaattttaaaaaatgtaattaaaaaaatttaaatatcgtggtaaaatatacataccgtaaaacttgccattttaatcatttttatgtgtacagttcattggcattaagtatattcacattattgcccagccatcaccaccatccatctctacaacttttgccctttctccaactgaaactccgtatccatgaaacactaactccttctgtccccaggcaaccaccattctacttttgtctcagaatttgactactcaaggtgtctcctataaggggaatcatacagtatttgtccttttgtgactgggttattgaacttcttaggtgtttggggttcatccgcatgtgtcagaattttcttttaaaggctcaatgctattccattatatatgtaagccacatgttatcccttcatcagtgggcaatcaggttgctttcatctcttgactgttgtgagtaatgctgctatgaacattggtttacgagtgtcttgagtgtctgcttttaattctttgtgtctatacctaggagtggaattggtcaataatgtggaatgcttacatatttattttttttgagatggcatctcgctgtcacccaggctggagtgccgtggcgccgtctcagctcacagcaagctccgcctctcgggttcacgcaattctcctgcctcagcttcctgagtagctgggactacaggcgcccgccaccatgcctggctaatttttttgtatttttagtagagactgggtttcaccgtgttagccatgatggtctccatctcctaacctcgtgatccacccgcctcagcctcccaaattgctgggattacaggtgtgagccactgcacctggccaataatgtggtagttagatttatgtttaacttattattgttgtttttgagattgggtctcactctgtcgctcaggctggaatgcgttgatgtaatcatagctcactgcagccttgaactcctgggctccagtgaccttcttgcctcagcctctcaagtagctaggactagaggcgcagggaatttctcatcttctctctactgcctctgagttggagatgtcagagggagccatggcccactgtaaagtaacacaatgtcctcacccacagggttagaacccctcttctggtggcagctctgaggggagcagtcacatgtggagagtgcagggctctgtgtccagctgggggaaggaggttaccaaggggattgacccccctctggccaggtggctgccttctgacacaccagtctctctctctagcacggtggcccctacacacccagcctgtcaaacctacagccctcgggaaggctttggccaaatccatgagcggctccctctgttaagaaggaagcacagctgaagcatgaggagggcagtagagtgtgtatgctccgccgcgtctccccacagtctgaccagaaggaaggggcctttcagccaggctcgcccaggctggggttggagtgtcagtatcaagccaatgtcttcttgcttaatgagtgagcccaggtgctcccgtgcagctgccaccgtagtgagggtgaaccggcaggaggctccacggcactttcaggctcaggctgcctggtgagatctactctgtgggctctgtaggctggtagaggcttccaggaggaggaggggatgcagccaccagtccccactcctgggagtcgtatttctgaaagcttgggtatacagtaaatattaggctgtgggctggtttatctatggatttgatgtgggagggttataggtacaagcagtttaaagatggaaattttgagagaacccttagtgctgggtaaggcaagcaggcttgtcaaagcagctcttttggggaggccagaatcctgtaccaatgtcctcagcatgttcatcagctgctgggggagtgccggacaggatgaaagcacaggagaactttgtggatgataaaatgttccatatcttcaaaggaggtgggttacatgggtaatgcatttgttaaaagtcatcaaaatgtaaaccagatctgtgcatttcacggaatataaattatacctcaaattagaaacatttttaaaaagacagatgggctggatgcagtggcacacgcctgtaatcccagcacttggggaggccgaggcgggtagatcacatgagtcaggagctcgagaccagcctggacaacatggtgaaatcccgtctctactaaaaatataaaaattagccaggggtggtggcatatgcgtgtaatcccagctacttgggaggctgaggcaggagaattgcttgaacccaggaggtggaggttacagtgagcagagattgcaccactgcactagagcctgggcaacagagtgagactccatctcaaaaaaaaaaaaaaaaaaaggttttcaacattcattaaaggcagagtagcttgttatagactagcctccccacaggaacagttagaaaaactggacaaaaatgtgtccccccttccccccaccatcaaaaacaattgttggaaggtaattggggacctcagccaggacttgagtgaccaggcctaggaggtgatcctgacagtccttagtgcttttcccacatttggtgatcggtcaacagtagagggctaagaggctaagaaactgagtatgaagtgatagttaagaggctggagagcctagctgaatgtttggcactctcacagggctgaaatgacataatgagaatttgggtcccagtaaggagatgagaccttggtggggatcctggaagggccacccctaagagtccaaaagaataaaaaatagaccagctgtcacaaaaactaaaacctgctttgagccagcttagtcccaaactagatgaaggcgatctgcttgaacgccaattgtgtgccataaagtcaaagtcagtactctctggaggcagataaaactttactaggcatgccataagacaagacaacgcaagacaaaaggagaaaacaaacaaaaaaaacaatagaaacatacatagatattagagtcctcaggtagaatttttttttttttttttgaaatgggagtttcactctgtcacccagcctggagtgcagtggtgtgatctcagctcactgcaacctcaacctcccacgtagctgggattggtgatccacccgcctaggcctcccaaagtggtgtgattacaggtgcaggccaccgtgcccggccagtattttgccacaatttaaaataaattttctttttttcaagtttgttctcagactgtattcacaaggtcacatggcggcttacacttctgtaggccttgttgaccgttctttttagatactgatgatcttgatctttttcttgtctcctccgtagaagaatgggatgcaggaggtgctgcctaagcctgggcgctcctgggcgttcttcattccagggggcagctgcatgatctgtgcagtgcggttgtcatgggaataacccttcccggcctctcgtgcaggctccaggctgccagggtggctcatatcagaaggatatttggagggagggaggcagggctctgagcaccgctcctcctgcgtcttctcctgctctcccatcctctccttcttctcccgcctcttctccacctgcctccggatcttctcctcctcctcctgcatcttctcatactcatcccacagcctctcctccttgaattgcagcctctccacctgcttccgcatctgctcctcctgctcccccatctgctcctcctgctcccccatctgctcctcctgcttcctcatctgctcctcctgctcccccatctgctcctcctgcttccgcatctgctcctcctgctcccccatctgctcctcctgcttccgcatctgctcctcctgctcccccatctgctcctcctgcttccggatctgctcctcctgctcccccatctgctcctcctgcttcctcatctgctcccccatctgctcctcctgcttccacatctgctcctcctgctttcgcatctgctcctcctgctcccctatctgctcctcctgcttccacatctgctcctcctgcttccgcatctgctcctcctgctcccctatctgctcctcctgcttccacatctgctcctcctgcttccgcatctgctccttctgcttcagcatctgcttctcctgcttccgcatctgctcctcctgctcccccatctgctcctcctgcttccccatctgctcctcctgcttccgcatctgctcctcctgcttccgcatctgctcctcctgcttccgcatctgctcctcctgcttccgcatctgctcctcctgcttccgcatctgctcctcctgcttccgcatctgctcctcctgctcctgcatctgctgctcctgctcccgcagctccttctcctggtcccgcagcctctgctcctgtctccacatcttctcctcgtgcttccgtagcttctcctgatcccgtagctcctcctgatcccgtagctcctcctcctgcctccacatcttctcctgcaaagtgttggtttgaacctcaaaaggaaatagagtcataagctaggtatataaatgtaatctataaaataacggttttcgtctatgattctttaaaaagaaattttaagccgtaaccctgaggttctgatttcccaggcatggtcccaatttgtagatttttagcacactctagaggattctgtggtgggaccagaacaaggacccaaattttccagctcttggctggagcctccccacaccctgcatgatccctagaccatgtcccagccggatgcggctcccacacccccggggctgccgccgctcacctgtggcagcgggattttgtccgtctccagtttcctttttagctccttgatgtggagctggatctcagacttttcagtttctaccagtcgaagtttttcttgtagttcggcatttttctccttcagctccttattggttatgctatggccggaggcagtagagaaaggaatgaacgaagaacagaaaggaccgctttggtgatcgaccctctaccctcgccccacaaccacagaaccgtggcactggaagggaccccaggaattaaaagtcccaggtggcaggccagagagaagacatgagttgcctgaggctaccccatgagtcagtggcacagccggcactggagcttccctgcacacacatgtaaacctgtatgaccccctaccatgctcacctgtaccccccacctcccagcacaccacccacgctaagggctctcagacctcccatccccccctcccctatcctacatgttcctgaacagctccagactcatggcttccctctcctttgttaactccttgatgtactgcaaacagagaaaggtcaagtcaggatacagcaggcagaggagcagctggacgaccagtaacgacagctacactgatactccacagtaacacttgctcctctccgtcacacccgacatgttctcaaggcgtttccaaacccgtggtgtcatttgtttttcttttctttttttttttttttttgagatggagtttcgctcttgttgcccaggctggagtgcaatggcgcgatctcaccccaccgcaacctccgcctcccggcttcaagcgattcttctgcctcagcctcctaagtagctgggattacaggcatgtgccactgcacctggctctcacttgtttttcggagaactcagtaagggtggaaggcacagagaaagagactgaattgatagctggctaacaggggcccagagcgatcagataatattgttattgctattactgttattattaccactgttggaacctttcttgagtgcttcaccaggcactatgctaacaatcccatttaatcctcacagccaccacaggagacagttatcattatcacctctattgtgtagatgaaaaacatggggtattaaaggttaagtgcttgcctaagatcacttagagctgggatttcaacacccaggtatatctgattctctaagcccattcttttggttgggggtaggggcacagataaggaggaggaaattaatcctttgttgatttttgaaagaatgatacattggcatagtccaaacctcagaaggtacagaagggaaatatcttcccccaacactgttcctctctcctgagttttttatgaatccttacaaacatgttttatgtatattaccataatacgtacgtacacacacacacacacacacacacacacacacacacacacgtacatgtgttccctctctctacacaaatggtaacatactaaagatactcttctgtaccttcatggtacaagtaccctcaactccgcctaggatttgaccaaggccacagccaagtatgggtggggtgggcacttggcctccgagctctgtgtccagtgctcgctccccacagcgccccgcaactcacccacagcagctgactcagccccaacctgcctctaacaaccacgcacaaaagcagcaagaaatggcccatgctgtcttctgggcaggacactgcatcctgcagaagggacctttaggctcattcctccatctgcgaagctgggctcccaggggaccgggtaggtggttggactcaccttgtccgccctctcgtgctctgcggacatagcagagagagcccgctgtaactctcctgcaaagtgccaggaatgatgcaggcgggctgccagatccttggaatcttctggaatgagagaggttgagctgcagcccaaaggcctgtgaaagtgccaggttgaaggatgacggggtgcccagattcccaccttcaaatttcctggcagcatcctggctgtcatggagcgctgtctccagttcagttttctgacacataaggattcgtatggtatgatcctgggcctttgggagacaagaaaagcaagtgctgaaagagaagcaaagaaaccttctccagaggacaggagggaacttcacaccctccactcacctctagctgcctccttagggcttgctgatgttggtggcttgccttattttcctatagaaaagaagaggaagacagagctcttactagagggaggcagagatggcacagcaagagacatgcccccagaatggccccactgtcccaggacaggcccacccatgggaccaggttatcagggaccctgtggggatggggtggaagctgggaggtgagccttcctccccaagctgggagtaggcgagacgagactggggcctctacatctgagtgccccccaaacccagcggtcatgtcgtgagcaaagaaagaaaccatgttacctctttcagctgagctcggttctgttgtttctgtggggagagtcaaaggaaggtgactgagggtggtccctcgactctattccccaggccaggaagcggtaggcaggggtcaggaatggattttaagggcaaagttctcagacccaatgggaacacaaactggtcaactttccttaacgcccaaagaaaaaggatttgggtctttgttggcttttgcccacagccacagaactgaaagtctgaaactagattctctggaaaagacagtaacataaaccttccgacataagagtgtgagaaaagcccacccttctgccagcttgtgatggagaaagatgtgttcattcaacaagcattgagcaagcacataggggccggggacggttcttcactgctgggatataggacggaaaaggcagacaggagcccttggccccaaggtttccattctagtgaatctttaaatctcagactctcagagcaaacagaacctctgatactctaactctacctcctcaggaaacggaagcccaaagaggaggggagcttacagcaggccctggactagggattaacacaaaaacaacagcaacaaatctgatttaagcttcacacatgtaagtaaaacattaccatccccattttacagatgtgaaaagagaggcccaaagagctcgagcaattttccctaaaccgtgtccctcgcagttggagagagaagtaggactcaaacccagaattcttagccagtacccagcagttcttccttccacaatcttaacagttaccctcgacctcccccttgtgccccttgtcctcaggagaccggccagccaagactcacatcctcaggcgagtggcagccccccgaagtggttgtctcagggttagcgccatgatttattttcttctttttggtgtcggttgctccggtaccaacaccagcactgttccactgatgatagtctgtaaactgtggaaaagaggagcagtgatactcatgagaactacaagctcctacagtcactttacagtttatacaaaatactctcatagacgatctgacttaatgccaccaacgactgtacgaggtgttgtcgcaatcacttagtgactgagagggattgataccatggctaaaagaaaggcaataatggaactgaaactcagtcttctgactctgagctctggggtgttgccacaaatcagcagctgccagagaccaaaaccagaggcagaggtagaaaagtaaaaagtaggcaggaaggtgtacactgtgtggtttacagtcgtacatcctcttagagtcatgtatcctcagggcagaaggcagcctttctgttaaatgtgggaattaaacagaaagaggacaacccaagctgcatttcagagagaagtcttgtatactctttgaaatctatgtgactatcatccctaagaacattaatgttttgtgtctcccacgagaatcaaggaaaactgatgcttcagaaagatgccccatatgtatcctgtggcactcaaagtaccccaggttgagatgagatgaggaagattcaagttgtcaagtccagtttcccaagatctcttgcacagaagatgagcaaatctcacttcaaagatcactgactgatgggcactctggtcccagaaccatggagaattcaaatatgaagtggagaacttagaaaaaactgttaaagtctctctggagagtagaagcctgggagaaaaccaaaccaaacccattatcccatcagtgctgtgcccaagttgcctctttgagattggcatggggtcacagggttgggacccaggtacttggagacgtgagcccaaagagcccagggaagtcaggcttggggcagcggtaggtgagggccgagtatggagtggggagccccaggagtcacctgcccaaagtcaccctggggtgactggtgagggcaggtgctggggcatccggttccttgggaacgtgagcccgaagggcccagggagatccatttttggacaataggaggtgagggcagagtacaaagcagggagccccacgagtcaccggctgaaagtcaccctggggtgaccggtgagggcaggggcaggactgctgaggggttggggctgacacaagattttggttgggggagcccagaggcactggggggggcccggccctgcgtgcctctggagtgacacggattctggcagctgttctgccatcagaggggacctggggctgggttggggttggggtgctgcaatccgatgcgttttacctttttcttggtcccagccaattttctttgttgggttttttcggacatcatggggtggggagggtggtggggttggggtcacattggcgtgatccaggcgaggacagtgatatgcctccagtcacgtaccacacagctatgtgactgagccacaggaggcgtcaccggggctgcactagaatgcggaaaaggggcgtggccttaatgctccaagcccattggtcaatgagaaagatgaaagggaaaggaggcggggccaggcagctgcgggtcatgaaggtcctgtgatgtcacaaggaaagcctcccatggaactgctgtccccgcccactctgggagaggggcggggctggctttcacttacttttttttttttttacatatataactttttattataatttaaggtatagtcgataatataatgtttttttttgttttgttttgttttgttttttttaattgatcattgggtgtttctcgcagagggggatttggcagggtcataggacaatagtggagggaaggtcagcagataaacaagtgaacaaaggtctctggttttcctaggcagaggaccctacggccttctgcagtgtttgtgtcccggggtacttgagattagagagtggtgatgacttttaacgagcatgctgccttcaaacatctgtttaacaaagcacatcttgcaccgcccttaatccatttaaccctgagtggacacagcacatgtttcagagagcacagggttgggggtaaggtcacagatcaacaggatcccaaggcagaataatttttcttagtacagaacaaaatgagaagtctcccatgtctacctccctctacacagacacggcaaccatccaacctctcaatcttttccccacctttcccccctttctattctacaaaaccgccattgtcatcatggcccattctcaatgagctgctgggcacacctcccagacggggtggcggccaggcagaggggctcctcacttcccagtaggggcagccgggcagaggcgcccctcacctcccggacggggcgactggctgggcggggggctgacccccccacctccctcccggacggggtggctggccgggcagaggggctcctcacttcccagtaggggcggccgggcagaggcgcccctcacctcccggacggggcggctggccaggcggggggctgacccccccacctccctcccggacggggcggctggccgggcgggggttgacccccacctccctcccggacggggtggctgccgggcggagacgctcctcacttcccagacggggtggctgccgggcggaggggctcctcacttctctgacggggcggctgccgggtggaggggctcctcacttctcagatggggcggttgccaggcggagggtctcctcacttctcagacggggcggccgggcagagacgctcctcaccttccaggcggggtcgcggccgggtagaggcgctcctcacatcccagacggggtggcggggcagaggcgctccccacatctcagacgatgggcggccgggcagaggcgctcctcacttcctagatgggatggcggccgggaagaggcgctcctcattttccagactgggcagccaggcagaggggctcctcacatcccagacgatgggcagccaggcagagacgctcctcacttcccagacgatgggcggccaggcagagacgctcctcacttcccagacggggtggcagccgggcagaggctgcaatctcggcactttggggggccaaggcaggcggctgggaggtggaggttgtagcgagccgagatcacgccactgcactccagcctgggcaccattgagcgctgagtgaaccagactccgtctgcaatcccggcacctcgggaggccgaggctggcagatcactcgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagcttcggcacagcatcagagggagaccgtggaaagagagggagagggagaccgtggggagagggagagggagagggagaccgtggggagagggagagggagaccgtggggagagggagagggagagggagagggagagggactcactttctaaactttaaaactttatcaccttagttgaggtacaaatcctgttgtaatggaaaatttacagcgtgcttaatgattagtaaagcagattatattatccaacattccaataagataaaataatcacagtgatttctcttttttggaaaaagtttctcttattctcctacattattgttaagttttttttttttttaaactagagatatgtctaatatattttaaaacacaaagcttttgaggtgggtgtggtggctcatgcctgtcatcccagcacattggtaggctgagatgggcatatcacctgagatcaggagtcaagaccaaaattttagtattttagtgtgtattttagtatttattttagtatttaatacatcatttagggctacatgtagccacagaaagaataaatctgattcagtgacttaaagaaatatagatttcatttttgtcacttaaaacgtgcagaggaaggcagtccagggttcttttcagtttcctgatacttccttagcctggtttctattcttgtggtcacaatgtggctgctgtttttccaggccttggattgccttccaaggagggaaagatgaaaggtcaaaaggctgagtttgtctctttttagctgaaaaacacagatttctcaaaagttgtaaaattatactgcaattcaattttcatccttttttttttttttttttttgaaacgcagtcttgctctgttgccaggctggagtgcagtggcacaatctcggctcactgtcataatgtccgcctccatggttcaagtgattctcctacctcagcctccctaatagctaggaatacaggcgcatgacaccacgcccgactcatttctatttgtatttttagtagagacgagatttcaccatgttggccaggctggttttgaactccagaccttgtgatccgcccacctctgcctcccaaagtgctggaattagaggcatgagccactgcgcctggcctgcaattttcatcttttggctgcaaataagttatgtcactattctcagctgggggagtgtttaactcacatgttgcttcctctctgttacacaggttttaagatttatgaataggtactgaattgtatcaattgcttttttctttcttgattgagcagtgttttttcttatctttttatgttgataaggtaacttaacagtgattggcttttgaatgttgaacattgcattttggaattaaatcaactttgttgtgataaatgattaataccatattatatatggttgagatgggtttgctcctagttcatttggtagttttgtacttacgttcacaagagaaagtggagtctaagtttttctgtgtgttttttttttttttttttttttttttgccacggagtctcgccctgttgtccaggctggaatgcagtggcatgatctcggctcattgcaagctccgccttccgggttcacgccattctcctgcttcagcctcccgagtagttgggactataggcgcccaccaccacccctggctaatttattgtatttttttagtagagacggggtttcaccgtgttagccaggatggtctcgatctcctgacctcgtgatccacccgcctcagcctcccaaagtgctgggattacaggcgtgagccactgcacccagacttgtgaggttttaatatgaagtattaaagctatgctggttagacaatttgagaaatgtttcttctcctatttctgacagagtttatgtaagatgtgtgctatttcttccttaagcatttggaaagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctcatgaacactcctcaatttggagagagagggactgtgatgaggggggttgagatggtacccagagcctgatggccctcaccagcttcaggagaaacctgctcccctccagggctccttcctagggtccggcttgcactgcattctgggagaatcctgtagccccatcttccctttacccattggccgtttaatggtatcccattctcacatttagccttttgaatgaatcaaccaccatattaaaaaattaatagatttaatttttttttcagcagttttaggtttatggagaaattgagcagaaagtttagggagttctcctgtacaccctcaccccatttcccctgtttcctcattattaacatcttacattggtgtggtacattcgttaccattgatggggcagtattattattaactggagcccatagttaaaacatattggggttcactcttcatgttgtatattttatgagttttgacaaatggggaatgactcagctaccatgtctttgttttagtagatcgttagttgctttttgtcttattagctgactcttgttttgaggagaactttttgtcacatccttttgcaccccggcttactgtggcgtggggcaggggtactgggggccagctggtctctggggagcagcactcactgcatcctgcccccgccccattctgctcctttctggtctcagcagcctcccttgctcctttcacctgcctaccccagctcagctgcctgctgcttagatgccactgtggggcaaggaagctgcccccagtcggtccccgaggattctgcccagatagggataagaatcaccgcgagtgtttgctgagcacttgggaggcataggctcggcgggaagggaaggcctgcaggctgaggtggtctgctttgagttttgcagcgttgcctgcggtctccgtgggtgagggaaaaggcacagggaggtgcagaagcgttcctggcgccacggagccggtcagtgacagagccgggtctcaacccaggccactgccctcggcagccaagccccttctttattttggaatggccacctggccaactggcacacagggagaactcatgaaaggaggcgtggctcactcctgaagggagagggacacaggagcagccttgatgcgcaacgccccctccaggccccgagtccctgtccttggaggaagcaggactcccaggtgggagaggtgaagcagatggcttcccccactgcaaggaggaatcccggtgctcttctccaccagccttccctttggtcgccccctggcgtccgcgtcattgtgggaacactcgggcgggatgtattttaaaggagtgcctgatgcgtgtgggtgtggtggggttgggggtgggggtggggctgggggtggttgcagcggggcctatgcaggatcccggttggagggggctgcagaggctactgctgggcctggtgtcgccatggcagctggagagcgggcgaccggtcgcttggcgtcctgcttggggttgttgcccacatcaccgagcgaacgttcctgtcccgcccactcactgcgaggctgggcagggccgcttgccagttaattgtggggattattatttttttttttttgtagacggagtcgcgctctgtctcccaggctggagtgcagtggcgctatcttggctcactgcaagctccgcctccagggttcacgccattctcctgcctcagcctccggagtagctgggactacaggcgcccgccaccacgcccggctaattttttgcgttttttagtagaaacgaggtttcaccatgttagcaaagatggtctcaatctcctgacctcgtgatccgcccacctaggcctcccaaaatgttgggattacaggcgtgagccactgcgcccggccggttgtggggattatctgagagttgctggagtgttctgcacttccttgcgaaccttttacctgggtgggcagggggagaggccgagtcaagggaaggaggcaggatgccacacacgccctgcagggagagtcatctgctgggcactgcgacacacagaaagccaggagcctgagccccgcccgcggttgttgaacggagggagaatgaacaaccgctgacttcctggttcctgggtgccgcatcactgcccctctgctccgggtcaaaccggctgtatgcttagcttcaggaacatgtggcaggtggcagcccccggccccgtggcaggtaacggtggttttgcagtgtggcgtgctgtgggggccggcaggggcacagctgggcaggccaggctttctctggctcagtatgcagggctggttcttcccagaggaggcagaggtcagggaggagctctttccctgtgtctcctgaacagcttcatcagcacaccctgcagcggggactcagtgagcatcctgcagctgtcttgtcccagaagggctgtgtacttttggccctgagggcaacctctgcatttcctttctgggggctcccagatgagccccgctcccccaggtcatcctgatccatattgatgtgataaccccctcctcagtccgaaacatctggaggccccgtttgtccgtgggataagaatgggcttgagcatggctgtgggtgctccgtgtggcgacagtggcatgttctgtggcagcttgcttcctctgtagcccgatgtctttgactcccagcccgatgctccctcctcacccagcagaggcccctcctcggcctttgcatttgctttcatttatcttccttctttaaggctgcttttgagggtttactggccagcagcatcatgtgcagtctataaactgtgtgccctctcggggccaggtaggagcctgagagggaatgggagaagtggtcacgaatgattgtgaggactgcagaaagaagacagggctgagaagagtgtgatttcccctagaattcagagatgcctgcaccagctgggttttgaagaatgaataggagtttgccaggaagattctagaggaacaacagcaacaaaaagatttaaacatgggcacagaagaggtgaggcacagatggcacagggatttggggtgtgatggggcaaggaagccatgggcagggtctaggcccaggacctcaggtgctttgcatgccatgacttggaggcaatggccttgtcatgcagaactgtgcctccctgggccccattagagtccctggctcttggtgtgcctttcatgcccacaccacggtaggagcaggcaggtggggtttggcctgggtttccccaaaatggacactactccttcttgtgcttcagtatcagagtgggcccgtggagtgggaataaatgtttgggtttaggaggcctccagctgggtggcctgctcccaggcaggaaacacagattagaggaagtatcaagttggaaggcagcagccgtggatgttaaagctggaggaacctcttaaggaatggctgtcagctccctcgtttggtgtggtaggaagatgagggtgagaggggttgggagcaggtgctggagctggagcctgaacccccatatctcagtgctgccatcatccttcataataaggaaactgaggcacaggcaggttacatagtcttctcaggatgtcagtggcagagctaggacgtctatctctgcagctcagttctgtgcgaagtccaggcagatggtgctgatcagtaaggggtgctggctgagcgctgatggccacctgcatctcaaggagaaacagtgtcactggctaatctgatggcttctctgggcaccagcacgtgggcaccatcaccctttctctgcagggggtttgtttagtgtatttggtagaacatcccccagcctactaggtgtggcatgctctatgccacaagctctgtatctcaggcagcattttgtactttgaaaaaacaagttgggaacagaaccctgatgaatgtgtttcatttcctgtcagagcaaatgaaacctgaaatattaatggcacgagatttcccttatcttcctacaaaatcttcctacattgaaaaatgtactccccacaagcttagcatgcagctctgctacctgtggcccgaaatcattagttgtccatactcactgacctttggaaataaacacgaaggttcacttgaagacttgggggagaatcacggtcaacttgtgacgcttggtttttcagatattcagctgctctggagagccttggagttccagctgctctagaggttctggggagggagctgttagcctcccatatgagcgtgtggcccatcgttgccatccacacctgcccctctgtgggtgaataagtggtttcctttctcagctggttgacgcttcatttgtttgtgttctttttctttacagtctcctgaatatttacgcgttgctgaatctcctgtggacaaaccaccaataggccaggactgtcctgtggacagacggggtgagcctcttcttgtgtctggagattctgagtgagtagaacccgttatgatccccactgcacttaatgtggcattcatgaatgagtctgggctgatgtgctaattgggggccgtaagaagagttatagccacgatggccctcacctttctctaataaaagcttaaacacagctacggtaaatatttttgctttctgctttcacaaacttcacatacgcttacatttattttgaggcgaaaggggaagaacagacatttacaggggaccagttgctaggagaagactgtgcattccctgtaaccctgtcagtctcacctcggagatcctgtccctggagtgccccaggtcccttttcccagctgcactgagtgcctctgtcctcctggtggagctgtgctgctttcttgggcagcctcccttccccatggggtgcacataggctgggggcatcccggtggtcagttcttcccagggacccaggaggaggggctggcagaaagtgggcaggttctttccgctcgacctggcaataacaattcctaaattgctcagcaccccaggctgcttgccttgacccaggtagccagtcccaggcaccaccagtgtgggcagggccctccccaggggcagcagcagggcagcccaagacactggtggccaccacagttagtccccacaaggcgattgtgcaggacatgttctcgagctgcctgcagggtctggttgtgggagcagctcagcccctcctgcagaggtgggagcatcttctacagccagccattgtcccgcaggagctctgtgcccagtggaatatctcagtgcagtgcacaatggggccacagctgtgtcacagccatgctctgtcctttagtgggccgtctgagccacattccacctgcctgttctgacacactgctctccctcgatgaccctgctcccactggcctccccatggtttcgatctgtaacccagaccctgttcccaggagctggctcagcaccatcctgctccacaccctctctcaggagacatcctaacctgcccagcctgtcctgttcctgcctctcaacccagaacactgcaggtccttcaggtattcggtgagaccttagaagcaggcacagcaggatttatcccacatgcaccatgcaccgtgctgaggaagccacggtcactcccctaatggtcactagaggtgagagaactgaggttgttgcccatgtggtagaactggaattcagggcctcagccacacctcagtcaccacaccacgccctgtgcaggacgctggggaaaccaggcagctaggactggcctgtgccttggaatgcttactcagaccacccatccttgtcccctttgcacctcaaaggcttggtctacttttcagacacagtttttatattgtcagcctgatacatatgcatattttaagatgtcaaagagttttataagttttatgaaaaaaatagcagacccctggcctcccagaccatctccccaccgcccctgccctgcccactccccatagattaccacttccagctcttattgcttcttcctctggatttatctccacatttgtaaagaatatgggcacgctgctatttcttagtcttctgttgtggtcaagatggttgaactcgtagatttccctcctgagagctgctccatctaaccctaaccctaactctgatatatagagttatgtcatcatttaggtgaacccttatgcagtgtgtatcagtcaggataggctgcctcatgatgcaggaacaagcatccccagacctgagagagttccgtttctctagcctcctgccctgggggtgggtgctgagtctgggggaggtgtggggtggggggaggggcctcagcgctcagcagacaggtgctcactggtgtcaccatgttccctgccctcttctcatatggaacacgtggtgcccttttgccagggcatccctgctcaggggtcaggatagtcctcctctgagtggctgggagtctgactgctccctgtttagactattgagtagccccctgctttctgcctcactccctttttgtgctggtgtctcagtgcttgggccttttggggttttagaggtgggccgtgaggctgggcatgaaaaggcttctctgcctccaccgcccccccggggctcctcatccctgtgctgcctcagcacttcgtctggcaagatttgcaggtgcagttttcatttctcattctttgttggttttgagtgatttcaagagaagatgcagaaaggctgtgaccccacctctaaaagccagcggtcaacctggccacccttaagcctgttctagtgggccccctgccccgttgccctgctgtgacagtgtcccacgaggacagactcaacacaggacttcagtccttgccttcccgagtgctggcagccctggtgctgttgctttccctctcccctccttgttctcaacctcaggaggaaaatgcccagtttctcatgatgagatatgatgtcatctgtaggttttttttttaaaaaagtgggtaaaattcatataacattagccattaaccagttgaaagtgtgtaattcagtaacatgtagtgcatttgcagtgttgggcacccactatctgtgtctagttccaacaagttttcttcatcccagagaggaactctccattaagcagtcactccccagcctccctaccccagtctctggcaaccccaatctgctttctgtctccatggacttacatattctgaatgtttcccataaattagacatcatataatttgtgaccttttctttctggcttctttggcttagcatgaagtttatgtggatgacccatgttgcaacatgtgtcagaacttcagtcctttctaaggctgaacaatattgcattctgcagatacaccacatttgtttgtgccttcatttgatgggcgtttgggtagtttccaccttttgactgtcaggaataatgcagctgtgagtgtgtgtggatagtgttagattcggtatctgttttcaactcttttgtgtatgtatttaggagtggaattgttgcgttctgtggtgactctgtttcacttttccaggaactgccaaactgttttccaccacagctgcaccgttttacattcccgccagcactgaatgaggattctcattttcccccatcctagccaacacttgttagtttctgttttttgtttctttgtttcatgatggccagtctatgggtgggaagtggggtctgactgtttattggcatttcctgaataggttttttggtagatgttctttatcaagctgaagatggtctctgcctcatttagtgagtggtttttaatcagaaatggttgttggatttttgtcagatgctttttctgcatcaattgatctgatcatatgattttgtctctttagtctgttgatgtggtagattatatccattgatttttctaatgttgaaccaacattgcagccttggaaaaaataccacttggttgtagtgtataattctttttaaacgttgttagatttgatttgctaataatttgttgtggatttttaagttgtttgctcctgagaggcagtggtatgtcattttcttataatttctttggttttgatgttaggataattccagcttcataaagtgaggaagtgtttcttcttttccaatttctggaataggttgtaaagaattggtgtaatttctcccttaaatgtttggtagaattcaccagtgaaatctatcttccttttactgatttttagtttaattctattgtagtctgagaacatatttttatgatttctatttttaaaatacttgttaaggtgtacttcatagctcagaatgtggtctatctttgtgaatgttctgtgcaagcttgagaagaatgtgtattttgctgtagttggatggaatattctataaatgtcaattctgttgagttgatttatgatgctattcaagtgaactgtccttgttgattttctgtctgcttgttctatcaattactgacaggtcttgaagtctccacttataatagtggatttaccaatttctcatttagaattaaaattctctcagattttgccccatatatttcaattatctgttgttaggtgcatagcctttaaggattgtaacatcctcttaaaaattgatttttctctcattatgtaatgtcgcctctttatccctgataattttccttggttggtagtctgctttgtctgaaattaataatggtactccaacttactttgattagagttagcatggtatacctttctctatccctttacttttaacctaccagtgtctctgcatttaaagtagatatcttgtagatagcatagagttgagacttgtgttttttatccactctgaaaatctctgtttcaatgggtgtgttttgatcattcacatttaaatgattattgaggtacttagattaatatcaaactttttagtaactgtcttctgtacttgccagagacttctttttctctctcctctggtttcaatggaccattttatgtgatgccattttatctcctttcatagtgtatcactcatacttctttttaaaagttttacaatatatgtttacaatatgtatttcaaaataatctaagcccaccttcaaataacactatacctcctcccatttagtacaactaccttataacagaatactcccaaatcctccttcctgtcccttgtgacattgctgttaattatttcaattatccatatgtcataatcatacagtatatcgttaccattattgcagtaaataaatttatttttatatcaaataagagtaaggaaaatagaaaattttatttcactgtcatttattcctttttgaatacctcttttttatgtagatccaagttttcaacctatataatttttcttctgtatgaagaaaaatcttttaacgtttatttcagggtatatattgccagtaatgaattcccttggttttgtttgcctgataaactatttctccttcatttttgaaggatactttttctgaacatagaatgctaggttggtggtttcttctttcaaaattttaaggatttcactccactctctctctctctctttttttttttttttttgagacagagtctcgctctgttgcccaggctggagtgcagtggtgctatctcggctcactgcaagctctgcctcccgggttcatgccattctcctgcctcagcctcctgagtagctgagattacaggcgccagccaccatgcctggctaatttttgtatttttagcagagatggggttttaccatgttgtccgtggctggtctcgaactcctgacctcaaatcatctgcctgcctcagcctccccaagtgctgggattacagacgtgagccaccgcacctggcctatccaccctcttcttcctttactggtttctgatgagaagtgggctgtaattcttatctttacccctctatagataaggtgtttccctaccccgctggtcatttgccttagtcattttctctgtctttggttttctgtagttcaaatatggtgtgcctaggtgtagggtattttgctttttgttttttttttgttttgttttgttcttagtatttactctatttggtgttctttgagcctccatggtctgtggcttggatctgtcattaattttgaaaatattttggccatcattacctcaaatgattttcttctccattgtctcttttgttcccttttggtattccagttacacgtgtaacatctttgatgttgttccacagttcttggatactttgttctgttcccctccccaacccattattattatttttttatttttatttttttgtagaggtgggactttgccatgttgcccaggctgatcttcaacttgtgagctcaggtgatccccccgcctcagcctcccaaagtgctgggattacaggcatgagccgctgtgcccggtcttcccaccattctttgtgtgcatgtgtgtttcattttgagaagttcttgttgacctgtcttcaggctgattattttcagccatgttgatgagcccgtcaaaggcattcttcatttctgttaataggttccttttgggctgggcgcggtggctcacacctgtaatcccagcactttgggaggccgaggcgggcggatcacctgaggtcgggtgtttgagaccaatctgaccaacatggagaaacccctgtctctattaaaaatacaaaattagccaggcgtgatggcgggcacctgtagtcccagctactcgagaggctggggcaggagaatgacgtgaacctgggaggcggaacttgcagtgagccgagatcactccactgtactccagcctgggcaacagagcgagactccatctaaaaaaaaaaaaaaaaagaaacatgttgtcctttttgtcttctagcatgccttgtaagttatttgaagctagatatgatgtatagggtgatgggaactgaggtaaacaggcctttaacgtgaggttttctgttaatctggctatgggctacgtgtaatgtttgttgtagctgtgagtgccggcgtattccgatccttgcagtgcccttgtttttgtcctctggctctgggcttccctaaattcccttcctcagacagagtgagtgtcgtgcagctctcccagctttcacctgctgttgtacactggagtcctgttggtgtagttgtagggtgtggggagggccagcggtctatagtcttctgattacatctcagtctttctgtggtcccatttccctgggctgtgactgtcacagatgtttcttcttatatagcttttccagaccccaaacaggaggccagagggggctggactcaggaatgcccttcctccgtggctttgcaacaaggttctggtaaagtctttccctgcggggagcaggcctttgtcctagagaaggctctggatgcatttcaccaggatgacgtttgtcctccctctgccagagtcaccaggagatgtctcttgggttttcatggtgagaacctagtagggatcctggaggaaaagcccatgaaagttttgggcccccctaagactgtggcttctaggagtttctcagtcatgggagtccacccttggcctgcagcaatttgtcagaattacccaaactactgtggtatggccctggaggctctgttccaggtcagtggatctttggatttggctgtgtctctagatttcaggggggcgggttgcaaactcaattcactgatgagtccaaagaaggtcattgattttcagtttgtgcaccattttctagtcatgaggatgggagtgatgacttccaagttctttacgtgttggagcggaaactccaatccttcccctgctttgattttcctgttaccctaaccgggaatcatgtttgttatttgatggtttactcagttgtcatctgtcttcctaattaggacataagctccagggaactggagtgtcagtgttcccttgcgtccttgcacccacaagacagcctggcacattctgaatgaatacaccgaaagggataaataacgaggccaagccacctggctatgggtggctgctaatccgtaggatttctcgtgccttgtggtttcagtgaatttgcgacacacatgagtgatgctgccaatgggaggctcccagatgtcctcaacaaatagaggagtgaccactcagatccaagggtgtagcacttcccgcctatcactgggagctgatgggctgtctttagcatggcactttgtatggtgctggcgcccaggcttccctggggcaacagcgttggcccaggcgacacacaagaagaagggggtttttctgtggtcacttccgcgttgctagttgttttgccctcttactgtggctaaaccttctgtccatacctgtcccccattctcagtatttggcttttcggattgcagtagtgggacttgggtgcacattgcaataaaccaatttgcccccattatccatgtcttgttgatggtcccactgccagcatcagttcttatgaacagatttctaaaccatcaccatctgttctgctcttaatttcaagtgtaaaaagtattactttcctaattccgtcaaggggagggagaatatgtattcctaaagaccacagttcttgtatgaggaagtgtagatctgccacccacctactaaaggaaaggttgcttctgcccatcctcaaagctgttgagcagttatttacctagagggtaaaactggcccattcgcatctctataaaaacaggtaggaaaaggtggaaggagctgagttggggaggtggaaggggggcaaaagctatgtctcccgtccctccctgacagtgcagccccccaaccctccagcccccgccagtataggtgggaatgggctggcagggctgcattgtggtggtccctgctgctgctagggctgtttccagaagaaggcccagtttcaggcttgacttcccctcagaagtcataaggaccataaggtccatctgggtgggcgctgagctctccacgatgggagcaggatagacatgagcatcttcaccctcgtggtccctctgagcctgccctgggggtgagctctttttctgctcaaatgaacattccaggcaggccctggagctttctgtcgttctaaggcaatagaaggttctttggttactttcagtcccaggaacattgttggtcagtcatgaaaaggagtaattatagactctttggagcttctcccacccggctggagcctgacctgtcttggagccggctggggagggagggctgtgtgtctccttctttctttctttgcctctgtttttgctggccagggagtgttccgagggatggagtgtctggggagagggcattctctccacaagtgggctgggtggcacttctggggtccagcagatgtttcacttggacttcctgtctccagtgaccctcgggtaggtttcttagagatgaccctgctgggaacttgcagctcttccctgcgacctgtgggaggccttgctgggctgatgcccttgactgctctccctatcctccaccatgcccctcgggagtgctcctgggctgttccttcaaggcggccccaggctggccccacactggtgggagcagcaggcagctcctccttgggcagctcctcctcttcccctgtgaggcagctctggtcatggcctcctgcctctggattctcaggaaactcgggtgccgcgtccgcagacattggggactcggtacagctatcctaggggtctgctagaagccctgtttgggaatcatggtgaagccacctccccagccccctccatgaggcacagcccttcacggaaagtccctgctcctcttctggtaccccgtaggccagaaaccatgctggggtggggagctgggagcatctgttgatgtgggatgcaggcgtgcttgtcacctctcctggccctcagggcagcaggacagcttacatgaacatctcatcccgctgctggtggcctctggtgagagactactccagtcggtccccctgtagctcctggatcttagcgggggcctgggaatgggaggccacaaggaggttccagagctaactaaagccgctgagactcagagggagtctcacgccactgcctcctgtgcccccatcccctagcaaagtgggactgatgagggatgaccttgcgtccttctcccctgttcactgggacctggtgctgttgccaccgtgggcccaaacatccactgcccttttagcaaggcagcgctgctccatagggtccagccggggaagcatctggctttgcacaggtggaagatcatgactatttccagagtctgttgccaggctccatgtagttcaggagttgtttctccctctgagagtccaaagtggttgttttccggagtttggcagtacctaagggttaattgggatgttattgtctgcatttggcttagagataggaaagttttatgtttattcaaattatcagtaatttaaaattacaattttagtcttaattgtacgtatttggagatcccatttaagtctttggaaataattgcagagtaatattttgggaagttatattacaatgcacagacgttcaagtggagaaaggtccctgcgtgtgagccttggcctggcagaggggcatccaggacaggatctacagcacacagccctcccaactgggtctgggcatggctgcagctgagtctagccctcctttctgtgctgctgcatcccaggggatacggccacacaggccacagttgcctagaccgacctggtgtcaggatcactgtctctgctttggtaagatgtccttgggaggggaagggagccagccaatgagatgaggggtaggagggtgacagggtggagcagaccctcatgctggcagaagagaggttcacattcaccagggagcaggtttttctgaaccctggagagctgaggggggcacctggagcacccctgcagtccacagcatggggtgctggcttctgtactgtagtgcagtgccatgaggtacccatcccttgcagtggggtagggtttaaaacccagaaggcagccctccctggagcacagccccatggtgtttagagaccctctcctctgagcacatgcaggatgtgacaatgcaggtgggcctagtgctgcagtctcagagacacccatgggcttctgccatgctttttatccaccagggcagtaaaagcaacgtccacagtggcttagcctcctgcaaagcctgtggcaggacagccagggttccctgacagtggagatggtggacggccccatagggggttggtcccatctcgccagcagaagtgacctgtgtggccttagtggtcagtgctgcctattgtgatagtggattgtttaaagccaggtcccatcgtggctcctgagggaatgaaaatgaggggttctttgctgtgatctgatgcttgtgttccaccaaatccatattttggaattcttatccccaaagtgatgggacctttgggagggagacattggaattcacattcccaaggagatggggccttatggaggtgtcttaatctgtattctgctgctgaaacagaataccacagattgggtaatttataatgaacagaacattatttggctcagagttctaggggctgggaagtccaaggttgagggttgcatctgctgagggccttcttgctgcgtcctaacatggtggaaggcatcatatagtgagcgagagagggaagggggccaaactcattgttttattaggaacctgctcctcagtcactaacccactctcgcgataatggcattaatacattcatgagggtagagctttcaggacctaatcacctcttaaaggtctcacttctcaacattgttgcatcggggattaggtttccaacacatgaactttgggggggcacattccaactatagcagtgggtgatcaggtcctgatggtgaagccctcataatgggatcaatgccgttttaaaagaggctgcagagagagcctcccgccctccaccatgtgaggacagagtgagaagctgccgtctctgagccatcacgcaggtactcaccaggcacggaatctgctggctctctggtcttggacttcccagcctcctgaactgagacaagccactttctgtcatgtataatctacccagtttatggtattttgtgagagtaccctgaatggaataagactcccttcaaacaaatgtcctgctctttgaaagagagtgtggggctcacagtctgctagtaaagacagttgtaggagcaatggcaagcccacactggctcggattttcagaccttatcattgagttaggagcgaagtcctcgacctgaggttttattggtccaaagtcagggcctgctggagcccgacaggttgcgtgcttggcctgtggagcagttttctccagagcacctctatcccctctgccttgtgccaggcccagcagggactgagggtagaataatgacaggcacagctcctcccctcaaagagtccactatctggggtttgatgctggagcgcaaggaggggctgcccacatgggcggagcagagggcctggggaagttccaggaagaagtgactgtgtgccgaggctgcaggagtagaggcagcccaggagaaaggggggcatgggctggaggtgggggtggttccaggcagagagagcagcttgcacacgggaaaacaaggcatggagtgggcagctccttccgcctggtctctaaacctgtgaagagggggctggggagaagagacgggggtggaggagagcaggactcacaggccagccagccctccacagccttgggaacagagtgaagagcttggactgtgtcctatgtcctggggccggtgccactgcaggctttggagccaggagggactcagtggagcttgctgtgtatgattgtgagtgtggggaatggtttggggtgggaggcaggacaagcagctgtggactcctgtctgcaggtgagtgccagggctcagtgtgggttctgattgggctaagtaggtgcccatctgcctggagtccagctgtccttgtgtggtctgtagaccttgttgtcaaggtctggcagctcaacgctggtctttctgagataatgaaaagggaaaactttagaggcaggacgaagaccttgtagtgaccagtgacatccccacagggtctaggtgtgcgaggtctattggcgcctgtgtgggaaggcgggaaaccaggggcttggggccagctacaaatgccacactgggctctgccttggctctaggtgctttggttgctggatttggtggtggctcagggcagtcacttgtcattctcagtattttatcccctggggcctcctcagagccataggagatggttcacctctgaaggactgccccatgctgtgcttggtaagctcggtcacccagggctgtcacagagatgggctatggcccacatgggctgagcggatttctgccctgccacctacaccttgctgtgattactttggcagtgtttccccgtcaggagagcaggtgggaagggaggcaggtccctgaactgggatagagcccggagacctgggtgtcctctgctctgttgtactgacacgctgcgtgcttatgaaatgagggcaggggttctcagtgctcccatggcatggtgactataatccatgaatgatgcccacacagttcctggcatgctcagtgtagccttgttgttgtaagagaaaaaagcagggattctccacttccccacagagtgaactggaacgaggagagactggtatttctccaacactaggtttctttggatttttatgctggttgatactccctaaatcacaggtcgccttaaagagagcaagagccctgcacggtggcccggacccttggggccccttccatccgatgcacctcgtggcccagtctttacctgctcaccatgcacagcacttcgcatgggtttggaaacgtgtcatctgcatggcaaggatgggaatggggagtgggaacctgcagtttagggtccaggcgggtggattttaatttgcccctgggggattctagggccagcagagctcactgccgctgctgtctgggcctccaggcagtgagctgctgggggagcccctctggaaatggacagtggctgtcagggcgtaggacgctagggggcgaacagaggaagtagaggtatctggggctgaagttcaaggttgcagcatgaagttcagggttgcagcgcccagcctagcagggcagggttcaatctgcaggactggcatgaggaggcagaggagtcagccaagccctcccctcagcctctctccagacactacagatccaaggccaggtctgcatgaggacagccacctggtctcggctgaggttacaggaagggagtcggggcaagggccagtgagtttgttcctaatttgggtcccctaattgtccaagagaagaagaaaaggcctaatttctgtttcgctaagttttagactactttagttcatgttctttaacaataggttattcatgcagagctcatctctattaatcaaaatgtatgattaggcagaaagccctattcccacaccagagtggtgaaatgcagtgcatgtgtgttcagatcaatttttgaagtcttgattttgttttgttacatgtttatttgattgcttgcagaagaatgaagttttttggccctctggaaaatttttctttctcctgagaggttttccaatctagtagaaaatagacgcagagtttggcttgcactgattgcggcattagaagcggccctgtacattttaatgtggaagacgtgatggttttgcgtttgctcctccagttgtgccccatagctgtctttctgccagctctcttgcacatttagttcttgagtgagatgttctaaatagaagccatggtccattcagtccccagcctgctgtccttctgtgacccgccagccagctttgcttagggagctatgagcccctcctactaggctacaaagtcatgggcaggaaaagcatttgtgcacagccaggagcagagcacccaggcccaggtctgtcccggagccatgtggacctggcgaatggctgttcaggtcagaagggggtttggatacaccggttctgtgtttcggaggccagcgtagtccccagtgtatttcgcagaagtgatagcagctttattcccaaggcactagtgcctgcgcgttaggcacgtgctgggtgcctgcttgagtgtctcctttgttcctctctatcactggctgtcccctgcagaggcaagcgaggcagagagttggctggtaacagccagtgtccgcagagccccagggctccctgactgggctgtgccacctggggacaggcagatagaccccaagtaaagttaaagggaagcacagtggggcctgcacaggatgtgagttggaggctctggtgaaactgagacttggtgggggatgggaggcaggggccctgctgggacagacaggagaccaggggccagtggcagaaatggtcctcgatctaccctcatgcagatggtggcctctaccgggagccctgtgtgtctctgagccttagtctccctccctccagtctgcgaaatgggcataatagaaatgatgcctctcactaataaatctgtgcagaaagagaaagcagtttgcaactgcaaagcattattcaggtcttcctggctctacctccaggatcgtatgcctccgctctctcacgagacacaggcctcccatgtgcccggtggtggtctcgaggtcatctgagccatcatccacccctctataccggggacagtgtgctgccaggaggggcaccagaagaggtgtcatacagtggcatgctgagctaggatttgaggcacttcctgcctcttctagttccttgtgggccgggggtgctttgctcagatggtgctggggaggaagggcaatatctaaggatgtattgagagggtcacattcaggtgtgccatcttctgagggacagaaccctgtcacgacagttttgccgtgactgaattcccacattgcagagtgcgcttggggtgtggctctgaacatcgctggcaggtcaggtggagcctcgctgctctggggagctgtgcccaggttccctcggttcctgaagctcagaggttgcaggagaaagggcctcctggtggctgcttactctgccccactgtgaagtgcctggtcactagagttaggcctctctcccactccgggcttcagggattccactgaggatggagggtgttggatttagtttcttttttttttcttttttttcttttgagatggagtctcactctgtcgcccaggctggagtgcagtggcaccatctctgcttactgcaagctccgcctcctgggttcacgccattctcctgcctcagcctcccgagtagctgggactacaggcgcccgccaccacgcccggctaattgttttgtatttttggtagagacggggtttgaccgtgttagccaggatggtctcgatctcctgacctcgtgatccgcccacctcggcctcccaaagtgctgggattacaggcatgagccaccgcgcctggcccccttctggagtatttcgttcattagaagtaagtcagggacttagtgtctttagctccagccagtcctgtggcctctctgccactgtgtgaatgtccccaaccccccacctgataagcaggtgtcctgaggtcatcagggatttggacttagttattaaaaagcaaccagcacccttaggagcctccagagcagagattgccaaactttctcagaccacggtgccctggatctcagcaatttcatggtgtttctagaccaaaacacatagctaacaactctactctttaagtagctaggtccaaaccacatggtatttatgtcccaacaacttggaagccacatgagaaataatactcataaattgaaacaaatgtatttcatcctaaaccacaattacaaacggaagtgtgtctgctgaatgagattggcaccattctcatttcctgtttgatgctgacttttgtgtgggacttgctgtttaaaagtttatttttatttttaatttttatacacatatcatagttatacatattatgggggtacgtgtgatattttttcttgagacagcgtgacagagttttgctctgtagcccaggctggagtgcaggggtgcaatcttggctcactgcaccctccacctccctgttcaagcgattttcatgtctctgcctcttaagtagctgggactacaagaggtacgccacctcgcctggctaatttttgtatttttagtagagatggggtttcaccacattgtccaggctggtctcaaactcctggcctcaagtgatctgcctgcctaggcctcccaaagtgctggaatcacaggcatgagccaccgcacctggcctacatgtggtattttaatataagcatatacattattaattgtggcaaagtacacataacataaaataccatcttaatcattttaagtgtatagttcggtggaattaagtacatcaacattgttttgcagtcatcaccatcagctatctccaaaacgttttcatcttcccaaaacttaaattgtgcgcatgaaacagtacctctcctttcccccttcctccagcccctcccagccaccactctactttccctctgtctgaattcacctctctaggtacctcatgtaagtggaatcgtgcagtatttgttcttttgtgactgtcttatttcacttcgcatggtgtccgtaggggtcctgcacgttgtggcatgcgtcagaattgcttccttttttagtgctgaataacactccattgcgggaatatgccacattttgttgatctgttcttctgctgctggacacgtgggttggttccgccatttggattgtggataatgctgctgtgaacaggggtgtacagatgtctccctgagtcccttctttcagttcttttgggatatacccagaagtggaattactggaccatatggtagctctttttaaaattttttgaagtgccatactattttccacagcagctgcacccatttacatttctattatgccaacagtgtacaagggctccaatttctccacatcctcaccagcacttgtgttttcattttttttgtttttcttttctttcttcttccttttttaaatggtactatcccaacaagcgtgatagcaggaatttgcttttaattacagctacttctggcctcacgagacgtctttcagaggaatgtagtgtgatctcaccttggaaacgagagctgcctcaaggcagtggtgcatgcggtgctgacaggtgccaagggtcactgccttccccatggacatctgggctgtgctgcagtgcccctgtgggtgcagcagggcccctagggtgcctccgtgcagcttgggagccatggaactagacagtgtgcttcagacgagtagataagcacagaaacagagccgtaaggactggggggaacgtccagtccatagttctgtgtggaaccacgatccacggaggcagctgaggggcaagtgtagtgtacgtggctgtgcgctccatctccgtgcttacagccctacaaagtgggaagagaatggaagaaacaggagagaaaaagtcccgtgtggtttcccggaatcctgtgggtagtgagagtctcagcattgttattcctagcatgttttgtgtgtaacgtgagatgaagcaaatgattactgatgtgatcttttaactctgaggaccttgaccaggattttcagtggcgaggagaaaggagatacggaggaaaggtgctgcgggttaagaaagcctcgggaggctgggcgtggtggctcacgcctgtaatcccagcactttgggaggccgaggcaggtggatcatgaggtcaggagatcgagaccatcctggctaacacagtgaaaccccgtctctactaaaaatacaaaaaaaaaaaaaaaaaaaaaaaaaaaaaaatagcggggcgtggtggcaggcacctgtagtcccagctactccgaaggctgagacaggagaatggagaatggcgtgaacccgggtgaacccgggaggtggagcttgcagtgagccgagatcacgccactgcactccagcctgggtgacagagcgagactctgtatcaaaaaaaaagaaaaaaaaaaaagaaaagaaaaagaaaaacaaagcctctggaatccggaactacaaatccataagtagccctagagcgttccctggagaggcctggaatcagtggccaaaccaatcacacggagcacccccagtcccgggtcatgtcttgaaattcagttttctgctgaaagaagctgagactacttggacaaatggttgataccgggttgggggcgggaaatgtacaagttgaacctaaatgctttgtcatagcagataataaaggagccaccctggactgtgaggatgtgattctgctgagagagagcattaaaagaggaaaaaaactattaaagtcaaagtccacgaggatagtgttaaaaggactcgtgagctcacctgatgaggccagagatggacaatttgaacatcagtaagagtaaaaatcacagtaggttgaaatgtatgcagtatgtttaagtccatgagtttttttaacaatactcaggaaataaacctaatccgtcacctttggagaatgctagggaaccaattatatatttttggtaaataagggaaagctctgaaatatatatcctgcttttcttatgcaggccgcactactgggtgagcaggtggcaggttgggaggttccatgtatagaggatggaacctctgtgtctgaagcgtctcagcacatctgaattcacaagctgggcgctggtggccctggggcctgctgacatctcaggaagggaggaagagccacactgcccgggagctggtctgcccctattctaacagggatctcattcgacttccagatccaaccactgatttgcaggaacggaaaggacagaggacgatgtttggctgtgcttcaggcacctggccatcaaaagccaaaccatgggaaatgctgtgtgaccaacgactcttcagttaataacttgggaggcaaaaaaaaaaaaaaaaaaaaaaagaggtggaagcacaaccaacggttaaaggggacataaaaggcacacatagtgtgtgtgtagggacatgtgctacatggagcagggtggggctatgattaccctacaaccaggatgtggtcaggggcacacagggaggctgggtcccgagggctggagtggccggtagggcccctcttcttccctgcctgaggattgtaaaggttgtttcatagccgttttgtttgtttatttatttatttatttatttagagatggagtctcgctctttcgcccaggctggagcgcagtggcgcgatctcagctcaccgcaagctccgcctcccgggttcacaccattctcctgcctcagcctcccgagtagctgggactacaggtgcccgccaccacgcctggctaattttgttttgtatttttagtagagacacggtttgaccgtgttagccaggatggtctcgatctcctgatctcgtgatccgcccgcctcagcctcctaaagtgctgggattacaggcgtgagccactgcgcctggcctcatagccatttattaagctaaatatttacactatgttttctaaaaaagtaaaattattttaacaacataaaagtcaaaggaagaagttcctggaagtggtcttgaaggtgcaagtgggcaattgtgaacagtctgctggtgcaggatgtggcgcttcgtcgtgggagtgctgtctccctccactgtgggccgcgctccttcctgcagcactcgcagctcactgctgccatttcccgtgtaatcctgtcttctgtcttgactcagacccactcgtatctttgttgtctggggtctgcgctttactaggggaccttggagttctgttgttggctgtgacttcattccatgttctttcccataaggaactgtgttgggaatagtttgatgattccatggtcatgccttttggccttttctgtgaggggcgaatggggagcacatggaacttattgctgctgtcttcagtatttcttgggggaggaactcggtgtggttttttccagcctgagcccaccctgaggtcggttgttggacccacctgcctgatgcagactgccagggtcttcctgccagcgcgggatcccccactttccatttcctcttgcaaccatcagacccagggacacatgtgtggctccttctccagtaagcgacctgggaggtatccttaccccaggacccgagtgagcgtctgttggagactcccaggtgtgcaggccagaaggacatgcccagttgtgtggctgcctcttccctgcagggagagagagaaggctggcgtggggcttctccccgggctgggcctgcgttgtccccgaggcccgtggccgctggagcagcccctgagcgactctgctccttcctgggcctcggtttcctcgttctcagggggggcttctgccagactgtctgggagatgttttcagccctctaatttgtgcatgctgtgactcacccaaaattacagagcaaagctaatggaatcaggaatttataaatcccccttccttcctcacgcggttccttgagtttttgaaaactaccattcagaatgagacagtggccttctacctgaggccacagggttgtctgtggcctaactgatttctggccagtcaggctgggtgagcctcaacagcgtgaacatactaaaggcttcttccttgccctgggacaccggttctggccaggctacagggctcacagctcagacctgcctctgcctgggagtgacacggtcccctctgctcacgtgccatggatcagagctgccatgtggcccagcttagggagaccaagaagcatgggagactccccggctatttgacgagcaggacctgtccatgccatctcccatctgtgccctgcatctgcgacttccaaagagcattggcctgcactgtcctatgaaatgctaccacaagccctttctggcaagtgcagttaatcctgttcggtgggttaggaaaccaaggctctgagggaggctttcagtgccacagctgggaggtgagagttgtgagttgcagatgtctcagccatcccgagcgtgaccattctgagtggcgggaagcttttcactcagcactgagtacatgatgcctacagtgttctgggcctcctccatcaggaatcatgggcccttctccccaggacgctcatcgatggccccggctcctccagccctggctcctccagccctggctcctccagccctggcccctccttgggctgtggctgcaccctgggctccacccattccagacccaaaggcccatgggccaaccagacaccgcccctacatggtgtgcccacaggctcttatggatcccagagggccccctttgtcctgcttggggaggctggggtggccgctacacagtgccctgccgtggcccccatgctccccaactccctactgtgtctgctggacgtttgaacagcctcctgccctaaaccttgcatcctgccacctctggcccactctccaccctggcctactcttcaccctggcccactctccactctgcagccaagtgatcttttccagcagcacatgtgactgagtattgctgatggctgcgactgctttcaggatcaaattgtgtctcttccgaaagagacatcagataagagacattggaaaagaacatgaattgcggtcacccagagctctttcgcggtttgggattaagccatgcagaaaggtgtgcaggagcctagatcacctgccaacctgcctcttgccatcctctattttgtacgctcagtcaccccagaaaattgctccggcccttggatttacctccgtgtcactgtccatccggtaccctctgcctgggatgcctcctgggtctccatcacccgcctcactcgtttttcctctgcacatggcatctacttccgcccttccgcaggacaccttcccaggctgggtctggaccaccctgcggactcgctcctcgcaatactggccacatgccctcaagcccatctgtttcttagagtcgatgtcccctaaggtgtgagttcctggtgagcaggagaacctgtgccttttataacctggtgtgctgctcggcgtgccgaaggaaccaaggcgatgttgagaaatgaatggaacagctgtactgtgcagagatacgtgcagagaggggcaggaggaagcctccacttcagacttcagtgtgaaaaagagacactggaaaagaacatgaaatgtggttgcccgatgctcctttgtggtttgggatgaagccctgcagaaaggtccgggcagcactgcagccccgccatgctgcttgccccacgtgggttctggagtctggtggcacctggaagagcaggtggagtggaagctgctagaaggtgggaacctgagggtcctgggctggcagaggccttgcccccgctttgcctagggaggcagtgagcttcctccttcatttgaactttgccctgaagagctgggccttccttgttcatggggagcctgatgcttcttcccagcacaccacagccacacaggaggtgcagcagagcatgcggagatccacctggcaactcacagccagccgcggcgtcactgtcaggactctgtgaaaaacaaggtttctgtttggcgcggggacgaccagagggaaggagactggtagagcctaagtattcagccgaccattaaaaagtgaaagtcagaagcaatgtaagtcaaaactcaggacatctcagggtgaccttggccactcacagttgttcgtgtttgaaatcacattgattctcgcagctgtccaaggcgcaggaaataaccactctgggtgatgtcgttgggatggttttgtcagcactcaggatttgggggtttgttatgaaaatttcacgttacaaaaaagggagaagtgcagttttgtgtgtttagggttattggtggctagacatctgaaaatcaggatccccgctcattgattttttttttttttttgagatggagtcttgctctgttgcccaggctagagtgcagtggccaatcttggttcactgcaacctcggcctcccaagttcaagcgattctcctgcctcagcctcctgagtaactgggattacaggcgcctgccccccgcctggctaatttttgtatttttagtagagacagggttttaacatgttagccaggctggtaactcctgacctcaggtgatcagcctacctcggcctcccaaagtgctgggattacaggcggtgccgctccttacattttgttgctgttcccaggaagattgatggagggaaaacacactctccacagaggagatcctgtgtttacagccgtcttagatagagtcgtgatgaggaggaggactctgggccgacagtgtatgagggttccgcctcataaggctgtttggtgtttgtgcccacactgggtgtgacgggttgaagcagtggataacaagcctattactgttatgcaaatgtgggcggcccagttgcattcttcatgcatgtgtctctccctaatgagtttcaaaatcttaatttagatcttgattttgttgcagataggattccaatttaaagagcgtttgtcattcagagactgtggtagacaggaaaatggtcttcagagatatccacaccctagctgtggcgcctgtaaatctgttactttatgtgacagaaaggactttgcagatctgattaagttatggatcttgagatggagagattattctggattattcaggtgggcccttataatcatggtgacccttataagaaggaagctggaggagttaattgtcagaggagaaggtgctgtgacgatggaagtggagattgaagtgatgcactttgaagatggaggaagcggctgcaagccaaggaatgcaggtggcttctagaagccagaaaaggcaaggaaacagattcttgcctagagcctccgtaaagaaccaggccagtcgacaccatgaccttagcccaaggagacctgcgtgggattcctttctttttattttctttcttttcttttcttttttttgagacaggatcttgctctgtcatccaggctggagtgcagtggcgccatctcagctcactgcaacctccacctcttaggttcaagccattttcgtgcctcaaccacccatgtagctgggatacaggcacatgccaccatgtctggctaatttttgcatttttttgtaaagataaggtcttgctatattgcctaggctgttcttgaactcctgggctcaagggatccacctgcctcagcctcgccaagtgctgggattataggcgtgagccactgcactcagccctctgtgggatttctgaactatagaactgtaagagagcaagttggtgttgtctgaagtcactagatttatggtgacttgtcacagcagccataggaagctaacacagagactcagggaccaagcctttccattgcagcaagattgatcagttgttctctcccatcacggggctctcattttgctcaagtcctatgtcatcgtccctcttttcctggagagcaggagctgacttcagacgccagatcttcttttcctgccacagcgcacttgcagctcttgggaggtgaaggttctgcctgctgctcttctggaatgataaacgctgggcccttagtggaaatgtcaggtgaaatggaaggcagctccttgggtgcagtgacaggacctgcagtgggcctgttggagctggcactgagggctgctccccatccctctgtgggtgtattggctgcatgctgactggccgtcctcgtgggcgtggcctggtgtgtgtgcaggtggacagaggctggagtatccttgagaggctgtgcgttctctcggcttcttttggagccagagccatcagggagccatcacctgtcctggcctgacctgtcctgtcatgagtgctgtgttccttgagctgcctctcaggctaggggatgaggtggctgtgctcaggcctggcttctgcaggcttcttcctatctttggagcggctccaccactggaatctgtgacatgagaggcccgtagcccaggcccatcatctagaatggagaggcagccccacagcctcctgggaaccagagctccttgcctgggtcatcacagaactaagccttaaaatcaggaggcctcagcaaagcgcctctagagactcaaaccaccttgtaaatctcactgggagtgaacgattgactttttactcagtaccaggactacatactacctcatttatgggtttttcctctaaattgctaatgtttgaagtggaaattttcaaaactgactaatgtctctgcttcaagatttgctgtcaggcaacttatttataaataaagcagcttttcaaggagcactaacaaacaatccctcgtgttaggagactcagagccaagtcgtggctctaggttggccttgcagggtgttagggagccagttctccaccccagggccatggacttctgggtccttgcaccatccagagaggtgatgatgtggttattcccatgtatagagtctactgttttcagggggcatttgcatctgtggtttcattagatgttcagagcatccccacaggggttagttcatgtagagaaggaatcagaggctcacagaggttcagggtttgctgggtcaccagctcctaagaggggccctttgggctgaggccacggcgctttctttcttgcaagacagaaattttccttttcctttctttgccataatggccacctccttccaccccatatccttcttccctttggccactggtgagttctgattatttttggaaaaaaaaaaaaattaaaactctgggagcttgagactgaggtaaagtcccctttcgtagagatttttggactgacatgttagctctctgccctgtgtaacttcagagtttggtaggtgatggggacacgcctgttggagagtcctggtgtgtccagttttgtccccgcagcttcactggctgtcagagccacagcctttgcttacggctacgccctggaatatttaacagcaatttcttttcgctttcttctgtcgtgttctgtctgtgtcagtgttttgtggtcttactgtacctgttgttttattataggcagatactgtaaacgctgatacagtctgtgccctgcggttgtggtttttagggccttgcggcggcatctttgctagtgctcactgcaaataggggcaggaagcagttgtttgggaatgagccacatggtggaatatcttgaatgtcccaggccaggcacagagcagctgctcagtaaatgttgctgagtgagaggctggggggttggtgaggataggcaggggtgggcgtccaaggctgcagagttgtaaagcggggggtggggcagccagcaagtccagctcgaggaaacaccacggggttcaggggctctgtgtaagaaatggcagaggtttggcttcgcttttagttgttttgtttcttgttcaagtgaggagaacacaccgagaagggaggagagcaaggctggctgagcgtcatggcagggtggtaaaggaatcaatcacccggacaggttgtccgttcatgtgccgttgtttgcattgctgtgatacagactgctgtgccactgaaaccttccgaaaagcaagccacccagagagtgacttgggcaggtgtgtattcatgtgtgcatcagggagaggaatacttgcaaggagcagagcttccagaagaccaagattcagtggaggcagcaagtcagggccgggcagaagcccctggggtatctgcggaagagcactttccagggtgcatggatggatgcgttaaccagccagttcctacgcatcacggaggagaggtgcctgccctcctgggagccgtgcctattccattgcttctgttgtttttttgagacagggtctcactctgtcacccaggctggagtgcagtggcacgatttcagctcactgcagcctctgcctcccaggctcaagcgatcctcccacctcagcctcccaattagatgggacttcaggtgagcaccaccatgcctggctaatttttaaatgttttgtagaaacggggtctcactgtattgcccagactgttctcgaactcctgggctcaagtgatcctcatgcctccacctcccaaagtgctgggatttcaggcgtgagttaccacacccggcctcttgttgttgttagtaaacttttaattctagaacagctttaaagttataaaaaagttgcaaagactgcagagaattcccatgcttgcttcctccagtcttctctctcgttaacatcttacatcacacggtgcatttggcataactgaggaaccaacgtgggtccattgctatgaactaaactctgcagtttattccaatttccttagtttttgcttaatgttttttttctgtcccaggagcctgtccaggccactacgttacctatagtccttgcgtctccttagcctcctctggtctgtgacagtttttcagctttccttgtttttaatgaccttgatagttttcaagagtacaggtctttgtgaatatccttcgatttgggtttatctgctgttcttctcatggttagactggagttatgggtttgggggaggaaaaccacagaagcgaagcaccattttcaacatacatcaatgttgcatgatatcaatatgactcataactatcgatgttgaccccgatcagctggctgaggtagcatgtgccagttgctcactgtaagattaccccaccttcagcggggtgcggtggctcatgcctgtaatcccagcactttgggaggccgagtgggtggatcatgaggtcaggagatcgagaccatcttggctaacatggtgaaaccccgtctctattaaaaatacaaaaaattagccaggcgtggtggtgggcacctgtagtcccagctacttgggagactgaggcaggagaatggcgtgaacccaggaggcagagcttgcagtgagctgagatcacgccactgcactccaccctaggcgacagagtgagattctgtctcaaaaaaaaaaaaagaaagcaaaaaaagattaccccaccttctttccatagtcctccctggaaggaggtcgatgtgcagagcccatgcttaaggaatgtggagttacactccactccttcatggggggtggggatatctgtataaattatttggaatatttctgtatgggggacttatctattctcccccatttatttattcaaacatttacatcaatatggatttgtggatatataatttataccttgctttataatccagtgctgtgttatttattttattgctcaaactgtcccagctttgactatatgaagctctttcaggtggcatcccatgtcccttagagagatccctacctttttgtttttttgagtacagtcagttggccatatccgtgagttctgcatctgtggattcaaccaaccttagatgggaaatatctgggagaaaaatagatggttgcatctctactgaacagactttttgtcttgtcatcattccttaaacaatacagtataacaacgatttatatagcatttacattgtactaggtattataaataatctagaaaggatttaaaatatattgaagaatgtgcataggttatatgcagattctacaccattttatagaagggacttgagcattgaggattatggtatctacaggggggcctagataaccaatcccttacagatacccaaagaaaactgtacctctttctggcacaagatactcaggctcatcttgaatttttcctacccagtcctggactcagctatttctgcaaggatccctgccttattttattgaagaatggtatctagaaaccaaggtctggagacagggttcttcttgtcaccgaggtacattgcttccaggccctctcagcagacagagctaggaaatatgcatgtatgctaatctgtgtatacatatgtatctcccatagtttttttttatttttttattttttgagacaaagccttgctctgttgccaggctggagtgcagtggcacgatctccactcactgcaacctccgcctcccaaattcaagcaactttcccgcctcagcctccctagtagctgggactacaggcgtgtgccaccacacccagctaatttttgtacttttagtagacagagtttcaccatgttggccaggatggtcttgatctcttgacctcatgatccatccgccttggcctcccaaagtgctgggattacaggcgtgagcccactgcactcagccttttttttttttttttttttttttttaagacagagtctccctctgttgctcaagctggagtgaatggcacaatcttgtctcactgtaatctccacctcatgggttcaagggattctcttgcctcagcctcctgagtagctgggattataggcatgcaccaccacgcctggctaatttttgtgtcccatagcttttttttgaatgcacgaccccatctggcggcgaagccctggacctagccttctgatcactcatgggaaccatgaccacgtgtcacatagtagaaaggaaaacttggacaacttactgtgtagacaggagcagcaacaacaaaaaagacttggaaggcttaaagaatattttccaagtatacacaaatacagagaataataagaggaatgactttgagagcctgaggcaggaggattgcttgagcccaggagttcaagaacagtctgggtagcatagagtgaccttgtctctacaaaaaaattaaaaaaaaaagccaggtgtggtgacgcgcaccagtggtcccacctccgtgggaggcagaggcaagaggatcacttgagcctgggaagttgaggctgcagtgagccatgattataccactgcattccatcctggctaacagaccaagactctgtttaagaaaaaaggagtatctggggtacctgctatccagtttaagacatgtacaaatatgattcagccttccatgagcatgcctccccagccacccctgtgaaacccagtaaattgaatttactgtttgttttttggaggcatgttttatttttacactgcatgtatgcctaaatgatatatcccattgttatgatattttcaaactttgtagaaatgataccttactgtgttcctacaacttgaattttcattaactgagacattttacatgtatttatcttcttagcaatcctgagaaaagcaagagtcactatctccattgtatagatagagaaactgataatgtagagcaatgatgtgatttttgctaatttcaagcagctaatggagatcgactcacatttgtaccttcagagccctagtccatgctctttgtatgacataaatgtcaagattcatcaggaaaaggaagaacaggcgggtcttgttggttactctgtgaccctgttgcttccctgggacctggaagtcctggtgtctcccttagcctggaatcccagtctccatctgggttttgcaggctccaggagttttgatgaaatgaggacccatatggctggttgagactcccaccccctcatcactccctaccagcgtttgtgcagaatcctcctctcctcccgagttggaaataatgtatagttggctcaaaagtcagcccctccttattttagcaccagatgctgcctctcagcttcacgctgccctccagcagcattgcctgtggtccatgggatcttggccttcacactcagcattgaaacagctgccttccgctcccatcataggaaagagaacagaagtctcttgctcccactccccccgccccaccccctgctgctggcctatttctgtgctttgttttgctgtagaacttctggaaagagttgtctgcagtggctttctccatttcctcccttcccgttctctcttatacccgctccagtcggacttttgccccttccacagacacctctcctgacacttttgaccccatcacttagagatcaagatctgtaagactccaagtctccagatccagtggtcagctctcggtcccttcccatgtgactgaccagcagtgtttgccacagtcgtcccctctaggaaacaccttcttcccttggcttgtggggcactctgtgcttgggattttcttcctgcttcactggactttgctcagtccccttactgacccgtgagtgtcagagtgtccctgcggtcagtccatgcccctcttctccgctcggtccacactcccaccatggttgacctcattccgacttgtggcacaaggagctcacatttatcttttagctctgatttctcttctgacctccagactgtacaccctgttgctcacccagcgctttcccttagagttctaattgacgtccccacacaacaggcaccaagctgtccctggccatctcaaccccaatctccacatctcagtaaatggcagctccatgcttccggacacctagaccatagacttggagccaaccttgactcctgtctctcttaaaccccacatggaatctgttccgtaagctgcccatggtcacaccggcaccgctgccgtgcgatgagagcctgtcatctccttgctagattgctgtgccagtttcctgatggttcctgtttccacactgactgcataccttcccacccaagtctgtgtctgctcagcagctggtttattgcatacaaacttaaatgagaatgctcctccgaccagagctctccgttccctggccatcccattaagagtaaatgctggaagcccctcctcaactgactttatttcttaaaactctatcctgcaaaatcctgcctggctaataactttatcaccttcttcgtgttggttccaacgttcccttctgcaggtggcttctgcggactttggtactggcccacatccctgagctggtaaccccccaccatgcacaggcacccccacattaattctgtagcttatttgtttattgttgtctgtgccactccagacaggaagcctgtgggggttgggggcttggtctgccttcttcagccctgggctcacagtcctgacatcttcttgaagacggcgctcacggtcaggctgcagcaaattcacagttgacatctaggagtgagggcctcctgccatgctgcactctggcctctcacctgcctcctgctagtcctgggcacacctggaggacaatcagggaatttctttccccatctgctttggcatcctccaaacctgggaacctttctaacacctgactgcttggtgaccatgtgtgtgctctgtggatttctgtccaggagggtccctcactctggccctcagggccatgtgcatgtggacaccgactggtagggttggtttcctatgcagagagcagggccagaggcatagccggcccacccccagccccattgctcacggttcacccagtcccctggcctttccgacgctgtgcgcatctgtatttgttgcagtgaacagagcctagaattataggactttgtcagacagtttgattttcaaccccgtaaaaaatacattttacttaaccacctaggatacctctacattatagacctcaagcagaagtttcaggagacagtttcttactctcattagaggtgatgcgttttgtgtggtcttcggtttcattgccccataaactcacttggcgatctgcctgtgggtccccagcagtctgtaagccacagctttctcaaccgtacttcctgttctggaggagaaacctgagctgcaaagagctaagggtcttgctaaggtcataccagtgaattcaccaaacagccagtactggaaccctgtcctctgattcccatcctgtggcttttttaggcttgtgtaatcaattttaatgattgtaccattgtagcttatttaaattaccccaggaggaacatcagctctgttcaagaaatgttattgtagttgctcacctgctttgttcagggaaatgcatcttttgtgggatttcttctgagtaattaagagggtctaagaagccagttttatagtcatttatttaactgtagagaacaatgaagttaaacacaaaagctggttccatctgcaggaacatatgagtgatttgcattagaaagggtgttcatcaaagctcctcccaggtgcctagggaggcatggggggccttggtgggttccctgagggtcgggccaaggccttgggccagggagcacagttccattgcactgggtgtgttggggcagaaccttgtgcttggaggtaggtgttgcttctggccctcggttgcttgctcctgcaggcagggccgtggacccgtagctcagcaaccatggaggagctgtgagaaatgcacagtctcaggccccaccctggctctgctgacttggaacctgcatgttaacgagactgggggtttgtatgcacatcacatccggtccagctctggcctgaggactccggtctgtggtttctagtttttatcatccagctggtcatcctcagcagtagagaatgtggttggttaccatgtgcagggcagcctgctatgtgctgtggtaacagaagggtggggcagagccctcctagccctcccagccctctggggcttgctgtctctagggcaggcaggggctggcatatgcagttgtacaccatggtgttttacaaagcacgagtgccatggaccccatgggtgggctggattgagatgcaaggagggaaaacagatggggtggggtcccaagcaggaggaactgcatgaggaaaggcgtggaggctggacagatgcagaggcagtcagggaatagccagtgtcagaatggagcaggcgacagccgggttttggaggctttcagtcccacgtttagatatttggactttatccagtgggtcatggaagctactataaactttttaaaattaaatactattttatttaaaaaattgtgtaaaatacacataacataggattcaccttctggaaccatgtttaagtgtagagctcagtcgcattaagtacatttacacggttgtgcaaccatcaccccatccacctccagagctctcctcaccctgcaaaactgaaactctgtccccattaaacacttaactcccattcctcctcccctcaccccctggcacccaccattgtactttctgtctatgattttgacgacttcaggtgcctcgtatgagagcaattgtataggatttatattttgtgactggcatatttcactctcaacgtcctcacggtgcacacacgtcgtagtgtagcacgtgtcacagtctccttgtctgttaaggtcgaggaatacttccttgtatgaatagaccacattttgttgatcgttcatctggtgaaggatgcttgggttgcttttacctcttggctgttgtgaatcatgctgctgtgaacatgggggtacaatctctttgagctcttgttttctttttctttttttttctttttcttttgagatggagtctcgttctgtcacccaggctggagtgcagtggtgcaatctcagctcactgcaagctccgcctcccgggttcacgccattctcctgcctcagcctcccgagtagctgggactacaggcgcccgccaccgtgcctggctaatttttttaagtatttttagtagagacggggtttcactgtgttagccacgatggtctcaatctcctgacctcgtgatccgcccgcctcggcctcccaaagtgctgggattgattacaggcgtgagctactgcgcccggcctgagctcttgttttcacttccttcgggcatacccccagaagtggagtcattcctagatcatatggtgattctatttttaatgttttaaggatagcattttccaaaggggctgcacaccattttacattcctacccaccgtgtacaagggttccagttttctccacatcctcaccaacacttgttattttctggtttttcaatcgtggccaccctgatgggagtggggtagcagctctctgtggtttggatggcgttttcctgatgcacgatggtgtggagcacctctcctgtgtgggagcactgtggcctggtgagcaggggctctgtggtggggaggcgcgtgccgagggctgtaggagagggcgacgggtggtgctgtgcatcaggttcggggtgatgggaacgctgtctcttgcacctgcacatcaggcctcccccatgctactttggtggcttctgtgggagcacaatatgtccagggtgccatccccaaggcagaagggagcaccatctggtttgatgtgtggcctgtacttcaccaagcccaccacatttggcctatgactgtgtcctgctgcgactgggttgaagtcagaggagccgagacaggcgggggagcatttggaggacgtgtcccttgctgtggtgtctttgcagaagtggccagcacttgcactgcccagtagtattttcgatgctcctgggaacatgagaggattgcactctctgctttctcaaagttagataagaccatgtgccttgcttcagccaatgacatgtaagcagaagtgacttgtgggtagaagctggaagggactttctatgctgtcctttctccagtcacatcggtcctagaagcacatgcctaggaggaggggccataatagcaacgtggctgttatttgctttggactcacagtggactttgagtgagcaagacagaaaccattactgggcccaggccctgtggcgtgggagctgtttgttgtcacagcacagcctagcctgtcctcactgatccaggaggaacctgaaaagtattttaagtgcacagataggtgaagatgaaagtgtagcgttttgggataattctgcatgcttcttagtatctccagcagtttcgagatttggcgaaggggctgaacttttctgtaggtaaatctcttgctgaagagttcattatcagctggtaatggcttcattttgtcagcggcacagagctctggcttgtgcgtgtctgaggcctgtccccactggggcagggaggtaatgagaactcatgaaccctgcatctctgcctggctttaacagcctctgtgttttccagtgcttatcaaatccagagctgtttacatttcaggagacaacttcagactctgtggacctcattatacttccaaagcaggagggtcgttgtttttaagcattattcccaacttttttttttttgactgcagaaatgcctttttaatatcagaaaatttccaagttttccttacttggctatagtcttgtttttagtactgctttggtggttcagtaactattcattaaacaaatctcttcattttaagtttatttcttctatagggctcttctcttctcttctgttctcttctcttctttttgatacagaatctccctctgtcgccaggctggagtgcagtggtgcgaccttggttcactgcaacctccacctcctgggttaaagctattctcctgcctcagtctcccgagtagctgggactgcaggtgcatgccgccatgcccagctaatttttgtatttttagtggagacggggtttcaccatgttggccaggacggtcttgatctcttgacctcatgatccacctgcctcggcctcccaaagtgctgggattacaggcatgagcctccgcattcaaatatatgtaaaaacggagagaattgtgatccctgaaaattcatgtgttgaaatcttcacccccaggacctcagaatgtgactgtatttggagagagggtctttgaagaggtaactgagttaaaatgatatcatcaaggtagcttaatccaatctgactgatgttcttgtaagaagagattcagacacagacaggcacagacggatggccgtgtacatacatggcggaagacagccgtatgtgagccaaggagcgaggcctcctgagaaaccagccctgctgacaccataatctcgacttccagtcgccagaactggaagaaaatacatttctgttggttaagtcccctagcctgtggtactttgtgatagcattcctagaaaactaatacagtgcctgtgtgctattgttcagtgtcagcagttccagtttttaagcaatcttcatggactgctcccgaagttcagggagcatggggcctatagcagagaactaggcagcacctgcccttgtgaaactgacactctacggaaactggaaaaattcatgaggacaagcttcagttaacaacactttgaggctgggtgtgggagcttgagcctgtaatcccagcacttcgggaggccgaggcaggtggatcacttgaacccaggaatttgagagcagcctgggcaacatggtgaaacgccatctctactaaaaatacaaacaattagctgggcctggtggcagttgcctgtggtcccagctacttgggaggctgaggtgggaggattgcttgagcccaggaggcggaggttacagtgagctgagattgcaccactgcacttcagtcagcccaggtgacagagtgagaccttgtttcaaaaaaaaaaaaaaaaaaaagacactttgagactgggcgaagtggctcgtgcctgtaatcccagcagttcaggaagcagaggcaggagtactgcttgaggccaggagttcaaaaccagcctgagcaacacagcaagacccctgtctccacaaaaaatatattaaaattagctgggtgtggtggtggatgcctgtagtcccagctacttagaggctgaggcaggaggattgcctgagcctgagaggttgaggctgcagtaagctatgatcatgccactgtattccagtctgggtgataaagcaagaccttgtctcaaaaaaaaaaaaaagagcactttgaattctcataatcataatcatatgacatctgtctaccttagaaaccctcgctggtgggtggtcacacataatgctggtggtctgcggggggcagatggactctcacaccctcctaggttcccctttaggaactgaggcttcaggtatgggaagggtttgtggaataaatggatgaaaatggaatgagaagctttgcccacgtcagagccaacctatcatgtggaccaggattcagaccacccctgggagaggaaccaggatgcacccatcattctttttttttttttttttgagacggagtgtcacactgtcacccaggctggagtgcagtggtgtgatctcggctcgccgcaacctccgcctcccaggttcaaatgattctcctgcctcagcctcccgagtagctgggattacaggcgtgcaccaccatgcctggctaattttgtatttttagtagagacagggtttctccatgttggtcaggctggtctcgaactcccgacctcaggtgattcacctgcctcagcctcccagagtgctgggattacaggcgtgagccaccgcacctagccgacacccatcattcttacacagtgaagacccagggagatgatgagtcacaccgggaagtgattcatttgcttactgttaagttcatccaggattcctttaaataccaaatccccatatacgcttaaaaatacctagttcactcagaaacagtgtgctgactgacggaagccagacatgaaagactatgtggtgcaattccatgtataggacgtttctagaaagggcctaatgacagagatggaaagcagatgagggcctgcttgggtctggggcgtcagtggggattggctgcaggcagccatgaggagccttcagggtgatgagggttctaaaagtgcgtcgtgtgcctgagccactgcgacattcactagaagtcctccgtgctgacggagggtgaactgtgtggggcccaagttctatctcaggaaagccagggaagccactcagttcagctttgtgaaaatcaagggagtcttcttggaggaagtggactctgagctggatgtgaatgacggagtgtctttggtaaggagagacagctgcaggggactcctggtggaggaacaggatcccgggggagcggccgggcgggtgactgaggcgccaatggaaggagaagcctgtcacaggtgagggcattgaagggaactgcagggacacccagcgcttctcaactctgactgcagatttccagctgccatttctaaaggacaggtgcctgggctccactcctggaggtttggatttaatcagtctcgggtatagatcccggacgttagtatttttaagcatatttttaaatgaagtgatactctaattctatcattttctttttacttctcagcttgttgcttctctaaagagatacctccctttatccattttgtggtcacccagtgggacagttgagagagaaaaggccgggtggcatgtgattcttctacttcatttaccagttttgaagatgatgaatttgtttcccatgaccttccaaaggtggttttttaaaatttattttaatctatcgtcgtgaactcctggggcgtgaacgtgtgtcataggtttcaaaccactgcaatcattatcctcattgaggttcattgtggctggtggtagtgtcttcatattggcctctgagaccttctgacctgattctagttatctttgataatttccttgtctttaaaaaattataattgtatatattttttaataataaagatgggtttcggctgggcgcggtggctcacgcctgtaatcccagcactttgggatgcagaggtgggcagttcacgaggtcaggagattgagaccatcctggccaacatggtgaaaccccatctctactaaaaatacaaaattaactgggcatggtggcgggcgcctgtagtcccagctactcaggaggctgaggcaggggaatcgcttgaacccaggaggcggaggttacagtgagcagagatcgcgccactgcactccagcctggcgacagtgagactccgtctcaaaaaataataataatagtaataataataataaagacagattttgccatgttgcccaggcttgtctcgaactcctgggctcaagccatctgcccacctctgcctcccaaaatgctgggattacagtgtgagccaccatggcccagcctaacttccttgccttttaagagtaaagcagttttatttcccattgctcttccactagctttaagtatgtgttaatttattattttaggttgtcctagaggttatgatctgcagactcattagatgctagtgatgctggtcttctttaaattggtactttaaccgcttcctggacaaggcagggactttgcatacagatatatcagtatggtgtggaagacagctacactcaccattataccacctgcacagatatcagtatgttttgaaagttgcctggagaccttggtggcaatccagggctgaaaactctgggtggggcactaggtgggtggcaggtgcactggggactgaatgggatgctgtggcagagaggaccagacctaaagcctttagtgaagaaggcctggtgtgaattttttagctggttatcaggttcatattttaaagaatatttttctaattacgtttgtttgtttggtctggcctgatgtgggacgtggtattttcagtgtataggtcttcctagagttgggaaggagggatgcccttctgttggagatgtttctgttaactcaggtgctttaggaatggaaaggaaagtcatgcagctcaggcccggcaggggcattgttgaagatcctcagccagtgaggcgccttccctgtgcccagcacattgctgaggaccttgcctgaaagatgtcctttcatcctccccacccacctgaaagatgagaagtggaggactgatgagaaccttccagatgggttctccaagccacacagctaacaggtgccagagtcggaatttgaactcagctgtgacttacttctgttaccagcagaagtgggtgagaaagccggccacagtccactaaacacgggctatgaccaaggtctctttgacaacataatccaacaaataggcttgttttagaatataaatctcaaggaatttggggggagttgatatactcttgttttttactttttattttgaaatatttttagattcacaggaggttgcaaagaaatattcaagaagatcctgaacactcttcacttagccccgcttcaatgttaacattatgcataacgatagtacaatagtcaaaccaggaaactgacagtgatgtagtcaacagaaactagtcagactccagtagttataatgtatgtatgtgtgtgtgtatgtgtgtgattctgtccaattgcatgtgcaacttcatgtaaccaccaccacaatcaagatatttaattgtatcatcagcaaaggactgcctcatgctaccccattgtagccacatgcacagtccctcttccatcattcctaacctatggcaaccactggaggacatttggagtttccagtttggggctgttatgaacccagatctgctatatgaacattcacttacaagtttctatgtgaaaacaagtttttattcctctatgatcaattatctacaattgctggattgcatggtaaattcatttttacttttaaaggagttgccaaactattttccagagtggctgtaccattttatattcccattagcaatgtatggatgattcagtttctccacatccttgccagcatttggtgttatcactgttttttattttagctattctcataggtgtgtagtgatatctagttgtggtttagattgcatttttctgatgcctaataatgttggggatcttttcatatgattatttgccatctgtgtatcttcacgggtgaaatatctgttcatcacttttgctcattttttttttttttttgagacgaagtcttgctcttgtcttccaggctgtagtgcagtggcacgaacttggctcactgcaacctccgcctcctagattcaagtgattctcctgcctcagcctcccgagtagctgggattacaggcgcctgccaccacgcctggctaatttttgtatttttagtagagatggggtttcaccatgttggccaggctggtcttgaactcctgacctcaggtgatcagcccacctcggcctccgaaagtgctgggattacaggcatgagccaccgcacctggcccacttttgctcattttctaattagattttttttttaattgttgagttttaagggctgtttatatattctagatacaagtcctttgttaggtacgtgatttgcaaataatttctcccagagtataatttttttttctgttatcttaacttgacccttgacagaatgaaagtttttaattttgaggaggtcaaagttttatcaaattttttccttttatggatattgtgtttggtgtatgtctaggaactctttgcctaatcattaaggtcccaaagctctttcctttgattttttttttctacatgtcttatagttttatatttaagtccttgattcattttgcgttagtttttgtataaggtatgaaatttatgtcaaatttcttttttctttttttgcctatagatgtgcaaatactccagcgccattaattgaaaaggctgtccctccttcatggaattacttttgctccttgtgacaaatcagttgggcatatttgtagggatcatttttcctgggctctctactccattccatttgatctctgtgtctctccctttgcctatatcacactgtcttgattactatatctctgtaggaagccttaatatcaggcagggtgatttccccaattttattctcctttttcaaagttatttggctattctcaggcttttctctttctaataaattttagaataagtttgtttgcatctacaaaataccttacaaagtttgacaggacttttgttaagcctgtcagtcaatttaggcagaatcgaccttttaactatgttgagcgttccagtccatgagtatgtctcttcagtatttaggtctttgatttccttccttgtcattttgtaatttttattttatatagatcctgtacatattttgttagatatattcataagtatcttcttgttatctttagagcaactttaaatggtgttgcatttaacagtcttgatttccacttctttgttattagtgtatagacatgcaatcagtttttgaatgttgatcttgtaccctgaaaccttactgaactatatgttttcctctcagcactgtctgagctgcatcctaccaacttggtatgtcgtgttgtcattttagtgcagttctatatagtttaaaatttcccttgagatttcccctttgacctatggattagttagaagtgtgttggttaatttccaagtatttggagattttcctgtagtttttttgtcattgatttctagttggagtccattttggtcaacatattctgcatgattttaatttttttgaatttattaaggcttttttttgtgacccaggatatggtctatctgagtgtatgttccatggacaattgaaaagaatgtgtattctgcagtttttgggttgaattttctataaatgtcaatttgatctttttgttggatggtgttgcacacttctgtatctttgctgatcttctgtccagtagttgtgtcagttgctcagagtgggtactgacatccccaaatattattgtgaatttgtcgatttttctcttggcaagatttgtttttgctgtatgtgttttgtggtctggggggtacgcatttagaatttctgtatgttcttggtaggctgggcattttattattatgtaatattattccttgtctttatttagtttctttactctgaagtctgcctggatattaatatagccacttttgctttctcatgattagtgttggcatgacatgtcttttcccatcctttactttcagtctacccatgttgttatgtttgaaatgagtttcttgtaggtagcttgtaggttattttttaaatccattctgccaatgtctgttatttgatgtagttagaccatttatatttaaaatgattattgacttgctagggtttaagtctgcattttatgatttttttccttctctttctcattcctctgtttctttttccttgccttcctatggtgacaaacattttttagagtcccacatttccttatttatactgtgtttgaatgtacggctttggatagtgttctttatgattgctgtaaatattatgtcagcctactggtgtcagagttttaccactttggaccctttaccctcactactttttaaatataattgtcttaagtatttcctccgtatccactgagtaccttatcgtatgacataataacttttgcttcaacttaaagtatgattaaagaacctcatgaggtgaaggacagtctagtcttcttctgttagtctctttttctgtttgaagacatttctttagcccttctttaaaggttggtctgctagtaataaattctttagcttctcttctcctgagaatatcttaatttctccttcatttcttttttttgatagcaaatttattgagtcataattcacataccatgtaactcatacctttaaactgtacaattcagtggtttttagtgtattcacagagttttgaatcataaccacaatctaatgtaataaaattgtaagtctggctttttgcatgtgatagaggggagaaggaaaagcagtctatatcatcttgctctggaactagaagttgatagtcttttcaagtgttttataaatttcaggttcctctctccatccctttatttttatttatttatttattttgagatggagtctcgctctgtcacctaggctggagtgcagtggcacgatcttggcccactgcaagctccgcctcccgggttcacaccattctcctgcctcagcctcccaagtagctgggactacagacacctgccaccacgcccggctaattttttgtatttttagtagagatggggtttcaccgtgttagccaggatggtctcgatctcctaacctcatgatccacccgcctcggcctcccaaagtgctaggattataggtgtgagcctccgcgcccggcccctttctttatttttaaaatgtattttaatttttagttcttaattgtggcaagagatacatacaaatgtatcatcttaagcattgtttaggtgtacaggtcagtgacgttaaggacattgacattgttgtccagctatcaccaccactcatctccagaatgatttcatcttcccaaaatttaacctctgcactcattaagcagtaattgtccattcccctcttttcacaccccctggcaaccaccattctactttctggctgtgaatttgactcttccaggtacctcacgtaagtggaatcctacaatatttttgtgcgtgactgacttctttcccttagcatagtgttctcgcaacgttgtagtaagtgtcagaattcccttgcctgtgaaggctgaataatactccaccgtatgtgtagaccacattttgtttatccattcatccatgatggacacttgggttgtttccacgttttggggactgtgaataatgttgctatgagcatgagtgtgcaaataatctcttggagatagaccctgcttttcattcttttgggtgtatactcagaagtgggattgctgaatgatgtggtaatttatgtttttaattttggggggaactgctatactatctgtccctgtcttttccttacaaacacgtgtggaagactttgaggcatttgacctgtggaacatctcccttcttattttggatgggtgcactcctggtgaagttcagcgtgtccctttgtcctctctctcctgcacattggcagctggatccagtacctttgctggacttggttccgtctctttcgcaggattagaggaagtgctctatgtctgttcacccatctttttgtgagcaggcagctgttgatgctcaatgcccctgttttgggtaaaattgtgtctccccaaaattcatttgttgaagtcttaagctccagcatctcagaacctgcccttatttggagaaatggtctttacagagcttatcaaagcaaaatgaggtcattagggcaggccctaatccagcatgcccagcgtacttccaagaagaggaaatgcggaagcagacacgtgcagagggaggatgggaagatgtggtgactccatataaacataaacacggctgtctcttgcccttcattcttgaacgctttgctggacaggaaatccttgagtgtcttaaataggctactctttttttttctggaggtaatcatggttgtcaaaaagtcttaagggtcagccacagtggctcacccctgtaatgccagcactctcggaagtcaaggcaggaggatcatcggagctcaggagttagagatcagtctgcgcaacatagggagaccctgtctacaaaaaccttacctttcatttctttttctttctttctttctttctttctttctttctttctttctttctttctttcttttttttattttttatttttgagacagtctctctctgccggccaggctggatccagtggcacaatctcggctcactgcaacctccgtctcgcgggctcaagcgattctcctgcctcagcctcacaagtagctgggattacatgcatgcaccaccaagcctggctaatttttgtgtttttagtagagatggggtttcacctataggccaggctggtctcgaactcctgacctcaggtaatctgcccaccttggcctcccaaagtgctgggattacaggtgtgagccactgcaccgggccttaacctttcatttcaaataaaaaggagataacctggaattctgtgtgggctctcagtgtaaagatagaaggacacacagagtgttttgaaacatgcccctccctgatcagcaggtgtcctgctgtgtcacatgtgactgtcagttcccgacccctcggccgagcagaaagggctttggcaaggtgtccggagttggaggtggcctctgggaggtttgctgcccgagggtcctgttgccgccaggactggtgaggagactgaggattgaaggggccaaaagctgacaaaattctgtgcgggggctgagtggcagattcgggtctgaatcatttcctggttcctggaatattcccacttaggtgccgaagccagaattggagggagcgtggcgcctactcatggagcctgccaaggcactgccagctgctcacaggccaggccgggcgggcagagcctcctcgctgcctgctggctttgaaattcatgtttgagacacacattccagccttcactgcttgttcaaggtgatacatgattttcagactggacagcttggcctcttgtctgttcttgtgttttcctttatgtaccaggataatgttaaacccttcccatgatgctgcaaaaaccaaatagtgcagcacacaccccacagcccgaaacaactgcaggtgcgtgtgccagtggttctgaaaggaatacagagacgtgtggtttccgaatccgctgattgttttattatatactgttacagatcatgttattctaaattacaaaataaaacttatgttaatatacatttatacaacgtatatattatacattatatagcatgtagtgatgtatgatgtaatgtatgatatgtactatataataatttataatatattataattattataataaaaatgactggccaggcaccgtggttcatgcttgtcatctcagccctttgggaggccgaggcaggagggttgcttgaggtcaggagtctgagaccagcctggggccacatagtgagaccctgtctttctaaaaaaaaaaaaaaaaatagtaatttgttattattcttcctattactatttttaagggacaattttggaaacatactttactttttctagtgtagcaaagaatttacattttgtcacctgaaagcgtcctggaaaatccatcctagtgtcttgtaattctaacagtcaccaggaaggctactttgagaaaatttcatatggtatgagggaaaacaagaacattctcatttttttttgtcttgctgaattaaaaaaaaaaaataaaagcaacaacaagaaaaaacaaagcccagggctggggttaagtaggtgaaggaggaaagggagtccccacctgccagtctcagtgccgctctttgccatgcacacacccgtatgtgtgcccatgtgtgtgcacacagacaccaccgggtccccttggagttaccaggcaaatgcatgtcatcagctgttgtgccttgatgtctcctaagctacatagaatcccctcagaccacgcctgacacccaggacaccagggcagtaatccgcacgcccatttcactctcaccatgtaaattgcgttttctattttcatttcattttatgtcacttttcttcaacaagtaattattctagggctttataagaacgctgtgctttcttagtctatttataatgagtaagaagttgtttttattctatttcttttctgtctgtgcttgccattttttttaatcacgattggataaggggggatccctgcaagataacagcgcccaccaaattagaatctccctgaaaaacatacagttaatcaggaggaaaatatagttgcccatagtccatgattatagcacaactaggggacaattaatgtagcaaacctctgtttccacccaagaccaggatacagggtttcagggccaggccagagccccgagccatcaggaccgggcacaggagagtgcagcagcggcctggtcccaccctcactcgggagataataagagacatctgaaatgtcactcaggaataaaagagagggtcttggaaagtgcatgggatgggagagtctgctcctgggagatgtttcctggaggtttggtgtgaaagggaagagaagaattagctgaaaataaggaacttagtaaaacaacaaatcatccacaaagaagagctcctctcaggggaggaggaggtggaagaagaggaaaatctctctccttaattaaaaaaactgtactttagagaagtaagagaagagtgcatggctgaaccatgttcctgagcaagccacacagacctctccctccctactgactctactcatcagcttttggggagtctaagtaaattaatataaacccaagcacacctagcgtccatacaatattactgtaagaaaaagaaatagaaaatgtgtagcaaaatgctggacatgaaaacagccaagaagcacaaatgaaatgtaagtaataggcaattgcaaatgtgaaaaaacaccatgagccagctcttcataaaataagactggaaatggataaacaacgggagatatgaaatgagagctaattaaggaaagcaaatgaagaaaagtctaagataatctctgaaattaatagtaaatgataaggttccccaaagggatagtagttacagctgaaagcacagtagggatagaaatgaaagaaatagaaaagatcaaaaccaaagtgtctgttggaaagacatccaatttacctgtaattggtgaccctgaagaactaaaacaaggcaatggaacagaactaaaaatttaaaactgcaagtcaagaaaactttcctaaaataaaattaagacccaaatctacatggaaatatagtccactgccattccgggaatggttgactcaagatttatgctctaggaagactaaattctaaagataaagagaatatcagcagggcctccaggcaaaaggaccaagttatttacaaaggaaatttacagagttgtttacaaagttacaagttatatgcaaagtctggtgtcagacttataacaacaacaaagaaagcaagacagcaatgcacaatacttttaagaaactcaaggaaagaaaacgtgagtgaaggattttatgcccagccaatggttctttaagtgattcagaaacaaaaatattgtgcccaccaggcacacttaaagaatcagctggcattagtgatatgtcagaggctggacggcagaaatggtctgccctggttgcaggcaatgaggagtttcatcatctgtcgataatttaaaaacaataataaaactgactgaaagtccgtctgctttttatgtcactgtgatccaacacttttaaacaatgtcagccaaaaaatactcctcctgaaaaaacctattgttggtctaatttctaagcaatttttcctattacaattgcattttaatgctatgtgtaaacctcaaattagcatatttgcattacttatgctttaataaacattatattctacatggcatttaatttggagaactcccaagtatacgatcagcccctgacatctgcagactgaggcacatgtgtttattttgagaggaagtttgtagcaatccagaatcatgcaaactccattgaggtccggactcctgtgaccctgtgtattcctctgtttggatagcagattaggaataaccagtgatatcacaataggtaaagacaaagaaacagaacttggatttcttcaattctgtcattctatgtgaacactagaggtttttattggtgtgtaaaatttgaagagtaagagcacagatgatgagattggatatttttgtttgattggtgcaacttgtagttgacacatgaaatattttactgaatatgagctgtaccattaggactgaaattcatcttttaaaattgtccatggtttttaaaattacagatccagttaaggaaatagtgattattactggttattatgtgataattactgaaaacactgttgtcacatagaggatgaaggtgttaaaaattagccacattatgtatgccacatagcaggggacaggcttcatccaatgaaaagatgatgtgggaaactttggcgaaggcactgatagtatttttacacttaaacaagtattttaaaatgtttaaaaaaaattgtatatgtatgaccgaaagaaaggtagggataagtatggaggaatggctataaatgttatatattctgacaaaatagaaataatgaataaaaataatagttggagtaggaagagcaaaagaggaacagagaatcagctcattgattgccctgcaggtaggaaagtggtaacattgtttggtatacaagaatgaccactgaaacaaaaatatagaccttaaatacccaaagaaatgcaaaaacaaaacaaaacaacttttaaagaagcaaacaaaccatatagtgaaatacacacggtcaatataacactaaagaatagaactgagaccaaacctagcagccgcatcagtaaattagagtggatttaacccatttattaaaaggcaagactgattttcagattggttcacatagtggcacccaactctatgctgtataaagaagtcatatccaaaacacagtgatccaggaaggctgaaaatgacaggagggtgtatagcaatgaagagagaaaaagagcttgggagttttaatcctgactgcagccaagctagtatcaggccaaaagcattaatggaaacaaagagggccgctgtcaatgctaaaggctgcaatttgcagagaagatacactaggtgtggttatgtctgcttcacataacatcaccagaacctctacgatgcggaaaccacaggggcggtggggagacatgagggacacgcagttccaggacattgtgactgccttgctcagcctgagacatgtgaaggggaccaaaacatacgcctccaaatgtaccagactttgtgctgtgataatagggaatacaactttgtttcgagactacttggaacacttaggaaagttgacatatattagcttacaaagacaacctcaatgagttccgtaacagaaataatacaaacaacattctgtgctcacaatgcaataaaactaaaaattaatcataagattaaaaaccaaaaaggcccttcaatttgaagagttacaagattaaactctattaaataagtttttaggtgaaaggaaatacacaaaccaagtgcataatttttgaatttgacgataattaaaatatatcactctgtggaatacacataaagctgtggttataacctcagaaatgaaaccaaacgaattaatggatttatcatctaactaaaaatgatagataaaaatagccaaataaacttagagtagaatgacaaaaaataagagtaagattggaaattcatgagttttaggaatgagaaaaaaatgaaactgataaatacacaaaatactacatcctagaaaaagaatcaagtggacaaacctctgtctaagctaatcatgaaggggagagagagagaccccaaacaacacagaataagaaatgacattaacagaacagagcatatttaaaaaaatcattaaaagcttactttgtatagtgctttgcaagtaagtgtgaagacctggatagaaagggaacttctttaggaaaatataatttattcagattgaccccagtagacacagaaagttttaaaaaaaaattcctactggaaaaaaattcaaatctatattttcacaggagaattctatcaaatcttcaaagaacagatatctcaatgctacttaaattattctagaacatagaaaaagaaaccttaagattattcaatgagaaaaccacacaccaatctcacttaggaatattgatgtaaaatgcctaagtaaaacagtattagagagaaccctttaaaaatggttttgagacaactggatagccatttggaaaaagataaaattttgtcgatatctttcatcatctacaagcatacatttcaaatgtctctaaataggtagttaccagaaaaactaccacaagaaaacatgggtaaattttaaaataacctgtgggtagggaaaattatgattcaaaatccaaaagcaatgtaaaaaagattgagaaatttggttgcattaggaaaaaaacaaaacaaaactgctttcgcatgatgggggagggacaccataagcaaagtgaaaaagccaggtaataaaccagtagaaaatatttgcatcttatatcacaaagctaattccttcaaaatatagattataacaagataccatttctcatgggccatattggcagagaggaaaaaactcaaaacaaaacaatacaagtttgatggcgccctctattggcgaggctgtggagcagccattcagattgctccacccctggaggaaacaggatgccttgggacttggtgcacctgcatagaccctgactcagccatgcctccttcctgaatttacctggaagacaatactccaaatccaaacatgctcatggcatatggagatcttaaattaataggtcctcttttatgtctttcaataaagtaacagatatgtttctatagaggtcttccatttttacattaaattgattcccaggtatgaaattttggctactgtcccagtggcagccctctggaaatgacctttgttgagtttgtgttttgacctggtatccagcaaccttgcttaacagtctgaagagcagcttggggcttttctctatggacagtatgtctcctgcatgtaatgacagttggctttcattcatccattgcaatcttcatcctttaatttctttttgttttcttacttctgtggttgggagtgacagaacagtgttaagcagaagcagttatactgcaaattcttgtcttattccttcttgtagggccatctctaatggtccaccatgaggtgtggagtttgctgtggacttgtggtagatcctcactttgttaaggaagtctccttctggtcctaatttgctaggagttttttctccctttaattgtgaatgcatgttgaactttatgaaatggtttttgggcatcaattgagatgatctgttaatgtgatgaattatgtgattgcgacaatagcttttctaatattacaccaagttgacatgcctgggataaacctgtatttcatcatgatatgtctcttaaaaattgctgggttcacttggctaatactttatttaggatgttttttcacctgtttataaatgagtttggcctataatttacctttcttattctgcctttcattggttttagtgtggagattatattagacccataacattcagcatctcatccttttctcttttggagagcaattaatataagactgaggtgatatgttcctcaatggtattgttaaaacttacctgtgacaccttctggttccagtgcattactagtggccagatttcaagtgactaattaaatttccttaacatttaaagtctattcacaatgaggaaataaaccttacctcatcagttggcttccttcaacactaccatttttcttctttcttgtgagtatgtgagccttagttcaggctgctataacaaaaatatcatagattagtttagagaacacacattcattcctcacagttctgaaggctgggaagtctaacgtcaaggggctggtgattcctggtgagggccctctgcttggtttgcagatggctgccttcttcctgtgctctcacatcggggagagagagagcatctctctcgtgacttttcttctcattcccattcatgagggcctaatttcttcccaaaggccccacattataatagcatcacattaaggattaggcttcaacctctgaatttgggaggagcacattcagcccttagcagaaccccacccccaagattttcctaagtgaatgaatagtcatcccccagccttgttcctggcctctaacagcattttagaaggaggtttctcatgactggggttggctgagatgggaatttcctgattccattggctgtgattcagccccatgccatcctgccagtaagatgaacacatgagtcatgctcagctgctagggtgcctggtgctgcttccagttcctctgggtgacctctgtccagcacataaacctcctgaagcattccgaatttgcggaaagtgagccaccctcccaatgtgtacatgtctgggcctaccttcctgctctcgtatgtgacaggcacacagcctttccagaaggtacctcattgcctagtacagaaatgctgaggttctcacaggagtgagaaccctactgactggctgttgtgtctctcccatacagtcgggtgtggagcagttggacccacatacctatctgcgcccatcctcagttgaaaggtagtgaacagcttgggctgtggactcaggcaggcctcggttcaaatcccagctctgccactcaggggctgtgtgtgcagataggctgcatctattgtccaaagccaaacatggggaaaaccaaacaatctctcaaaggggtgtggtgagggcttaggcaaaagactggtgtaccgtggctcggatggattagtttccattctccctctctctgtttccagctttcctctcactacaagatgagggccctgtccctcttgggcgtttgccaaaggaaggtctggacacccagcagctcattcatgtcgcttcccagtttgctgttaccatgttgcagtgcagaagccataagccgcatgatccgtgagcctggccctgcaacttggctcctccacacagcagcgtttgccttcattgtcacagatgactatgagaagatgcccttggtcatctttggtctgggctctggagttctgtagagctttgagccgccagagctaagggggtgaggcttgccccaggccggtggcacacccaggactgggcctggatgactttaatggtaggacagaaggaagagaaaggagctccccagagtccagctgctgggctgtgcagcccatttgcagtgtacttccaggagccttgatggtgaatgctgtaaaagggggaatctttcttccccacctttctttaaatcatagagctattgtgatggcttctgagctgcaatagaatcacccatgaggatttttgtttgttgtcttggcatgaagttcctgtcccttcacagtaatccggcaggtgcctcccagggcatggagtcattgtgtcacattcttctccaggactgcaggagggtgggcacagagttccacaacttgaaatgcagcagacagttgaaaggattctgctcacaccaggagttggattgtatttttccaaatgcattaagtattttaagcagcttgagctgcttaatgggcctgaaagcatttgattagtccaaagggctctatgcccggcaggtcaggggacaagaagttcttaaaatcctatgggtctgaccccttctgctctctctggctatctggctacaacgggtccccagggttgcagcaatagctgtgacctgcttatcttcccagaagtgctggaggcaagctgatccctgagcactgtgcctggagcactgcaggtgccctgcagccatctccatccacaccccctgcctggcctgccccgattccaggctgggcctcgggctcccctcccttcttcgtccccctcctcatctatctgtggctctttctctcgggccctaccaccaagccctctccttgccattctcttctgtccctcaagccgtattcctcagcatcacatggtcctcccgggtcccggtccactcctgtcatgtgagaacaaatggtgtctgctggaatttgcttcgggcctctgttgtgttttgagccaatgtgtgtggtcctcctaacgtcatttgattcatccggcaaaaggctctgctgcctgcctgtctggggcagagcttctaagaccctgtcagttttggacaatgaggcttccctgggggtgcagagtggtgaagctgtttggaatccttctcttgaggtggagtccagagtttcttcctgtcagttcctccccatttgtgtcagcagggtgctatgtccagcgcaggtcctcccctggcccctttctggccttgcagagtgcccccggccccgtgtgagcagatggccttctgggcggagcgtgcagtctcttggcagggcagccaagttgggggtgagatggacctagggctctctgaccccgtaggtttggcctaggctgagactctgagcaggtcacttacctctgggtcctcatgctcaggttcaaaatgagacagacagtggagttaagagatgatttttctgatccttctttgggtctttgcatcagttattttaaaaaaagagaaaagcaagccaacacaaccatcctcggctgattggtggagcagggcttacttatgtggctagttaaaagaaaatttatttttgaaagctgcatggagattttccgtaagcacagtaatgtgagccggggtcaaagctgtctttcagagacagggaagtgcagagatgttcaatgtaaattgtgccttttagctaaacacttggtagattcagcactggccgtgtaggtttgtcctgcttgttttgggggaaccagaaaagatctgattgaatttaatctgatttctgctagagtttggtcatgtaagatttgaaaaagtgaaccttcctgagccagagcaatcaggcaacaaagaaataaaaggcatccaaataagaaaagaagccaaactgtctgtcttcactgatgttatgattctatacatagaaaaccctaaagactttgccaaaaggctcctgtaactgataaacaacttcaataaagtttcaagatacaacatcaatgtagaaaagtcagtagcatttctctacaccaataatgttcaagctgagagccaaatcaggaacacaatcccatttacaatcgccacacacaaaaatacttaggactacagcgaaccaaggaggtgaaagaaatcagagatgacacaaacaaatggaaaaacattctatcctcatggattgaaagaatcaatattgttaaaatgaccatactgcccaaagcaattgacagattcagtgctcttcctatcaaactgccaaggccatttttcacagagctagaaaaaactattccaaaattaatatggaaccaaaacagagccagatagccaaagcaatctgagcaaaaagaaaagccagaggcaccaattaccaaacttcaaactatactacgaggctgcagtaaccaaaacagcatgggactgatacagaagcagacacacagagcagtggaaccgagtagagaacccagaaataaagccacacacctacaaccatctgccctttgacaaagctgccaaaaataagccatggggagaggactccctattcagtaaatggtgctgggatagctggctagccttatgcagaagaatgaaactggatccctaccttttaccatgtaaaaaatcaactcagttggattaaagattcaacctatgagaatcctagaagaaaacctagagaaacatcattctggatattggccttgggaaagaatttatgactaagtcctcaaaagcaattgcaacaaaaacaaaaatcaacaagtggaacctaattaactaaagagcttctgcacagcaaaagagtaaacagacaacctacagaatgggagaaaatacaaactatgcatccaacaaaagtctaatatcacaactctacaaggagcttaaacaattgaacaagcaagaaccaaataacctcgttaaaaattgggcaaaggacatgaacagacacttctcaaaagaaaacaggtaagaagccaacaagcatatgaaaaaatgctcaacatcactaatcatcagaagaatgcaaatcagtaccacagtgagataccatctcacatcagtcagaatggctatttttcaaaagcaaaaaaaataacagttgctggcaaggctctgaggaaaagggaactcttacacactattggtaggaatgtaaattattcagccaccttggaaagcagtttggagatttctcaaaggacttaaaacagaactacatttgacccagcaatcccattcctcagtatatttccaaaagaaaataaatcactctaccaaaaagacacatgcacttgtatgttcatcactgtggtattcacaagggcaaagacacataatcagtctaggtgcccatcagcagtggactagataaagaaattatggtacatatacaccatggaatactatggagccataaaaaagaacaaagtcatgtcctttacagcaacatagatgcagctggaggccattatcctaagcaaattaacacagaaacagaaaaccgaataccacatgttctcacttataagtgggagtcaaacattaggtactcataaagatggcaacagtagacaccaaggactactagagggcagagggtgacagcggggcaagggttgaaaactaactgttgggtactgtgcttgttacctggatgacgggattaatcataccccaaagcttagcatcacacaatatacccaggtaacaaacctgcacgtggactccctgaatgtaaaataaaggttgaaattagtcaaaaaataaggaaaagtgggccttccccgccccccacacttataaagagttaaggattttgtgtttattttaagccatgttgaactcagcccaacatattgacacaaggcaggacttagtgcagtgtcactaggctttaattttgttgccctttgggctaataaagtcaggttatctcactgggctgtttccttatccattaagacatttgatgtaactaagtacccatcctatggtgacataaactttttcttatgtcattggaaagtccagaatacctggttgcaggcaaggtttgatctagcagcttgaccttgttagcacaggtccagtttctttccctcagtcctccctggtattttatcagcttcatcctaaggctggttcagggaagatattctgatgatatatatttctgctttggcaatggaggatttatattcgattgtcagaagtcctcatgtcctatttaaagtctagtcattggaaaataggttgataaggatggacctgaagaaaataaagcagcaatttgtcatgacaaagcaagactaggaagaggcattggaccagcatgaccaattcaaggacacgttgatgatgtcttcagcgcaagtgttcttcccaagcttgggggacctggcagggctgcctacagggctggtgtccagcctgctctatagaaggcgaattagagatcgcaataacgggccagcttccatgatgaccccaggttgtagtgatgtctatgtagaaatgaaataaatgcataattaaaaccaaaggtaggcttgcatttgggttgaggtcctggcacctacggaggccacaagtgtgtcagggtggaaggtaacttggtgaaataggaagtcactgcctattgcccactcatgtccccactgatggagttagctgggggatcccctggtgcagaccctggagaggcatcactgtcttccttgttcagtgggcttgggtcacctgcatgaattctgaggttgggaaggtgtaaacatttccctcaacacctgcagcccagccgccgtctccctgggtgcttcagtcagccgtcacgttggggaggcgtcatgtaaggtggtccttgtctgagtagaacctgattttgaaaatgaaattcatttccttgccttcattttccagacgaaaagatatgtatttgtggtgtgtgtgtggcgggagagtaattggctttggttttgacaaggaggacaccagagtcctgttctgatactcagttttgggcccatgcgtgacaattctgtgtttcttttcagcatttgccaatacattattttctagagtctctcccagcatacggaaaaaccccaaattcaaatttgacttttctcttcgaggctggttgtggcatgctgaagctcccaaggcatgtaatgtagtgaacaaggtggcctccaggagcgctgtcggctcatgggccccacccacccacctcgcggtgtaggaggatccaccaagtcactgtcagagtgggttggagagacctggcctggggtcagctctgtgggcagatgggccctttcccccactgggtggagtacgctccttagtagcccaagacagaacattgccttctcccgagaaacccacctctggggaaggttaggccatgggatctgcgggaagggttttaggagtagattaatgggatttgtgatcccaagcacccaggccactctgtggtccccacccctgggcttgagtcctgctgaggtataagtggtgctagaagacctctgccctgccctgccctgccctgccccaggaacctggctttctctgggctaatgagtgtcctctctgaaggtatccagaggccgtgcagacactcacactttggtgtgaggcgtgccctcggttgatcagttacactgctgtggggtgcacaggtggcaaggtgggggattctgggatcggggaggctagtctgggtgtagggtcctgccctggaggggctcacagtggggttgaaagcaagctctcgaggcgttattattcgggactctgagtgccgggccatgctgggggagtgagggcagggggagctgcggaggcagggctctgagggctttagaacaagagccggtgtgtgtttcccactgagtacctgccggcacctcatttatgccacgtagcaaccccatgacataggcttataggggactataattatccccatttcacagctgggagaacctaggcttagtgtcacagaacctaggcttagccactgggtggctgatactgccacccagttctgagccagtatcagcttccagccccctgactcagtctctctgctgtggtttcctctcaagtgccaggatccttcctggtcccgtttccaactcagaccagtggaggggcgcgctgtggttaccactcattagaagagaggcagggtctctctgtctctctctgggtgtcccccactgccatctctgggtgctgggggagctgctgtatatctctctctgtctatccctatctctccctccactgccatctctgggggttgggagagctgctctgtctctctatctctctccccccccaccccactgccatctctggagtttgggggagctgctcgctctctctcccccctcccactgccatctctggaggttgggggagctgctctatctctctctctctctctctctctccccccactgccatctctgggggttggggggagctgctctctctctctctctctctctctccctctctccccctccgccaaccactgccgtctctggaggttgggggagctgcctgggatgcagagcggcttggattggtgctccctctgcctcagtggttgagctgacctctgtccagtctgtacacattggatcctgaggctgagcttgggtggctgtggcaggaaggtttggtgacatcacacccttcaggcttgtgtctgtctgagccaggctctgactggctgggagaagaggaggaggtggggttctgggaggccctgaggctgagcacggctgctgtgctctgtggctgcactgcaggggcacgggctcagcatgttctgggccagggcacacaatgctttcagatcaggctccagcaccccacacgccccttcatgctttgcactttttgtctaccagccagagggcagtgaataatgagaacaaacaacatcgggtccagattttcgtggtcattttcctaacaagccgaggtcagagagcactgaaaggaggcctaagtgcttctgccacctcagctgactgtttttcaaaaaggaaagcatgcgtgggatgtgtgtattaggtgttacggtgatgtctgttgtcagatcatggccagaaaaggggttgtttcaattaaaatggattttggacttcgtttttcttggaatgagtaaattgagggaaatagcacatgttgagattttggatttctgctcttagaaaggatttaaaataagtggtcttcagtagttccacagcggatcttcgagactggtacagatggggtctcctggatgtaacgagttcttgctgctttaactggatccggttgactctgtctgaccagctcagctggttcgttctatgaaacgcacttctgctttctggaatctgaaggaaggagagagatagaagacaaagaaggacagatgtgttggtggccagaccctggcttctgaacagtccttcctgatggcttcaggacctgggaggagcggcggagcaggtggctgccctgggcttgccagacacctccattccagcaagatcctcctgggggatgtggtgccctccctgcctctcaggcacaagcatatgcttgtttggcctaaaaaagtctccttaattaaaattaatatcgtaatgcagtaaatccttctgcctcctcttcccctgcccagttacaattcccggcggctctccagcccatagaggaggcttctcaaagtttcctgcctcctggaggagagaagccattccccgatcacccaaaaggacaaagtatgtgcccactctgcgtccttgcttgtcactgcccaacatctgcaaacattaactaaagtgctgagcccattcaggtgtaggactcactagttggttaatgtgacagacagcgtttcctgtgccagcgctggctggtcacttcctgtcatccagcactcttgagtgttgcagtggatgcctgtttcgtaggaacactcagcctgttccgtaagaaggagcgccacttctcagcctgtacttagcaggtcactactgttggccactctgcttttctttttaaaattttaattattaaaaaaattttttttgagagtttccctctgttgtccaagctgaagtgcagtggtatgatcttggctcactgtcacctctgcctccctagtagctgggattacaggtgtgtgccaccacgcctggctaatttttgtatttttagtagagacggggtttcaccatgttggccaggctggtcttgaactcctgacctcaggtgatctgcctgccttggcctcccagagtgttcggattacaggcatgagctactgctcctggtccccttcttatttttatgttagtctttggaaacaattggcatatattttagtctgtttaggttactgtaacaaaataccataaactaggtggtttacaaacaacagacatttatttctcacagttctggatgtgggaagtctaagatcaaggcgccaacagatttgctgtctggtgagggcttcctggttcatagaaggccatcttctcactacatcctcacttggtggaaggctcaggagagttctctggagtctcttttacaaaggcacaaatcccattaatcacctcccaaaggcccactgtctaatagcatcactttgggcattaggttttaacatgtgaatttggagaagggcaggcacaaacattcagtctgtagcagcatacaaaaatgtaacaagaataatgtgatgaacagctaggtatccacaagctgctaaaggtagagaatactaccatattggttacctatttctgtgtaacatattatgccaacacttagtggtataaaacagtaaacatttattatctcacacatagtctgtgggccaggaatatggaagcagctgagctgggtggttctagtggaggggaaagatgtgagctggggcacctgaaggcttgactggggcaggaggatccacgtccaagatcgacttcacctggctgttggctggcaagagggctcagttctttgccatatagacctttccacagagctgcttgagtgtcctcacaacatggcaggcggattcccccagcctcagtgattcaagagagagtatagagagagtagagaggaagccgctgtgccttttatgacctggtctcattagtcatacactgtcatttctgcttatgtctgttcactagaagcaagtcactaaattcaggccacactcaaagagaaaggaattaggttccactctttgaagggagtgtcaaagaatatgtggagagagatatatatatatatatatatatattcttttttttttttttttgagatggagtctcaccactctgtcacccaggctggagtgcagtgatgtgatctcagctcaccgcaacctccgcctgccaggttcaagtgattcttctgcctcagcctcccaagtagctggaatttacaggcacacaccaccacacctggctaatttgggtatttttaataaggcagggtttcactatgttggccaggctggtctcgaattcctgacctcaagtggtctgcccgcctcagcctcccaaagtgctgggattacaggcatgagccaccatgcccagcctgtggatgtattttaaagcatcataacaccattgcagctagagcccctccccagttgcatcttgtctttcacacagaggtaactactgttgaagtttgatccttgtttatggcctagtacatgtataagtatttctatccctgttagttctgcattttgtctgtaagcgttatgtaaatgatatcaccttgtatttttttctgtagtgtgcctttttttttttttgagatggagtcttgctctgttgcccaggctggagtgcagtggcgtgatctcggctcacggcaagctccacctcctgggttcaagcgattctcctacctcagcttcccgagtagctgggattacaggcgcccgccactgcacacagctaatttttgtatttttggtagagacgaggtttcgccatgttggccaggctggtctcgaactcctggcctcaagtgatccgcctaccttggcctcccaaaatgctaggattgcaggcctgagccaccgcgcccatccagtgtgccttttttgcttaacattatgtttgtgagattcatccatgtgaaaacaggtggctgtatttcatgcattttcactgctgtgtggtattgcattgtacaaacataagactatttgtcgttctccattgatggatgcttagttgggttcctgtgacttgctgctacaaacaaggttgtcttgagtactcaggtatgtgtctctctgtgaacgtgagctggatttgtcagtatatttagcaaggattggaattgctatgggagagagtacagtaatcttcaaacgtactagaaacagctaaattttattccaaagtgtgtgggtgtcctcatgagtggtcccactgacagcgtatgagtttcctcttctcctttttcttgacagcacttggtgttgtcagacattttacatttttgtctaatgcgtgaaagtgctgtctacatgaggtattaatttgcatttccctgcgtgccagtgaggctaacatctttccatgtatctattttcacatatatattttttcatatatttggtattctgtgaatgactggccatatcttttgcacctttttttctgttttcttattgatcaatctgatccgttgttgagtttatgtaccataaatatcttttttcttttcttccttctaacataatgtagaagctaagagtgtggattctggggccacattgccagggttaaatcccagcttcaacacttcctgtgtggccttaggcttagtctgtgtatgcctcagtgtcctcatctgcaaaatgggatgatggctccccacggtgggcctgggaggatgcgcaggttcgtatctgtgaatcagttagtgcctgtcatagtaagcacaagatagactaatgcaacctagtgtgctgggccctgtgtggccacacggggctgtatgcacaggcgtcaccatggccagagctggagctcagatgtgtctgagaagattggcagatgctgcttcactctggctcccggtctcctgggtggccctgcttccatccctgagctgcctgaacggaaaacgaaatcccatccccgctccagggggtgcctgggaattggaaggcatcaggctcctcacagcaaaaatagaagcctcatttgcttaggagagaacaatgacgaggaggcaagccagcagaggcggccttggcgggctgtgtacaccctctgcttgtctccgcactccctggggtcagacgtagacgtggctaagctgcctgcagaccttctcttccccttcatcctggcctgcagtgggcatcagggtccatcctgggacgtgggctgtcttggcaccaagttccagttcttaatacctcagtgtcacactgttccctgatttctcaaagccaggaaggaattgcagaaaacaaggtcagtttagtatcgagaatcactggagagccgtgtcagagccctgctgagaagggcgcggggaactgtgttcctgtctacctgatgctgtgggctgcacaaggacggacttactgaagattacaggccagggggaagagggcacgtttagtgtcaaccctacacagaagaagttagctccgctgggcgcggtgggcactttgggaggctgaggcgggtggatcacctgaggtcaggagttcaagaccagcctggccaacgtggcgaaactgcgtctttactaaaaatacaaaaattaacctgttgtggtggcatatgcctgtaatcccagctactcgggaggctgaggcgggagaattgcttgaacccggggtgggagaggttgcagtgagctgcactccagcctgggcaacggaaactccgtcttaaaaaaaaaaaaaaaaaagaacaagtcagctcagccccactgcaaggagctcctgggtttatttaagtgagcctcagataactttacataaaagcaaatgtgtaaaaagcgataaagtcagatatattgaacatttgtcctgagggcaaatttctgagctctaaaagccagtttggttttagataacatctgtgagtctggaaacaggctgagatactctatatctgcactcccaactctgcctttggctttgtgagccctgtggtctccttgaaagaattggtccccagtgggtgaactaatcacccatgaagagtctcccaattcaaatctggaataaaaagtgaggacatgggggcagaatgttactcatcacatgtggcccgtcagtactagacttcaaggtaagtttccaagaacagagctctgtgaccattttcatgatagcaatttgtacattattactaagtaattttaatgccgtgtttacaggccaccttcccaaacaaaacaattgtttctggaagttagactcttgaagacttaacttttaatccagtttgttctcaaaacatttgcacaaatgagagtcttgaggtttgagctttctattctaaaggctcagcttcttgcccaggagaaaaataatacatgctcgtgtttataaataagagttatggcattggagtcctttacattgcagccagcctagggactcagttattcagaatttaaacattttacttgtaaagagcactttggtatccaccccaagggccctcctctgcctgtctcagcaccatctctgtgtgtcccatcaggaagcaacagacaactccctaagccccacagtaaaaacgtctctcctggtctgggggcgcatccatcccccatgtccccagtcccatcctgggtgttctgggattccagccacagctgtggggacaccgccatctcactgcatccctcttgctcttgcggcagcttggctgagctacagggccgggccgcaggaggcgtccttgtgccggagctcaccttgtgccggagctcaccttgtgccaggtgttgagctctgccagctgcccggccccactgtgaggccgccccttgcaggtgagttcactggcagcccagccagcccacgaaggccatgtgagtgtgaacccccattacaagctttccctcatgagatggcgctgatcagtctgggggatacctgcctttcagtatgggctgcagccattaggctggtaccaggaggagccaggtcgagctggcactggggcgacgctctgtctttgatgcaccctgatgcctcccccatcctgctgaccatggtgctcagcacagaccccttccaacccatcccagggcctctgctcagtgtggccagagcctcctgtcaacaagtatgtcactgccttcgggttattattgttcaccagattccacttgctctacaacccaggcacagtgcaccagagtttcccaaacctgtgtgccgagtgccagccccttagcaagtgcagcgttgcccatttcactctgggaaatgcagccatagctctggggccagctagaggaaggagtgtgattgtgccttcccgggacagcttccaggtctgggagtctgtgatgttgtgagtgttgccttagctttgctaagaaaatgcttagggagatgggttccttcacccattcttccactcatgtgcctttctggctccagggctggtgtcccctgctttggaggggacgctcacatgagctgccctattggggttccgtcaagtttctcttagcctaagcggcttcctgtctcgggctccctccccagccatttgggtcaccttgggtccctgaggatcgcttctggatcttggaccccctcaccaactcctgtgacataataatcaaaggtaatcaggaaatgtatgaatcgtcttctttaaggaatatttagcatttctgctcattccagagtccctggaagcatggcatttcaaaggcttggttagatcacaagtccaatttactgccagaaatttgcacgtagaataatacagagcctatgatggcagttgaagtggtatcctgtgagaaaattaattagtcctgaaactaaatgccgacagcctcagcaaaatattcatgagagaagcaaacctcgtgcgtggtgtttgaagtcaggcagctgaggctgtgtactggacgtgttctctgtggctgagttctgctgtggattctgggctagtctaggcaaggcctgcctctccttctggactggctcccagggctgggggctcaggaaggccctgcaccctggagaagaagggagcccctgagactctttggccttgtatttgtgtgtccctctgggctgcagggctgcagaataaaccagctcccaatcctccaaacaaaaataaagacctgtgaatggctacacttggagagcagagtgttttgatatcatggggagacctgtgtacttaatttacggcctgaagattgagaaggatttaattgttccaaaaatggtgagaaaagagcaggtcccagcctttctgtctgatcacaaacagccgagggggactggggaagtggcctggtcctcactgcccctggaggggcaggaagaggatggagtgatgtgcttggcagatgcaggaatggccaggcagtgggaaaagcctagggtttccaagccatgtctgatcctctgtgttccttctgcctgctgggatggagcccgccccccaaatatgcctggctcacttacgactcagagtcagctgcccccagggacttcccggctctcgtgaccttgctgggcatgactttcaggggagccctctgtccaggagacataggtcactcgaatcacacagccgtgctttagtgaatgctagccaggggccctggagagggcaaggacaggacactcctgcatggaaacgaaaatgaatatttttctctgcagaaaatgaaaagtggtgctgggtccaagtggtaggtgacctggcttttgagcgaaaatgctgctgggaaatgagagaaaagaaacatgaaaagaatgcaaatgagggtggtggacaggggcccagaggcctgattcctccaccctccgcaaaggctgggtgtgtgatgcctataaatagacactcaaaacccgttctaaatggagtgaagacatgggcctgcttcctcttatggaaaggccttacataaggtgcagtgctgctattgctcctgggcggtgtgatgattctgtgcctttgtcggaagtcagtgtgaagcctgtggggcttctgggggatgcacatggatgagctctgggctttctggagactcgcagactctgggaaggaggcggtgggcgatgggcaggtctcctagggctgggaaacagtcctgagacaggctccgggtttcctgaggcgcttctgggccaggagcaagtgggaaaagctggactgcagggcttggtcaagtgacagctgcccagagccggagtttagggtgcctggagaggacaggggctggcaggcctgactttctcactgatccacttggggtcacagagccaacctgtaacagagtgaggaactgaggccgcattgctggactcccagtggaggattcttgctgctggactaacctttagttcatgaactcacccagaaattacttatttttggaggaccgcagatggcgagcttaggagtgaagaagggaatactatttgatgctaatgtgattccaggcaacattctagaggttcccttgcaattcaccttcccagccacctttgaagtagttattggccagttttatacacgatgaaactgacagagatggtgtgaagggattttctgacgttcacacaggaagcaagcagcccatgctgactccactgcggaaagcgtgtgtgtgattgacatgctttttgtgtggtgctcactttgggtgtgataaagaggcctccttgcaaagggccaggatctgtgaagcaccatgttgcttcacagaacaggccgtgaaaagccacagaagcaccatagcctgggaaagaaatggaacaacggtgcaaacagccagtttcccctgagcagaggcaagcaggttacggctctgcagctcccttaacgggtagcttgttcaacatggaaacatctttagcctcctcagagacgttgggtcatctcctttacatggggaccagaagtatcttccctgggccattttgggtggaggaaatttcgtaattataaccctctgctaggggtgtctacctaggaagtgagagcaactggccgctttcttagagaagtgaagacgctgagtagactaaacctttgtgatgaagtcgaagccactgtgttgcctgtgtcctgtttccttccccagtgaatggggctcttccctacgactgcagaccccaggaccagattgcaggtgccctgtccagcagcgcagccattcgtgaagggctcgcagcctggcccggctcaacagctgatgcccccgggaggaggctgtattactatcctttttgaaaggaacacagaaagccctttgtaactttgtctgtagccaacatggagggagaggcagaattcagatgtgatgttgcagacaattgaacacccctcctcctgttccaccccagcttcctgcccgtagccttctaatgcccttgccctgaattcctgatccaacccaagggcctggccttgaaacccccgagcctgctggcagtagcttcctcttcagccttcctgtgcagagcttcctctattcagggaagtctgagacctggtggcctctttctcattcttttcatgaaaccatcttgcccaggagaaggtgggctgagaccctgggcattggaaaggagaggtggtcctccttcctctcttcactttcatcgcagtcctctccccgcccacccccatatgcacaccctccgcagtctgaaagtgtcgtgaagcaccagctctgcaaacccgtggggtcaagctttgttgtgggaaaatacatattcatgagggctttgaggagcctcattaaaatgcagagagtctctcctttcagaatggtacataagccatctctttatttgcccaacacattgttcttaaggcaataattatgcgatgaatggctaaagaaacattttaattatttgtttagggtaatttctgattatctcattagaattataatctgtccacttttacaggtgattcaaagcctcatatttacatttttatacttgaaggagctctatgtgcgcacctgtatcattgctgaagtgaaagtaattttctctgttttcttctgctttattccagaaagatttgatcaccaggagatttttcgggacattaccaaaccactcattttaggtaagaaatacaaggcagcgttgcatggaatgaggttttgcttttgccatgtggggagcggaccgtttcactggagggaaaatgctacattgcaggcagagctggcaactgccgtggctctttgttttctgggatcctgtgtgtgtgagcttggggagtttgaagctggggtttgagtcacagccaaggagtggatggacactggggacgcttctggcacttaccttgcccggaaccgacctgcccaccacccaatgacaacacagcaagacacgcactccccatctgtcctctcctcattatactggtgtttctgtaaaccatggtcctcaccagactcagtcattgatttgtgtaacccctacctaggttcctagttacagcgaaagtagacacatgtatatcggcaataataggtagcactcgaacctttcactctccagtgtgggcagtggctggtctactttgagaagggaccagccattgtgagataccaggaagctgagcagaagaaatctaactttgataaaaagaggcctcctcatcttgccagggatggagcgtggtccatcctccctccctgtgcatggagcagtattgcagccctgaagacactgccccatggtcagcatctggcttgcccttgccctgtaggactggtaggaacagagccctggtgccagccgagtgttccacacaggggagacttgcaagggacaggttctgcactgcagatgaattggctgtcttcttctgtggctggagacacacaaggcagcggctttgtagggaaactggtgtacagggtggggcgtgtttggagaacgaggagcagagggcattgttgctggagttaaagaagcagagccagggatggtcttcatgtcctgatgcccagagcaggcctgagcttctgatggattctgggggttcttatgtattcttgggaaggagcatgtggtaagcttggacagggaggcagttcagagtgttacatgcaaggcagcggtggccttgggaacaccccccctgcctgaccaaggcaaggaacactttgtgtgtcccagtgtggaatctctgtgccagttgtgaggggacggatgaagaccagcaggggtgaggacgggattctggagtgtcaagactcaggttcagaatcacagtttttcttccagggcagcacaaggccacaagtgtggctatttgaagccacccaaaaagccattatttgtaaagcaaggcagctttattgatttcactttctgccctgcatctttcccacattgtggtaaccactcaccatccctgttctgctgatgaggcaggaattcccttgcatccagttggggagcattcttgtcacaaatgtcctggatgaattacacggtggctctccgtggagggagcacattcacaaggcatttaagagatgcaggacaatcagccctcgtccatgaaacagggtgaaacgtagaagagctgcgtgattattaatgggtttggacataagctggagtgtttactgaaatttttctcagttgtcagttttcaaagtttgtgaatgtacttttgtgctctcaacaggccttttctgctctatttaactttctacttagggttgtaaacatacttcagccgtaatgacattagatacatcatccactctcagctctgaaaatgctggagattttgattatcaccagcagtaaggacagcttatgaagggagatgttacttatggagacacagctcatgattccataaaattccagtcttctgggagcccagggttaagcagctgcctcagcccatccaccctctagggactgtccacggtgaaattggcttcttgacgttttccttatggaacctggggtgtcattacattctgttagagtcatagggtggttctatttatgcctgtaaggtataaggtatttttttcttctgagtctagaaaagacctactggaatttttatgtatcctgaaatactattagacgatcaaaatcaattgcaatagagaaggtgctgggctctcttcccaattgctctcacccatctgcagtgtaataggcctatcatgtaagtgaatatactcatcacaattctctgcagcttcccagcagaaaagcatattccttctcagagagaaaggcggcaaggagatggatatttttaaatgccaattatgccagaatgagtctctgtgaggagatctgtaaagagaagaaagggccggggtttatttatttttctgctgcgaatggaatcattctgtagcttcagaatactaatccctgtgatgtgcctgatgtcttttcataggataatttgtgaatgtgcttccacttacaggaaaagtttgaggctcttttcttattcttctttttcttttttttttttttttgagaattaaattctaggcctcactatatcctatgataaccgtcctataggccctcgatctataaaatgtgtgcataatgaaatatataaaatcagcgattatcctgaaggaacacagaaaagattaataagctgtatttaaatcacggcaagtctcagaacatatattaagttagaagacatcacgtcctgaaaatgacgggctgatgtgatactagcatgtacccccgtatggatgcatataaatgctgtgtaaaacctagcccaaagtgttctttaaaacctaagatccaaagaaaggcatggaaattccaagctatgagacatgaagagaaaacacaaagccagagcactaagggaggaggccatgagacccccaagcagtgaggttcctgatggagagccaggatgatgaagactgtgtgacatttgtgcagggagagacacggcaatggctgggacagggtagcaaggctaggagcaagtgctcatatgtataggaagccaggaggtggcagacgtgtgttatggaccaggtgggatgtgatgcaggacagctggttggccacataggaaaagagaaaagataaagtgagatccctacctcacagcacatgtaccagtaaacggccatagaattaaaggcctatgccgggcacggtggttcacacctgtaatcccagcattttgggaggccgaggtgggcagatcacctgaggtcgggagttcgagacgagcctggccaacatggcaaaaccccatctctactaaaaatataaaaaattagctgggtgtggtggcggacatctataatcccagctactcgggaggctgaggcaggagaattgcttgaacctggggggcggaggttgcagtgagcgagatcatgccactgcactccagcctgggtgacagaatgagactccatctcaaaaaaaaagaaaaaaaaaaaggccaaaatgtaaagacaaaaatgttaaaatacatagaagattttttctatctgctcttgaggtgggaaacatacacacatcataaaagaaaagatggattaatcaaacatcagtattagcaacttctttaagagaactacaggctggaataaatattcatgatgaatttactgtgagagatttgtattctgtttgtatcaagaactctttcaaattaattttaaaaagacaatagaattgaaaaatgagcaaatactatgaagaagaaaaaatgaaaatgtcaaatagacaaatgaactctgccttgctcctaatctgggaactgcctgggagaccatgagatgttggcaaattagaaagtctgataatcgaagggttgcccagagtgtgaagcaagggggccttcatgtcctgtttatcaagggcaagttagtaaacccctttagagaacaattaggtgttatctagtaaggttgaaatgtggatcccccatgacccagcaattctgctcatgaaagggattcagtgttgtattagtcagttctctcaaaaacagaaccaataggatcagtttatcttagagtttatgtatcgatcaatcgattgattggtcaattgatataaggtattggcttgcatgatatggcatctgggaagtctcacaatctgccatctgcaagctggagacccagggaagccagtattgtagtgcaaaggcctggaaagcagagaactggtgcagattccagtccaggccgaaaggcctgagaaccagcagcatggagggcagagaagaccaatgtcccagtcaagcagtcaggcagagagtgaattcaaccctcctctgctgttttgttctatgcaggtcctcactggagtggacgatgcccacctacactgaggagggccgtctgctttactcagtctgccaattccaatggtaaccgcttccagaaacacctcacagactatccagaaacagtgtttaaccagacgcatgggcaccttgtggcccagtcaggttgatacataaaattaaccatcacaagtgggtcacaaccagcgttttctaaaaatatgaaccagattagaacagaagatatcagagtttgttctgcatagtgaatgatagtgatcctgagaagggggactttgaggggatgggactgacagcgatggttaagcctgaatggaggtttgctacattgttttctatacttctatgtatttgcaaagttgaggagaaaagaagttgtggtaaacccctggatgtaggcacacggaccccagtgttctgtgctgtgggtccctctgatgcagccgtcttgctcccgtcttgctggttcatcctccaccttggctgactacctggcctcacccttgtacaggtgcttctgtttgtctcttcattgaaatgggtgggatttattgatttatttagagacagggtcttgctctattgcccaggctggagtgcagtggtctgatcatggcgcactgcaaccctgacctccagggctcaatcaaccctccctccttggcctcctgagtagcagggactacaggcatgtgccaccacacccagcttatttttatgtattgtttttatagaggtgggattttgccatgttgaccaggctggtcttgaactccttggcccctagaatgctaggattacaagtgtaagccatcattccctgtgtgaaatgagtaggatttctgaatgagccaggctttgcacattgacctggctctgcctcttgaactgctgccttcacatgggaggctccttctggccctgcctgtgtggctgattcctctctcaggtgcttctctttatcttcacagacgaggctcatgggcttcactttttgggaccttaggtggacatctgagtccacagccctcctgcctggcttctgtctctgtggatttgcaggcctgcttgtcccatatcctccagtgcccagcccagtgcctcatgtacagtggatgctcaagaagtgtgtagtcatcacatagctctagtttcttatttttatttttatttatttattttttttgagacagggtctcactctgtcacccaggctggagtgcagtggcatgatcataactcactgcagccttgaactgggctcaagcaatcttcccacctcagccccctgagtagctaggactacaggtgagtgccaccatgcccagctaattttaaaatcttttgtagagagggcatttcaccatattgttcagactggtctcgaactcctggcctcaagtggtcctcccacgtgggcctcccgcagtgctgggattacaggcatgagccactgcctctagactttagaaatgttcagaagctcaccttcccatctgcaaagtggagactcatgagttgggggcgggtagattgtgagaatgaaccacataatgaagaggggatgtgtagcacatgtgagttttcccatcttgctggtttccttccctggaagaggcaaagagaggacaaggagctggctgttactatttgcttgcagacttggtgtgtgctttcaaattggaagctcctgctctgacacccagttcttttttgttttaagttgtactttagaagagaaaaaaattcatcaacacccttttttttaaaagatggaaaatgggttaagaaagtagcacgaggaactgtgagcccaacataattagtgtgatgaaagagaagttagccatttctgtatgtaacttttgattaatgatattcagctctaattaattatgtccaattctaattaatgacattagtgtgcaagctggcattctcaaactatattctgaggattcccagcggatgttcttgaatataatagtccccggtcacattaggttgggaagtgctgtgtgtactgcccgtcttggacactcccaaagcaccatataaaaggccttcagaagtcctgcaagaaaaggaacaatttaaatttcttttaacctgtcatttcccagacttacttttaccatgtgtgctgctaggcacatacggacatgctaatttaactctcataccacaaggtgtgcttggatgaattgatgagcaatgtacatgtcatggagacgttttctaagtcttccagagtcatagcaggggtctcctgtatcgcagcagagcatactgcaaagaattgcatttccatacagtctagggctgctgtgaactaatctcctttcttgggcaaatcgcttaatctccttcaatcagttcatacatctgcagaggaaagggtgatggcatgccaccctggatggtgggaggactcctagcagtggtggctgttaccatctcataagaaaccctcattacaagaaagtccacgtcatttgccatgtgctggtctcggggggtcagcgagtggggggctgcagggagagaccaccagttacctcctgagcctcacgtgtggggtacactgtgttttgtccgttgttggatttgtattcattgttcatctaaaagtgattatgttgaaaaacagaatggtggcagacaggcatgtttggcatgggttaatgcgaggctggaaagagagcccctgaccttcagttcgagaatcagccactgcaggaaagggtggcgtcttggtggccgcatactgtgaatgtcaagggagacgaagagtgcaccctggggagggcggactcatcagtccagtgggttgtccaggagggagtgagggttgatctttcatctcgaaggatgaatatacatttctgcgagagagggggaagacgggcgttccaggcaaacaagcgtgtatatataactgaagcgtggacagaggaagcagcgtggctggtctgggaatggaattgtttgatctggcttgatggaggagctagggggtgaggtagaagaggtggcagaggccagcttgacctgtgtagatggcttgggagaagccctggcaggtctttgttggagggctgacaggaagggatatgtgctttccatagttgaccttggagggtgcggcatggggtggaggcccgtgcaccagaggctcctcatagagtctctacagagagatgaccaggctagcgttttcatggcatgaaggttgtcttcagaaactcgcttcacaatctacttaagatgagtcaaatctaccctccaaagaacatctgctgctactggagatagcgcttcaaaagctaatgcaggtgctgaatgtttttccaccatgagggttccttctgtgcatcaattagtctagactcttgctgtttgaggaaagaggctcagagtagttaagccactagctccaggtctcatagctggctgataggacatcaacctgcggagtctctatggaggtggaatagtttcagtggtgcactgaaacagtaggggatggataggagaaaggcttggtctattagtcaggttgagccagagaagcagtaagggatggatatgaggagatacattgtgaggaatctgcacacgtggttttgggacctggccaggcaagcctgaagcccgcagggcaggccatggggaagggcaggctggaactcccaggcatggctgcagctgcagtccacaggcagaatttcttcttcctgaaggaagccttggctctacttttaaggtctcctgacaaattgatccagacccagacagattgtctgggatgatctcctttctaaaagtcaactcattatggactttaatgacatggacagaagactttcacagcaacgtctggaagagtggctgattgcctagccaagtcagtacctcaaaaagaccacactcttgataacacgtgggggctccaggaccaaaagctggtgctgcagatgtgtggggtggcagcattgtcacttcctgtctcccactaacctcagggtcacagtgggctggtggctgtagcatgctccacacctgctctcagggatgctggagggagactgaggcccaggcttttgtcttagagacttgggatatgtctaggatcccttctaaaagccaagttctagatagaatctggcctttcagggttggagagaccccatgtggcttctgagcagacttccttcctgatctcagtcttggaagtgaaggtcttacccctggttgcccccttcctgtgacagagggctctttgcctctttgcactccatgccccagagacaatcagtgctggggacaattttgtcagaaatctattcccagccctagcttagcctagtggcactctcagtcctgaaagctagaggccatttccacattggtgtagcaccgtggttctcagactgtgtttgctatcaggatcacctggggaacttggtaaaaatacaaatgcaggtcatattctgcttcctccatcctgggcctctgtgttctttattagccttcttggtggttctgacctacatcaaagttgaggaccactggcataacgcacggctgctcgaactccagtgtgcgccggaatctcctggggatctcatttattttatttttattttttgagacggagaatcactcttgttgcccaggctggagtgcagtggcacgatctctgctcaccgtaccctccgcctcctgggttcaagcaattctcctgcctcagcctcccgagtagctgggattataggcacatgccaccacgcctgactaatttttgtatttttagtagagatggcgtttctccatgttggccaggctggtctcaaactcctgatctcaggtgatccacccgccttgggctctcaaagtgctggggttacaggcgtgagccatcacgcccggccagggaccttgtttaaatgcagattctgattccatggtttttggtggatcctgcgattttgtgtttctaacaaccccccaggtggtgcagttgcttctggtcctcaggccacatcttaaatagcaaaggcgtagataggggccgaaattaagcacttaagaattacccagacttgcatcggaattctgcctctaccacttaactgtctctgtgttaccctgagcagactgcttgatctctctaagccttgatttccttatctggacaatgggaataatgtgcctttttttttgtttttttgaggtagcacctctgtctgttgcctagcgtggagtgcagtgctgcaatctcagctcactgcagcctcaacctcctgggctcaagcggtcctcccaccttggtctcccgagtagctgggacctcaggcacacaccaccacacccagctaatttttaaatttttaattagagacagggtctcattgtgttgcccagactggtcttaaactcctgagctcgggcagtcctccctccttggcctccgaaagtgctgggattacaggcgtgagtcactgctcttgctgctttttaaataaaaactgctggccgggtgcagtggctcacgccagcaaattccagtgctttgggaggccaaggcaggtggatcacttgaggtcaggagttcaagaccatcctggccaacatggtgcaaccccatctctactaaaaatacaaaaattgcctgtcgtggtggcagacccctgtaatcccagctactcaggaggctgaggcaggagaatcacttaaacccaggaggcagaggttgcagtgagccgagatcatgccactgcactccaacctgggcaacagagcgagactctgtctcaaaataaataaataaataaataaataaatattgctttgacagttagaaaagaaagagtttaataccgcaacataataaagaccatacaggcaaagccaccagccaacagcatacccagtggtgaaaaattgcaaaggcttttcctcttaagatcagaaacaagacaaggatgccccctttcaccacttctatttaacatagtactagaaattctagccagaacaatttggcaagaaaaagaaatcagaggcatccaaattggaaaggaagaggtgaaattttctctcttttcacatgtcatggtcttatgcaatatgtagaaggccttaaagacttcacacgaaacacacaaagctgttataactaatacatgaattcagtaaagttgcaggatccaaaatcaacacacaaatatcagttgcatttctatacactaacagtgagcaatctggaaggggagttaagaaaaaaattccattaaccaaggaagcaaaaaaattgtacacagaaaactaccgaacattgctgagagaaattaaagaagacaccagtaaatggaaagacatggaatgtttttagattagaagacaatattgttaagatgtcaatactacctatattagtccattctcatgctgctaatacagacatactcgagactgggtaatttacaaaggaaagaggtttaatggactcacagttccacatggctggggaggcctgacaatcatggttgaagatgaaggaagagcaaagtcatgttttacatggcagcaggcaagagagcttgtgcaggggaactctcatttataaaaccatcagatctcatgagatttattcactaccacaagaacagtgtgggggaaccacccccatgatacagttatcgctacctggccccacccttgacgtgaggattattgcagttgagggcaagatttggcgtgggacatagccaaactatgtcatatccaaagcaatctacagattcattgcaatccctatcaaaatcccaatgatgctttttgtagaaataggaaaattcgtcctaaaattcttgtgcaatctcaagggaccctgaatagtaatagcaatcttaaaaagaaggacaaagttggcgatctcacacttcctaatttcaaaactagctacaaagctgtagtcatcaaaacaatgtagtagttgcataaagacagacatacagacgaaaggaattgagtagacagcccccaagtaaaccctgacatatatgggcaaatgattttttgacaaggatttcaaggtcattcagtggggaaaggatagtttcttcaaatggtgttggaaaaactgaaaacaatataaaaacaacacaagagaatacaaaaatcaactcaaaatagatcaaagacctgaacataagagctgagaccataaaactcagaagaaaacaggtgcacaacttcatgacattggatttggtagtgacttcttggatgtgacaccaaaggcacaggcagcaacaggaaaagataggtaagttggacttcatctaatataaaaacttcctcaaaggacacagtcagcagtgaaaaggcaacccaaggaatggacggaaatctttgtaattcatacatctgataaagggttaatagccagaatgtgtgaagaattcttagaatttaacataaaaagaagccacctgattaacaaacgaacaaagggcttgaataaacatttctccacagaagatagacacatggccagtaaacacagaaaaacatgctcagcatcacaaatcgttagagaattgcaagtcgaaatcacaagataccacctcatatctattaggccggctattacaaaacaaaacaaaacagaaaataagtgtctgtgaggatgtggcagaattggaacccttgtgcactttaggtgggaatgtaaatggtgcagcccgtcggaaaacagtatgacagttcctcaaaaaattgaaaatagaattgccgtggaatctaggcgtggtttcacttctgggcatatgcccaagggaagtaaaagcaggggctcaaggaaatatctgtacattcatgttcatgcagcatgattcacaatagtcaaggggtggaagcaacccaggagtccattggcagatgaatggatcaacaaaatgtggtgtatacatagaatggaatattattttgccttgaaaaggaaggaaattctgacacatgctataacatggatgaaccttgaaccttgaggtcattatgctaaatgaaggaagccagatagaatagcacagatcctgtgtggttccactgacatgaggtactcagaatagtcaaattcatggagacagaaagtagaatggtggttgccaggggctagaaggagagggaagggggttagtgtttaattaggacagaggttcagttttacaaagtgaaaagagttctggagatggatggtcatgatggtagcacagcagtgtgaatgtacttagtgtcactaagctgtattcttaaaaaggcttccaatggtaaatttatgttacgtgtattttaccacaatttttttttcttacaacggaaaggactcaacaccatatctagtaaaacacacactgaatgttgttattgaaagcatagatggcaggatcacttgagtccaggagttcgagaccagcctgggcaacactgggagactcccatctctacatagaattaaaataacagattagctaggtgtcctagctactcaggaggctgaagtgggagggtcctttgagcctggaagttcgaggctgcagtgagctgtgatcatatcactgcattccagcctaggtaacagagcgagatcccatctcagaacaacaacaaaaaacaaataaaaaaataaaagcacagagccagtcacagggacactccatacatatgaattctacccacagtcattcgtgcccctgagtgtctgccttcccaccattctctgggagttggtttccattccctcacctctcctgttctctctgacaaaggtaattgaaactatgtttctgttctttcagtatggccaggtgggaagctgttctctagtgtgagttaaccaggacagagggtgtgtatgtgcaggggagagaagccggcaggctcttcctcccagatgctggactatggaatgtgatactaacatggggatcctccccaagagccttggatcccctagtgcaccaaagtatcctactgagaaggcatcagaaaatctgactcacagaagttagggcagtgtttacagtaccatgacagcaggcagagcttggggttcaaagcagaatctgaggaaagactctaaaaagacgagcccctgcccaagatatggtgccttttctagtctcatagcacattgcaccccctcccctcactgtaacaatccacaccctcagaacgcgcacctggagttgttcatggagactaaagtgggaggaagctttggacagtcacctttttgaagtctgttttgaattgaacagtgtgcaaatgataagccacttattttaaaataagcttcttaattcaagtgtaatataaacagaaaagtacaaaaatcctaagtgtttattaccatgaatattttcaaagtgaacacatccatgaaactaccatccagactaggaaacaaaacatcaccacaacccaagaatctcccctagggtcctctcccagccataacccacccccgaccactaccaccaccacctaaaggtaatcagaatcctagcaccaaatgttatttttgcaaatgtttgaatttttttttaaataaatgaatttctacaatatatactgttttatgtcagcttattttatgcaacattatgtttgtgagagtcactcacaggtggtgtgacagtagttcattgactcactgttacagagcattgtaaaaatacaaataattcatccattctatgtttgatggacatttgcatcttttctagttttgggtcatgattgctgctgggaacactgttacacatttgttgtacacatgattgcatttctattgagggtacatccaggattggaatgggtaggtcacagggtctgggtatgtttctattttagtgaacactgccagtcctttttctgacgtgattgtacccaattacactcccacctgcaaataggagtttcatttgctccacatccttgctcataactggtggtgttagtcattttaatttgatttttagtggatgcatggtgggatcctctggtatgattttcagttcactgaagactgttgaatatctctttcgaatacttgtcttgtgcttttcgaaaccttctcttgaagtttttgtgcaagtttttgctcatttttctgttgcattttctttcttagtgctttgtaggagttctttttttgttttatgagatggagtctcgctctgtcgcccaggcttgagtgcagtggtgcgatctcagctcactgtaagcttcgcctcgtgggttcacgcccttctcctgcctcagcctcccaagtaggtaggactacaggcgcccgccaccagcccggctaattttttgtattttttagtagagacggggtttcaccgtgttagccaggatagtctcgatctcctgacctcgtgatccgcccaactcggcctcccaaagtgctgggattacaggtgcgagccaccacacccggccgggagttctttatatagttagtacctgagacctttgctagatgtacatattacaaatattttctcacactttctcacgttcagtggtatcttttgatgagaaggcccagattatcaatcttttcctttaaggttaatgctttttgtgccctgtttaggaaatctatgcatacctaagaacatgaaaacaacagcatatttattttttccagccattcttgttttctaatatatgattttagggttataaatagcctattaagcctgctttagctgtaatccactatttttaaaaattgtagtaaaaaaacacagcataaaatttaccatcttaaccatttttaagtgtacagttcggtagtgttaagtaaattcataatgttgtgaagcagatctctagaactttttcatcttgcgaatctgaacatctatacccattaaacagcaacttctcattctccttgccccagcctctgggagccaccattctactttccgactactctaggtacctcaagtggaatcctacagtttctgtctttttgtgactggcttattttgcttagtacagtgtcctcaaggttcatctgtgctgggttgtgtgataagattttctccctttttaaggctgaataatattatgtggtatgaatagaccacattttgtttatccatcatccatcgatagacattgggttgcttttattccttggccatgatgaatagtgctgctgtgaacatggctggctgtccagcaccatttttggatacgttgtatttttattattaattagttcaaaatctgttcactttttaaaatttctcctttgaaatgtgggttattttaaagtagttgatttccaaatgcctccatattttctggttatatttttgttatttatttctagcttgcttaccccgtagtcaggaacagattatttacaatgttaacattttgaaatttgtttacactggctttagacttgtccaccatatgattaattttgacagactatcccatgtgcccttgtgtgtagttcctcagttcagtactttcgatatattcatgaggaaaaatgggtaattgtggtgttcaaatcttatatttccattcttatttttacttctttgttatatcatttactgaaagaagtgtgttaaattatccagctgctcataatgtctgtgtctaatagacataaatttcataatgtctaatactttagatttgtcttattatagtcctgtcaattctccctttataaattttgagtgcatttaactagatacatataaatttagaatttattcctagtaggttgccctttttaattatgaattctttcttttccataagaatgctgcttttcgtaaaatctagtttgtctaattaccaatataggtatataaactttcttttttaacttactgctttagaatagttttagattcacagagatgttgcgaagatagtagagagttcccatacatcctgtacctacttttccctgttgttaacatctcacattagtatggtacatttgttacaattaatgaaccagtgccaatgcattattattaactgaagtccatacttcattcacattttcttagtttttatcaaatgtccttttgctgttccaggattctattaggagactgctttgagttcagttattatgtcgctttaggttcttttagactgtgacagttcctctgactttccttgtttctgatgaccttgacaattttgaagagtagtggtcaggtattctatagaatatctttaaatttgagtgtgcttggcatttttctcatggttcaataggggctatgggctttggggcagaagatcccatctgaaaaagtgccattcttatcctatcaaatcagggctacataatttatcactgctgatgttaccctcaatcgtctgagtgttatgcaccatctccatgagggaacagtatctacacaaattatttgcaattctgcacagggagattggtctgttctcactcatttattttctcattcatttatttatatttgtatggactcatggatattcattgtatactttgggctataaaccagtattgcattattaattttgttgttcagatagttccagcttttgccctttcctaagatagtggactcacccctctgtgtttcaactctaccaatttggaccctcaagttcttgttgccttattagccataaattgcaatttcttatttccccagtcctctgagactactgaaagttctgcttaggcctattgcctcttaaccactactttcttcctgtgtgtgtttttaaccttttggcttccatcactcacaaatccccaaatgccttgacgagaaaagcagcacagaatgctgagcttatttctgggtaattatctacttgtcatgatctcagcccctcaagtcctagctgccttggactctctgatgcttccacagagatcatttaaaaaaatttcgtcaagagtttctagttgttcttggtgagaggattagtctgacacaagctagtgcatcatagcaggcggtggaattcttcagacataatatttttttttacttcttctactatgtcatagttgatggtgcctcatggtattttaatatctgatgctttgcacccatacagcaactatcctgagtaacgaagatgttatgtcatataggaaaatgagtcattcttttttttttttttttttttttttgagacagagtcttgctctttcgcccaggccggactgcagtggcatgatctcggcttgctgcgagctccgcctcacgggttcacgccattctcctgcctcagcctcccaagtagctgggactacaggcgcccgccaccgcgcctggccaattttttgtattttttaagtagagacggggtttcaccgtgttagccaagatggtcttgatgtcctgacctcgtgatccacccacctcggcctcccaaagtgctgggattacaggcgtgagccaccgcccccggccgaaaatgagtcattctttgcatttcattcatttatgcccttagtcacaagggctttagcaaagaattggcttccaccctctctttaaggtaaggaaataaataatgaccttggaagacagtattcatcataaaagcgcttgatgaaaggagcaattggagtgaactatgtaaaacaggcttttcagtctaatgggacagtgtaattactggtgcagatttctagttaggccttaaagaaattaagcctccctatatggttaataatggacttgtgtaagaagattgcttcagagatgaagtttgtgattcacattagcatatttggcagtgaaagcgttacctttctcaatcaagcaggatatgtaagatctttgtgtatgcttttgctaaactttactgctgccatccctgaacttgacttgatatttttacatccccttcaagtctgcatcccagttttgtgtcatctacagttctgaagagctgccttgtgctttatcatcatccagggttgaaaagagccagatcattggagaatccccacagactgacagttttccctgaatcgatgcctgcttattgtgctcatgcaggtagctcctattccatctcacttcgctgcatgcagctcacatatttcagatgatccacaagaacattgggaaggacctgccaaaatcctgccttgctaaagtccaggtatactctcttccagatctcccttaactgcctttgcagattctatatcggagaaagaagtgaggctaatttcacaaacttattcttaccgaattcatttatagctctaataattaccacttttcttagatgtgatcccaaaacaatcctttaataaatgcattttagaactgcactgtccatagtggcagctacttgccatttaaatttaatttaaatgaattaaaatgaagcagacaaaaaatgcagtttctctattggactaaccatgtttcaagtgttcaatacctgccatattgggcagtgcagatagaacacttctatcattgcagaaatttctgttgaacagagctgttctaaaaccttgttttagaatcagatctgagctcacccgtctgcagattactcagtcatcatttgactgtttttttttttttttttttaaagagacagggtctcactttgttatccaggctggagtgcagtggtgccatcatagctcactgcagccttggactcctgagctcaagtgatcctcctgcctgtctcctgagtagctgggcctacaggtacatggcaccaggcctggacattatttaagtctttaagaaacatctacatgtgttttttcctgtcacctctctttttctccatttccttcaaaatcaccttgaaggcgactccatttctgtattgcccaaatcagtctacagtgtaggtgttggatgtggactttttttttggtttctaatgaggttgtgttgcagatgagctgaagccacctttgatattctaggatttgtgcctgaagaatagcgctttctgtcttgctgatgtttatatgactgctatgattgtcaagggaaataaggagaaatgaatgggatccacgttgcttggcccagcatacctgtttctgagtgctgttggagctgagaggcatgctcttggagaatcagccatcaagctgtcttttccagagtggatgttgtccagggcagttgcagagtgagcacactgtcaatgagtgcctggggtccttcatttatttctttacagcatctgtagtagaataaaattccagtgttaagagacaaaaaaaatgtgcccagctctcctggggttgacagtctcagttggtaaatcccatcccaagggggcagctcctctcctgtctgtggtttgcctgctgtcccccaggagccacactcaccagtttggtcagctggcagatgataagagggagagaatcttttagaaaacagatcctggagatcattgttagtggagaacttattatcaagtcaggaagaagaaaaatcattgttagttgagtgaatacattttaaaaaatgataaagtgttcgtcaggcacttgggatttcttgctcatatgctaataggatttttgaaaatccactcactgtttggaaacttgcttgctcagtgacaactgcatccaaatagcagatcatgagccaggtttgtggggggacaagagtgaagggagttcggaggaagtcgctctgggccaggaggcagggaccctggccaccagccatgtgacccggggcagatccttgcagtgctgggccttggttttggccactgccccctggccccccacttcccagaattattgtgaggaactgtgcgtgtatgtgcaggaactgggttaacatatctacttatggttggccgggcgcggtggctcacgcttgtaatcccagcactttgggaggccaaggcgggcggatcacaaggtcaagagatcgagaccatcctggccaacatggtgaaaccctgtctctactacaaacacaaaaattagctgggcattgtggcgcatgcctgtgatcccagctacttgggaggctgagacaggagaatcacatgaaccagggagtcgaaggttgcagtgagctgatatggcgccactgcactccagcctggagacagagtgagactcagtctcaaaaaacaaacaaacaagcagacaaacaaacatatctacctctggtcaacacagaaacaaggtaagcttttgttatcccctttgatagacaaagcaacagagcttaatgagcatgcatgtcacaaggaagcacaaattcacgcttattatttttatgggaagacccctcacttcctggtcctgatgttctctgtgggacctttggtgagtcagggaaggcctcacagtatggagacaacagtcccagcctctgacttgcaggagtgtggggactaagtgacactggaagtgtgctgcacacgtgcaggcctggattattaggagggaaggttagaaatcaagagccaggggaaaactgggaatagctggctggcttttcagaagggagtcattattttgtgcaccttgcaactcaggcagtgagcctggcggggaaagagaaatggctgctctttttttctgtccatgtgtcaccccctgtcagtgtgttactgggtgcaggtgtctcctctgatggtgtctgggcttttctttcccctcccttccttctttgcctgcttctcctttgctcctctgtctccgtttctctctccctgcattttgtctctttctattccttctttcttccttttttatcttcagattttaacctgttcctttcatcaaatgatgcttattaaatacatttggtgatttatatttttgtttctaagaaagctgatcaaaataactgtgtaagttcagtccgtgaaaagacaataatgatgacaggcaggcagcgctttggaggaaggagggttgggtcccgggtacccctgattcggtgggtgtttgtgcatagagtggtacctgcctgcttgaggataggaggctttgcagcttgaggtccttgctccctggtgtggggcatctgaagggctgtggtgggaagagggtcagaaccaaggccagatgcacccggagcttgctgcacgcacttctgggaggtttcctcttattttctctattttaatttctccattttctcttttctctctttcctctctttctggaattcccatctatctgatttttgacctattcattctatctttgaagtctctcttttctttcatatttttccatcttcttttctttctttctttttttttttttttttttttgagatggaatctctctctgttgcccactgcaacctccacctcctaggttcaagcaattctcctgcctcagcgtccagagtagctgggattacaggagcccgccactgcgcccggctaatttttgtgtttttagtagagacagcaatttcaccatgttggccaggctggtcttgaactcctgacctcaagtgatccgtccaccctggcctcccaaagtgctgggattacaggcatgcgccaatgtgcccggcaccatcttcttttctttccgttctgttttctgggatagttcaacgactttaaatacccatattgaaatgtttatgcttgctcttactttggctctctgagggctctttctattctttcgtcatttcttattttgtagcactgtatctttgtgtttctgcggcaatatcttcttctatttatttaaaggtattaatttgttattttgtttcttttttgacaattacttctgtttccttcactatcttttttcctttgctgtccttgtacttgcttgcctggattttcttcttcctgtttgagaccttcctcccagatctgtgagccgtggttgttaattcgcattgagaagtgaagcactgaaaattgactggagtgtctgcaacgtggctgcacattagcatcacctggaagcattaaaaactacctctcccgggggacagtctcagggccattggatgaagatctgttagattggggtctgcatattgataggttgataaataaagatattgatagagatcggtaggtagaaatacagattttccctcctcagcaattctaatgtgcaagcagggctgagcgttgtatagtcttgggtgacagtgccgggcctctggagagttggtataattaccgtgcagcgaaaccactctgcgttttactgtgccgggtgcctggaagactttgattgcatccatatgattctttttctgtacctctggcaaattgcagattgggaggaattatatatccctacagagacttcagtgaatgaagtttcagggacctatgagcaagaaggatgaactggcttcccggggaggggccagcagtccttctgccagacaagtcatcagggctgggacaggaagcatgggaagggcagctgtgcagagcaggatccaggaggggccacctggtggcaggtgtggccactgagcagcccctggctagggatggagctggagctgccagggaagctttgaggccaggtaacttggctcttgggctctcatgaagccaactgttcctctcccaagctctgagaaaacagtggagtcctggagtgacaggatatggtagctccataaggaggaggaacctgtagttggaggggcaacaccaggaggccagtgagcgatactctgtacctgagagaggtggccggaacctgggcccccacttgctgccagtgaccttgcacctgccacaccttctcttggagttttggcttctttaactgggacatgaggatcctgaccatctctgccaagcaggagaggaaatgggctgatgtgtgttgtgaggcagtagagactggggcataggaagcaaattgactctcagagtttatggtataaccttctcccacgctgtagggatcaggtttgcccctaaacctgcagactggctaaggccagggctggaaagggaaaaaagtaagcagaggacaggtcatgctgcaggccggcccctcacccctggtgacttgtgctcttggagtgagggcccaggagggggttgcctgcctatgcgtgtctctccctttccccctcctgttctgtggggctgggcctcacacggccattcttcgaaggaggaaggtggccttttgcattccctgttggtgtgttacttattgtcacttatttttgattaaggatattatatttagggagaaattatttgcattttctttgtaaatcatctgaagaattgtgcaacacaggagtgcattcgggaagaaaattcagacatcagagataaagcagagttctcccttggctgcatctacaaccttcctctccctagagaaccactctgtggttagtgtgttttccttcattatcttatataagcatttatgcatgtgtagatgtagatggctgtgttttgtttttatgcacatagaaggtatctgtgcattgttctgctgccggagttgttcagaacatggtattgtggagaaccacatgactgtacacacaggtctatcttagagacctgcctcatttgctttaactgctgcagaggcttccagggaccgtgtgtacagtactagatactgtttaatgaacactttcctactgatgaacatttaggttgtttcctaatgtttgctgtcacaaacagtgatgctggtgggttaatgcttctctaggggagagagcaagaagcagaagtgctggctgtcatctgcattctgcagtttaccagatactgtcaggttcccttcccaaatggctacagagtggtttggtccctgcagtgtcatcagttcccgacattataactttgcagatgtgatagggagaaaatctccattttattttttcatttcctggattatttgtgaagtcaagtatatttgcctgtgtttactggcacatgtattttctctttggtcaatttcccttttgtaatttttgctcagtttcccatggggttattcgtctttttcttattgatatctaggaaggtcacacgttcatgtgagtgtttgggtgtgtgggtatacaagcaaaaaaaggtttaatacatcctggatgctcattctttgatacatttacttcgactattttcttccagtctgttgtcttctgttttaggtgttttttttttttctcatccaggtttaaacattgtttattgttgtagctaaataattcactttatttagggattataagaaaatgtagaaagtaaatttgcattcttttcctttttcttagtattatgaaacttatttcttttttaaaaaaccagtctgttgaggtaagattgccatataaaagctgtacacattttttttttccagtgacttttttaaaaaatatatttaaaaacaaaaccggccgggtgctgtggctcacgcccgtaatcccagcactttgagaggccgagaggggtggatcacctgaggtcaggagtttgagaccagcctgaccaacatggtgaaacccggtctctactaaaaatacaaaaaaaaattagctgggtgtggtggcatgtacctgtaatcccagctactcgggaggctggggcaggagaattgcttgaacccgggaggcagaggttgcaatgagctgagatcatgccattgcactccagcctgggcaacaagagtgagactccatctcaaaaaacaaaagacaaaacgacctcctcccaaataacccccaaacaaacaaaaaaccagattaaataaaatttacagtgaatatacccagcaaacatttgtatgtgcaattcaatactgtgtctgttactgcggcacgaacctcagacaatatataagcgttctggggggtcgggagagtcccaagttttaactctgtggggtctaggaagacaagatggggaagtgagagaatggggaaatccgttttgtttatcttaattctttccatataaatatattcataaagaccaaaaaggaaaggaagcttgggatgttaaggtaataggagaataggagagtgtgggactttcccaattctgactgaccaaaaaatatgaaaggaattaattttatggtgggagaagagatttaaaaaataaaaaaaagaggatgggggccaggcacagtggctcatgcctgtaatcccagcactttgggaagccaaggcgggcggatcacctgaggtcaggagttgagaccagcctggccaacatggtgaaaccccgtctctactaaaaatacaaaaattagctgggcatggtggcgcgcgcctgtagtgccagctactcgggaggctgaggcaggagaatcacttgaacccaggagccacaggttgcagtgagccaagatcatgccactgcactccaaaaagctgtacatatttaatgtacaactttgtgagtttagagcgaagccaacccccatgaaaccattgccacagcgtgtgccgtaaacagatccatcacctgctcacgtttcctcctgcctactttattacgatgatgatgatttgtgatgagaaactcaacagaagatccaccttctcagcagatttttaactgtacaatacagtgttgttagctgtaggcactgtgctttatagtaaatctccagaacttactcagctcggacagctgataccgtgtaccctcggcccagcatctttccacttcccctacccccagctcctggaaacccccattctactctctgcttctatgagttgactttttaagattctgaatataagtgagatcatgcggtatttatctttctgtgcctggcctatttcacttaatgtcctccagtttcatccgtgtggctgtacatggcaggatttccttctttttaaaagccgaataacactccattgtaagtgtataccatgttttctttatctgttcatccctcaaaggacatttagattattcacatatcttgggtattgtgaataatgccgcagtgagcgtgggagtgcagacttctctctgaaataccgatttcagttcctttggatgtatgcccagcagtaggattgctggatcattcggaagttctatttttaattttttgaggaacctccatactattttccataatagtgataccaatttgtattcctatcaacagtgcacaaggattttcttttctgcacattctcaccaacgcttcttatctttcatccttttgatactagccattcttacaggtaatagtgtgttttgcatttccccgattggtcttttccttgatgattttttattgtcttatttaagaagggcttccttatactgagtatctaacattttagagtcacctattttacaataagtctttagtccccttgaaatttatttttgtgaatagcgtaactcagggatatatatatagcttttaaaaaatgagttgcaaagtttataacccattccccccaccagctgatttgacatgttacctttatcatatggtaaatcattatagatgatgagttgttctggactgtcttctgctggtctatttgtatactctcgtggaataaaaaattctatggttttatatccttcattgttcttctagagtgtttctgcaattgtttcctctgccatctgaattttattattctcattggaggttcttttggaattgcactgactttctaagttgatttggaccaaattaaaatacttaaaattgaaatatttactatattaaaatgcagtattatttgtttttatctgggaatgtagtgtatttttttcttgaaagttttgtacacttttgttatgttctttccctatatgctttatagttttgttgctattgtgtatgaaatattttttattattacattttctatttggttgttgctggtgcttaggagagccattgatttatgtgttaaactcatacctggccaccttgctaaacctttttcttagtcctaataattcgtccgttgattctcttggttttctataaagacaggaatattgtctgaaaaaaatgcctccttcttcccctcttccttctcaaactgtacacctcttgagatgtctctttgtgtttgtacttctaggtagggtaaccagccccagactgaaaggtgacagtgatagcagccttcctaatcttgtccctaaatttacaggggatacttttatggcgtcactataaaatgagatgttttgctgcacttggctgataaatatcctttatcaagttaagggagtttgcttcttggtctaccttttaaggtttattttaaatcaggaatgggttgtcgaatttgatggccattatacctttttccttttttttttttttttttttttttttttttttgagacagagtcttgctctgttgcctaggctggagtgtagtggcgcgatcttggctcactgcaacctctgtctccgaggttcaagcgattctcctgcctcagcctcccgagtaactgtgaatacaggcgtccgcccccatgcttgactaatttttgtatttttagtagagatggagttttgccatgttggccaggctggtcttgaactcctgacctcaagtgatccacctgcctcagcctcccaaagtgctgggattataggcatgagccaccacacttggccccattttatacctttttcatggaagtaaacattttctaattcacaataaaagagaaaaaagtataataaacacaacatatccattgccatatttgcttagatttgttgttagcattttattatatttgctacttctttcctttttgtcgattttttttttttttttgagatacagtctcgctctgttgcccaggctggagtacagtggcatgatctcggctcactgcaacctccacctcccaagttcaagcgattcttctgcctcagcctcctgagtagctgggattacaggtgcatgccaccatgcctggctaatttttgtatttttagtagagacggggtttcaccatgttagccaggctggtctcgaactgctgacctcaagtgacccacccacctcagcctcccaaagtgctagaattataggcacaagccactgtgcccggccttttttgctgaagttttaaaagttgtagccatcattatttggccatataagttcagcgtgcactttaaaaataagcacatcttcctacatttccacgagaccattatcatagtaacagcattcacagtaattcattgataacatttaatacccagtctatggtaaacactctccagttgttaccagaatgtcctctacagctggtttctttaccagggcctggtcactgcggagacagcactgtgggccctgatgtctccactccttctctaactggaatgcaccctcttcctttttgttccattacacctctctattgcagagactcacgtggaccagctgtcctgcatcaaatcccatcttcagcgttcgtctgattgctttctgggctagcatttaacttttctctctagctcttgcgcttcttgtaaatgggaatttcagtccaaaggcttgtgtgtttttgctgtgaaacaacagcagaatctcataggacgagaatttttcttcctgtttgtaggcagggtcagcaaaagggcaggtttgttcaggttgcaggtctgctggggtagctctgcctgacatgtttattctgagacccaaactagagggtaggggctgcatggggctcgtgttgcccatggtgagtcagaggaacacaggaggagcggatggaagcaggagatggcctgaggtatagccttggggcttgcaggtggacggttcccattccactgtcgagtatcaatggagtgggcagtgtgcttgtcccatggaggaggaaggggtatttgctgaatgattaaatccaacccaccaaagcatgtttagattcagactaaaagttcttggcaagaatacttcataagcggtggtgtatgcattctattgcagcatgtcacaattcacatgtaatacgtggttgtctcattagcaactgatctgactagttaccatttattaataagatgctgtgctgaacttctgttaacctcaaaaggggaaagcaccaggttcaaggctgaagaagagacccagagccaggaaacaagaattgggattttttttttttttttttttgagatggaatcttgttctgtcgcccaggctggcatgcagtggcgccatcttagctcactgcagtctccgccacctgggttcaagcaattttcctgtctcagcctcctgagcagctgggactacaggcacgtgccaccctgcccagctaatttttttgtaatttttagtagagacaggttttcaccgtgttagccaggatggtctcgattcgatctcttgaccttgtgatccgcctgcctcggcctcccagagtgctgggattacaggcgtgaggcactgcgcctggccaagacttgggattttattaggggcctgcatacaggggagacggatggtggtggattggaccagagaaccgccttatgtacagagatggtccagtgatgggctgggcgtggtggctcacgcctataatcccagcaatttgcgaggccgaggcgggcagatcacctgaggtcaggagttcgaggccaggctggccaccgtggtgaaaccccatctctgcaaaaatacaaaaattagccaggcgtggtggtgggtgcctgtaatcccagctactcgggaggctgaggcaggagaattgcttgaacccgggaggcagaggttgcagtgagccaagatcgtgccactgcactccagcctgggcgacagagcaagactccgactcaaaaaaaaaaaaaaagaaaagaaatggcccagagatggcgggctggataacatatcggccttcctgcagtcttgtggcagtgggctgggcaggaaagctgcaacttcttgccaactttatgcagtttatttagcatttctacttaacaccctcctcttaatgacccctacccagcaaccttcatttaccccaaaactcagggcctcaatgccctgtatggcccgtgttccataggatgttccaggggctcaaatgttcctcatagacaaggaacgaatctctgggttggccacacctgattccccagctcagagcacacactcaggtgcatctgccatacagggtccttctgagggtaggttcaagttatcgctgtcaggtgcatttaccctacagctggtgacagcttgagtcttcttttataaagtttcttatgcttgagactgacaagaaatctgtggctagttctttggcaccatgtatatgaacggccagttaaccctctgttatccattggtgatcctggcctgaatcagttaattcattagttgttgcaaattggtggtttcacaattctctcatactgttttcatttattagctgttattcttctgtaaagaagagattttccttatcacctggagctgttagaccaccctgaaatacagtatcgttagaacaggccgggcatggtggctcacgcctgtaatcccagcactttgggaggctgaggtgagcggatcacgaggtcaggagatcaagaccatcctatctaacaaggtgaaaccccgtctctactgaaaatacagaaaaaaaaaaaattagctgggcatggtgttgggcgcccatactcccagctactcatgaggctgaggcaggagaatggtgtgaagccaggaggcggagcttgcagtgagccgagatcctgccactgcactccagcctgggcgacagagcaagactctgtctcaaaaaaacaagaacaaaaaaaaccaaatccttatttctcttcaattgttaattttcagaataagaagttggcaatagccaattttaatggtatgatacattctcagggtgtgccatcttcccctttatgatataaaccatttttggtcatgacgtgttagtttttaatgctaatagtgaacctatttgttaaagtttgaggtaagatctttgcctctctcatgttggagactagtttgtgcttatcctttcataaaataaattgcttcagctttccatctcttttttgagatgtgacatcatggtaatctattccttgaaaatgtaataaaacgtgtttgtcaattcatctcggtctggcctttattaggttaccttgttattttaaaatatcttctatagctattcagtttttctacttattgagccaattgtggtaatttatattttcttagaaaatcttacatttcattcagttagatttgcaaattcattggcataaagttctgaaaagtattctcataattttataaatttttctgcatctgtaattatgggcttttcagttctaatgtttgtgttttctttctttttcttgatttgtcttatgatatgtattctttttatactgggccaactttcaattaattactgtcttaattttttttagtcttttatcttttttttctttttttttctttttgaggcagtcttgctctgttgcccaggctggagtgcagtggtgtgatctcagctcactgcagcctccgcctcccgggttcccgcattctcctgcctcagcccaccgagtagctgggactacaggcgcctgccaccacgcctggctaattttttgtatttttcgtagagatggggtttcaccgtgttagccaggatggtctcgatctcctgacctcatgatccgcccaccttgaagcctcccaaagtgctgggattacaggcgtgagccaccgtgcccggcctagtcttatatttttctaattccttcattttgattttcacttttatttcttagacttattttatacattaacactcttttcgtttttttttttaatttaatttttaagttttggggtacatgtgcaggatgtgcagcaggtttgttaggccggtaaacgtgtgccatggtggtttgctgcacctatcaacccatcaccgaggtattaagccccacatgcataagctgtttttcctaatgttctccctcccccgatcccacccctgacaggccccagtgtttgttgttcccctccctgtgtccatgttttctcagtgttcagctcccacttataagtgagaacatgtgatgtttggttttctgttcctttgtcagtttgctgaggataatggcttccagttccatccatgtttctgcaaaggatatgatgtcattcctttgtatggctgcatagtattccatggtatgtatatatgtaccacagtttctttatccagtctttcattgatgggcatttgggttgattccatgtctttgctattgtgaatagtgctgcagtgaacataggggtgcatgtatctttgtaacagaatgatttattttcctttgagcctataaaccagtaatgggatcactgggtcaaatggtatttctggttatagatctttgaggagtcaccacactgtcttccacagtggttgaactaacttgcattcccaccaacagtatacaagcattcctatttccccgaaacctcgccagcatttgttgtttcttgactttttaataatcaccatcctgactggcatgaggtggtatctcattgtggttttgatttgcatttctctaatgatcagtgatgttgagctttttttcatatgtttgatggccacataaatctcttcttttgagaagtgtctgttcatgttctttgcctgctttttaatggggttgtttgggttttttttcttgtaaatttaagttccttgtagattcttgatactagacctttgccaggtggctagattgcaaaaattttctcccactctgtgggttgcctgtttgctgtgatgatagtttcttttgctgtgcagaagctctttagtttaattagttcccatttgtcaatttttgcttttgatgcagttgcttttggcgatttcataatgaaatctttgctggtgcctatgtcctgaatggtattgtctagattttcttctagggtttttatagttttgggttttacatttaagtctttaatccatcttgagttaatttttgtatgaggtgtaaggaaggggtccagtttcaattttttgcatatagctagccacttcttccagcaccacttacaaacagggaatcctttccccattgcttgtttttgtcaggtctgttgaagatcagatgacattaacccacttttctaccaaaaaaaaaaaacccctctgtagtaaatgtgtatatttcctaatgagtactaatttggccatatcccctagttgtgatatctaattttttgttcatgtctaaaaatacatcatttacattttgaatgctttctaagcctcagttatttaatgtttaagaatttcccaggcatgtcatattttgttttgtttttgttctttaactatctttgtagcagtctgggtccactcaggagatgggaaccccagggggagcatcatatttaatagaattattaggtatgatgagagagtagctgttaagaggtggaagttctgtgtggtatcgtgggggtggagggagggggacctaagcaggggcagacctgggaaagccccagggaaggaccagcttgttagggaaggtgtggttcagcagtggagagcagggacagccgctggttcaggcagtccagcactggtctagagatgctgttggtcacaataggccaccctctggagtacaggctggggagcagtggcttgaggctgggcctgcggtgtgagttcgggcaccagcacgtccagaggtgccggacatgcagaaggaacgattgctcaacgcaggactctccagaccacgcgggctacatggggtttgtcgagggagtccagaggtggctggccatgtggagctctgggttcgaggcccaacaggtgtggccccaacaaggctgcagggttgcagaagaactaggtgcctctgtggcctgagccgggaactgcgggaaccgttttcctccagcaatgttgctccatcaccctctgcccagaaagcttaatgtgctcactctaaaggagaaacatgaccgggcccggtggctcacgcctgtaatcccagcactttggaaggcagaggcaggcggatcacgaaatcgggggatagagatcatcctggctaacatggtgaaaccccgtctctactaaaaatacttaaaaaaattagccgggcgtgatggcgggtgcctatagtcccagctactcgggaggctgaggcaggagaatggcgtgaacccgggaggcggagcttgcagtgagccgagatggccccactgcactctagcctgggccacagagccagactccgtctcaaaaaaataaaaataaataaataataataataataataaaataaaggagaaacgcttaagggaattctgtttattcagagaacatattgaggggtacattcagaattgggaggcaatgaattgataactgacacaacctttttgtcattcctttctaattgtcccattgtagtcagtgggtgtagccagtacagattctttgtagaatgtcacatttcttttgtggcctaatgctacataggcagttttggttaaacccatgtgagtatgtgtgtgtgtgtgtgtgtgtgtgtgtgtgtgtgtaaaacctccgccttctctatttgttaggtacggggttctaaataaatcttattgttatttaaatttttatatcccatctcatttttgtctggttaatttgattttaatctctcaatatgaatgtggctattaatttcaccttttatcattatttgcttggtttatattttgaagctatgttgtgaagtttataaaggtacatgatgctcttggtggattatttttgttattaatgggaatttttccttttatgcctttgcatactttgttgtttacattcattttgtctgattaatattgccatatgagccttctttttattagcacttgtctggtgtatcttttcctatacttttatttttagcagtcttcgtgccatttttttcaggtgtcatcagaagagactaagcaactcatggcttaattttctaaaataatctgaaaatctatgtttttcaacagatggactaaaagagagtataaagagcactgcattcatttgctcaggctgcggtaacaaaacacagacttggtgtcggaatccatagaaatgtattgcctcacagttctggaggctgggagtccaagatcaaggtgtcagcagggctggcctcctcgggccgtctctccttggccttgatgcccctgcatgtgttcttccttctgtgcctgttgtgtgcccctggggtctctctgtgtaccccaatttatcttttttttttgagatggagttttgctcttgttgcccaggctggagtgcagtggcgcaatcttggcccactgcaacctctgcctccccggttcaagtgattctctgccttagcctctggcaaaatgcccttttcaatcctccctgccattggctacttttaggatcctgctgattggtgcatgttacagattgctgattggtgtgttttacagagtgctgattggtgcattttacaatcctcttgctagctacagagtgctgattggtgcttttttacagagtgctaattggtgcattttacaatccacttgctagctacagagcgctgatgcattttacaatcctcttgtaagacagaaaagttctccaagtccccactcaacccaggaagttcagctggcttcacctctcacaaccaccccaagaaagttgagggtgaagtgcaggccatgcacaggatgctgtcttgatactgagaaaaggaaggtggtgttaaccacagaatttcatggccaggggtgagagttaatgtagcagaggggctctccttggaagggctgtctagaagaagagtgtgtaactctgggcaggataggaagaggtgacacctccatgagaaaagggactttgtcttttttgcccctgtctccccagcctgtggctggtgtgtgtcaaagaggcagagtcattcctgtgtagtcatgatggttagttttgtgtgttaactttgcccagctctggtgcccagttgatttgctcaaacaccagtctggatgttgctgggaaggtaatttttgggtaagatgaacatagtagaccttgagtaaagcagactgtccttcatatttggatgggcctaattcgatcagttgaaggccttaagaccaaaggctgaggttccccgaaggggaaggtcggcccccagacccccttgtgactcaagactggaatgtcaactcctcctggagttcccagcctgccggcctgccctgcagatttcagatttgccagcctctgcagtcatgtgagccaattccttgaaataaatctctttttatatatcctgttggttctctttctctgaaaattcctaatactgtagttttttcatctggtgatctatttggctatctcactaacttctgagttgggacagcctcagagtcagaagtcatgtgtctcctggaccctccatccccaaagcacagccccatgccaaaatatgcctttatgttagtagcactgcccagccctgttcagttttctgagatccagttcctacaagactgtggcactcagtacttttcatctcattgggttctgtgcctctggggctgttgcctctgagaccagatcccggatcctttctttgtgggctgctccacccctgctgtggaaatcacacagaaggcggacagtacatgtggacaggtcagacagacacactgattggccagctgcagcatggggagcatggactctgcccacagctgtggcgagatggctctgtggtgagatctgggctttcttgtgtgctgaggaatgggagcgtttgccatccttatccaagctgcatcactcagggctggcccctctgaggttgcactgtgggccccaccccagcctctgaacgagaattggcataccagccagatgcctaggtgatctgtgcatgtgctgcaggtggagaaggtctgcactagacatctccagaaggacgatctgggatcagggttagacaaggcccacgtctgctgcccagccctctcctctttgatgtcctttctgcacctgacacctcttcttgacattccctttccttggtttatgtggtaagacctctctgtccacaacaggaatggtcttacccatcttcttctcctaccatgtattaatagttccctgtgccttaaacccctgattcaaaacctgcttcctcaactctccaaagtcagccaagcgagaggttatgggcacagtcttccacaagactgccctcacttctgacaccagccccaaattcaggggtcctcaggcccatccttacttcttaccagctggtcaggggttcccatgaccagtcttaaattagataatttgctagaatgactcacagaactcagaacaccattatacttaacaatgacagtttcattatagcaaaaatttacaacccagaaccagacaaaagaaggaacacctggctgggcgcggtggctcacgcctgtaattccagcactttggaaggccgaggcagctggatcacgaggtcaggagatcgagaccatcctggctaataacggtgaaaccccgtctctactaaaaatatttttaaaaaattagccgagcgtggtggcgggcgcctgtagtcccagctactcgggaagctgaggcaggagaatggcgttaacccaggaggtggagcttgcagtgagctgagatggcaccactgcactccagcctgggcgacagagtgagactccatctcaaaaaaaaaaaaaaaaaaaaaaaaagaagaagggacacctagggtgaagtctgggaggcttccagatgcaaagctttggcgtcctcagagatgcattatcctcccagcatccaagtgtgacagtaatcaaagagtattgccaaaaaaggaacctcacctgagcttcaatgtctagagtttttatttgggattctttatgtaggtatgatgcatgatgaattgaatcagtgaattgattaaattgttggccatgtggttgagctcaatatctagccttcccagaagtcaggctggtagcccgtgtctcctgtctcaaagccccaaccctctagtagctagttggcctctctggcatcaccaacctccatcctgagtcatctcttttgcataaactttggaacgcaccacgaataacaaggacactcctatcacttggagattccaaggatgtagaggctccctccaaggtaccagaaggccagccaagttctttattacacaccaactgattgccatgacttagtggttaataaagagtggggcttggggttcctttagatttcaggcctgacacaaccccttggatatagactacatgaaatgaaagtgttaggaagggtgtatgcatgctatttgtttactttgaagagtgacacttggaaccaatgtcagttttacaggctgccctgacttgctggggcacagactgtgaagtgcatattcagaatgaatgaagtgttaccctacagcagtggctctcagacttgcaggcatcagaatcccctggagatcttttaacatgcagacttcagggtcctgcccctgagttttcattggtctgggggagggcccaagagtttctgtgtttgtggagttcccaggtgacactgatgctgctggcccagggaccacacttcaagaagccctggaatagactctgtggtgggtgtttgaactttggattcttggccataggtttttacattacaatgacagaatgggaagtttggcaggaataaagatgacttccacccacaggctcccggggaggtccttcttccctgggccctggcctggtgtctctgtctagcagctagctagcattcaggtcccaggtctcacattttggctggactttaatggcaattgatgggcaagtgcaggctgttcttgcaggggagggagtgctgcctctgcttgggctgctaggcttggggcctggtcacctggggccactgcccttccttcagtcttgccagacaggcagaggagtaagggcttgctaccggggcagagaacatcgaatgattgcaatcgtggggtcattaggattaattagtaaatagccatcagatcttaaaaaatagattcaggaacagcctgggagggcatttgggtgtggtttcccagtttgaggggaaagcatgaatcgactactatctcaggtagggctctggtgctgggaccctgctcaggccagttaagtgacagtggatgtggcctggaaatcctgtttctctcatgttcagtgagggtggaattaggggtgtgtgtggggaccttgggggcgccatgtgatgattaactgtagtctgtctcagttgtggaagctgctaatgtgtttttctgggacatcatcatgggatttttattattgatttcagcagggagactgctggctcattatgtgacaagaaatcgatgtggtgttccacgttcgaagcaggggttctccgtgacgtgcgggccctggaccagcagcctcagcatcccctgggcatgtgtgagcagtgcacactcccagcctccccctgacctgctgagccagaagctctagggctgggagccagaagccccgcaggtggctctgctgcatgggaaggaactgttgggatgcaaagcaggccagagaggacaggagcagacaaagatctgaagctgaatatggacccctcagggtgccagctgtcaccccggagcgcccccctacctggggaagctttggcaaccttcctggttgcaagccaaggcccagggactccaccgctggtgacccccttacctggccctggctgtgccctttggctcagggctgggcccgggaggctggagaggtgccagggttcattgccagaggctgccttgcccctcccttgtgtccttgtaggcagagccctcacccccctatgctttcccgccacccaccagccacacctccttgcccaggcctcagtgcctgacagatggcctgaatacatatatatatattttttgtcttaaaaaactattttttttaacatatctacagactctccccttaccaggtatttcttggggaagaaaatgttgcttagtagacaaatgtccccaggtctccttcagggaggatgagcatcacctgcattgaggaaggggtgcttcagcagagatgctcacttcaaagcgagcctcactagtagccacagggtgcacagctaggatgggaggcagtgctgctgagccaaggggtggtgggagcagctctggagaaacctggtcgggtggtgggtgaagctgcctccaccccagcaagcgatatggggcctccccactggactggggaactgtgtatgagggtttggggtgcagagacctcaggtggccttcaaaggaggggtggccagaggcccagcaggtgactcccacacctcttttacatcatctcctgctgaacaccccagagttccctgcttcttacagtggtaacatttgtttaggagttgtgcagtaagtagaccaggcatggtggttcatgcctgaaatcccaacattttgggaggctgaggcaggcagattgcttgagtccaagactttgagaccagcccgggcaacatggtgagaccctgtttctataaaaaatacaaaaattagccaggcaaggtggtgtgtacctgtcatctcagctattttggaggctaaggtaggaggattgcttgaacctgggaggtggaggttgcagtgagctgagatcacaccagtccactccagcctggataacagagagagaccctgtctccaaaaaaaaaaagagaaagttttgcataaataaagttaaattatttaaaataaaattatttaaaataaaagttaaattgtttaaaataagctaggagaaacttgctacttaaagacatcttttgggagaatttttattcagaagataatcatttatcaaagtgattgagtaacctgtaatttatccagtggagtttaatttaagcatttgaatttcatgtttacccttttagcagctatcattgaacccgtcttggtagctccaaagcacacttaaatatgagatgcagcccctgcctccattggcttatggactgggtgggtgtgtagccaccgtgtacagaaagttaaagatggttctagggaccaggcaaacagcctggggtgagttaccagaaggatgatgtgaatcatcgtgtgagattacaggttgcccatcaccatggccagtgcctctgagggtttgttgggattagaggggcagcttccaggcctttcaggagaggagggtctttacatgtcttttgtgggtgaggacctgaggcaagcagagagagacagccagagttacgtggggctggaagaaatcaggccagagtgactgggacccttgactctccttgttagagggtgtgtttgtccattttgtcctcttataacgtagtaccacagactgggtaatttataaagaaaagaagtttattggctcaaagttctggaggttgggaagtccaagagcatggtgccagcatctggtgagggcctttgtgctgcctcataacatggtggaaggcatcacatggcaaagagacagagagacaagataggggctaaacttaacctcttatgaggagccctctccctgggtaatggcattaatccattcctgacggcagagtcctcatggcctaatcacctcttcagcatactgtctcttaatactgttataatggcaatcaaatttccacatgagtattggcagggacttctgaaccatagcagagggactgccttccccatggatcctggtgtcctgcaccctgggcccagtccactctctggctggcacctctggttttgccccccaggactctgtaagctctagccaaggcagctggtgctgtgcttgccagctctgtgctttgacaacaacttctgccttccccacactgtctgaactccagggtctcctcttcgttttggtgttgggggactctggctcaccacagagctcctctccaggcacgtccctccacagcacctgggaaatccccttttctggctccaagtgacctatcttccgagggctacttgggaattcacagaacctcagctatggagaagctcagaggattgggggattgaaaccgtaggtcatccttgaatggttagcttttgaaaataattgtgcatttttccgtggtatgggttggtttcctgtcctgtctccacagtgctgaaccaaatcagcaacgctgcactttgcaactctgacagttgagcttcctggtcctgcgattagagccctcaagatagtactgaagcattaggtgaacggtggggacagaagcccagactctgtctggagtaggggccctggagggacacacacccacttcctatttggctctgtcctatatgcaggcattttttttttttttttttttttttctgagacgaagtctcactctgttgcccaagctggagtgcagtgaggccatcttggctcgctgcaacctccacctcctgggttcaaatgattctcttgcctcagcctcccgagtagctgggattacaggtgtgcgccaccacacctggctgatttttgtatgtttagtagagacaggatttcactatgttggccaggctggtctcaaactcctgacctcatgatctgcccgccttggcctcccaaagtgctgggattacaggtgtgagccactacgcctggcgcatgcattttttagaaggaccttgagatgatttactattgttgatcaaggaagaagatgaagcggggagatatgctgccttgaaagtgtcctttgagcatgcagccttatttcagctgtatgtcagggtgtgtgtgtgtgtgtgtgtgtgtgtgtgtgtgtgtgtgtgtgtgtgtgtgtgtgtgtatcagggttgctgctgaggagttgcattgcttccctaaggcccaccagggagattcctgtgagggggtcagacagggcctttgaagttttatgtgttattaaagaaggtcgtatcttattaccacaaagacctgggatatctgcagcagggagtggtagaggagaggctgtcaggccagcccttaacagcgtaactctctcattccttcctcagttcctccttatcctcctggcatccagctccccatcagaaactgtgaatcctaagatatgatgggaccatggacccttcacatttttgtcatattcattatagtggttctcagccttggctgcatgtcagccacccagagtgtccaaattctcctcacccagaaattctgacctcatggagctggggcaggatccaggaattgatattttttaaacctcctcaggttgattctagcatccaaccggggtttaggcccgaggaccacagcctgccagttttcgtgtggcgtgacctttcctgccgatgataatgctgatgatgtcaagcctagctgaacgctgatgggcagtgtctgattaatcgaatgaagtaaaaataaacaggttttaacttaatgtacctccccaaatctgtaaagagatccatggatgacatcagtgctgtccaggatggagtaagcccactatcgtccattccactcacggattagaactcaaaactctgaacagaatgaaaagcaaccccatcgggaagggggttggagcttgaatgcgcagcacattagaatagagtttctgtggttgggtttttttccctcctttgatctgagtgctgactgatttgggaaatagcacagtgggcagaggcagcaaaactctgtgagaaacccatctttgtggccagagggttgaaaagaggaacgctgcaagctgaagattaggagggatcactgttttgttttgtcttttcctctctcctggccctgccagacccagagcagtagcacctactaccctgagagaaaatccaactctctggttggaggaaccggttgttgcataaaggtggtgggaagaatccccatttttttctctttctcattctgctttgccctcagcaggggctgcagttgcaagaaactgtgaaagagtgtgatgtgttaggctaaaactctgggagagccccaactttatgggcagaggaaccaggaaaaggtgcatctggtagtagcggaatatggaagaaatcttggagaggggaaatctggaaaagagggtttatttatgtttctgaaccaactccatgtatgggatatacccagagaaccatagcaaaggctttggatttaagctgcaatagaaaccgtggcccgggtcccagacttaatccctgaatagctcgtgcttgaagccaactcacagagcacagcaaagggttttgaaaccgcactgacgttaactccatcccctaacgaaggggaaccagagcttgtgttctcaacctgagtggatttatcgtctgatgaagcagacacatgaaaatcaacattctctacattctcaacattctctctcattcaacatttttaatcagggttaaaatgtacatattaaagcgatctgggatgcaatctacaattatttgggatacaaagaagcaaaaaaatctgactaattcttcagtcaatcaattaaaaatattttttaaatgacccagttctcaagggaaaaggcaattaacaaatgtcaaccctgagatgacatagatgttgaaattatcaaagactttaaagtgactgttataaccatgttccatgaggtaaaagatggacagttctgaaattaacagaaacatagaaattcgcagcagggcaatatgaaaaaaaaaagaaaaaaataggaattttagaatgaagtaaaaatattactggatgagttcaaaagcaaatgtatatgacagaagaaagaatctaagttagctctaagtagatcaatagaaattatcctgaataaaagaaaaatgagtttaagaaatgagtaggccaggtgtgatggctcatgcctgtagtctcagcactttgggaggccaaggtgggaggatcattgagccaggagtttaagatcggcatgggcaatatggtaagacctcttctctactaaataaataagtaaataaataaaattttgctgagcctggtggcacacacctgtagtgccatctactcagaaggctgaggcaggaggatcacttgatccccagaggttgaggctgcagtgagccatatttgtgccactttactccagcctgggtgacagagcaagaccctgtctcagaaaaaaaaaaaaaaaagcaattattaaaaaaaggtatcatttacaatagcatccccccaaaaaagaaagaactacatataaataagaaaatatacaagatccgtatgctggagactaaagaatactgatgagagaaatcaaagacccaactcatggaaagatatatttatattttggaagattcagtatagttgtgaattctccccaaatcgacctatagattcattgcaatcccaatcaaatttccagcaggatttaaaaaactagatattgataatgggattctaaaatttatatagaaaaataagggatcaatagtggaaacaatggttagatccctggtgaaaaaatattcctgattacatgcgggagaatttcccagaagatgaaaaacaagggaactctgaactttgaataaagggcacatgatccttatggactttcttagttctctagggctgctgtaagaagtccacagactgggtggcataaacaacagaagcttactgtctcagttctggaggctggaagtcccagattgaggtgtcctcaggactggtgcctcatgagggctgtgagggaaagtctgtcccatgcgtctccgtttgcttgtggtggtttgctggcgatctttgatgttccctagtttagagccctgccttcatcctgtttgtgtgactgtctccacaattcccctctttagaggacaccagtcctattgggttagggcctacgcaaattactgtatgtcaactaattatatctgcagtaatccccttcctctctctctctcgctgtctcttcttttctttctttcctcactgtgttgccaggctggagtgcagtggcccgatctcagctcactgcaacctctgcctcccgagtttaagagagtctcctgcctcagcctcctgagtagctgggactacaagtgcatgccaccacgtgtatttttagtagagacagggtttcactgtgttagccaggatggtctcagtctcctgaccttgtgatccgcccgcctcggcctcccaaagtgctgggattacaggagtgagccaccacacccagctgcagtgatcctatttctaaacaaagtatattctgaggtacaggggatgagaacttaaacatatgaattttgaggggacataattcagccataacacggatgtggcttattttaaatctacacagtactgtatgcacttggaaatgactagaaaaatgtgaaaatcacagggcaacaagcagaagcagacttttccccctcgagtcttgtggccgcttctctgggggtgacagatttctttgtctctgaggatggatctggtagagggtgtatttagcagtgtacttctttgcacggggtcctggcagctgcagaagctgcgcccctttctccagcatgttaagaaaaaggtcagtgctggtaacgttctgtgttcagttgccctcttatctggaccctcgcttttcccctaaaggcatccaggagcaaacatgacatgcagaggtagactttgccaaggcaccgctatttccagaagttcttgtgggagagagttgacttcttactgttagacgtaacccaggaagaacagcaaataccggccaggccagaagtgcacacagttactctgttcctgttacggcattaatgctgctttcaggcgtggactacattgtgagatattgaaaatgccatttcctggagactagtattgatgatgaaggtctgacagcaattttaatgatgtttaaagggcagatcatcgccctttgcgtatttcgagatgaggatgcagtggggcagatgtctcagcatattgaatgcccagaaggaagaagttaggcccaacattaaccccaagcctcttccaagggctgctgagacttaacacccttcccaccgcagaaatgtcacctgacaggtatggctgcccaaggcttcctgggcttttttatgcttgtcttttttatgttatttgtctgtagaagtactatagccaggaatgactagaggaaggaaataggtaccattgtcccatcactcgaaggcagcccttgctaacgtcttaatgcatttcttcacagttgattctgtgtttatttgttgtgaataaatcataacaatacatattacatgctaagccttttgtaaatatttcagatgccacaaaattgtcttgtggaagtgctaacactgatttatctaggatcctgttattgaaggtttagtgtgtgctcaatatttttgtccatttcactgccgttttccaaagagaacacatccctttgtgaccctaagctaggttagagagccttgcttgacagtgttggatatcagtattgtttttggaagattaatttattagtgtcctttcagagcttgcggttgcctgtgatcttgaagtgaaatacttattcggtgacttttgtctggaatgcttgggctgattatacaagcattctccaggactgttcaaacccacatcatgtatagtgtatagtgaaagcaactaaattatatttgaaaggaacaaaataatattatctttacaacatgtgagaccaaatgggggacaagattggtgtcaggaacaatttggctgagtctgtttctcatttgtatgatacgttttcacccagcctgtattgtggtcactgaatagctatttttcatctggtctgctatattactagctcttctaagcaccagctaatgctattttcccgtgcaaaagaaaaacatggtttagaataaggacactggagctctttattgttgacaatgagcctttatttctcacatctaattagaatgtttcaggaggcgagtggtgagcacggtgtcgggggccgcattagctattgatttatgtgctgttatagaattaattgagtctggacatggagactcattttcttggacatgtagcaggtaatcatgcttctcctgtacatttgaattgctttccagatggtgtgttgtacaggatttatctttaatatgattgactagaagcaaaggacctgagtgtgtttgcatacatgctctgcaatgcaaagcccccagcccccactgtagagatggttaactctctcctggccacaccccccctgggctcatatggggacctgggccttggattgacactgtatgcagcaaagacagcgtcaaagggtcctggataaaggctctgggaggggagaaaaggcctatagtatattctgagggaaacagaataaacagcattacttattatgcaaaaccaggacataatgtgggttcagcaggggaatagttagtgtcttagtcagctcaggctgctatatcaaaaaacaccatagacttggtggctccaacagcagacatttatttctcacagctctggaggctgggaagtctgtgatcaaggtatgggcagattcagtgtctgctgaggtctgtctgctttctggttcataggtggccatcttctttctgtgtccacacatggtgaaaggggcaaggcagctctctggggtctttttcttctttcttttttccttccttccttcctctctccctccctccctccttctctctctctctctctctctctctctctctctcgtctcgcactgtcacctgggctggagtgcaatggcgtgatctcggctcactgcaacctccgcctcccaggttcgagtgattctctttgcctcagcctcccaagtagctgggattacaggtgcacgccaccatgcctggctaattttttttttttttttttgtatttttagtagagatgggatttcacaatgttggccaggctggtctcaaactcaagaccatgtgatctgccagcctcggcctcccaaagtgttgggattacaggcatgagccaccacgcccggcctggggtctctttcataagggcacagtcccactcatgagctccaccctcatgacctcatcactccccaaagaccccacctcctaatgccatcacactgggggtcaggatttctacatgtgaattttgggggcgatgcaaacattcagtctgtagtggtcagatgatatctattcagctgggaaataggatgtagccattaaaatgatacctatggagagcttgtgttgcttaccgcatgttaaaagagaacaacatggatttgtgtttacagtaaggtctcggctatgcaaaagagatgcacagataaaagactggaaagaaagaaaccaccaaacaaacactggctttctatgggtggaacaactgtgagtgggcatccattcctctctatatttcctattaagaacacagagcaaaacagattgtagtccttgttgctgggaagtaatgtgccctcagaaacagtcaccctctgagtacagaagtctgcccacatcagtttcacaaatgatgtgctagatgattagtcatatctccggctctctcctgccctcctacagggcagctgtccccatataacagttgtatccctagaaggagtatgcagttaaagtaattggagattctttgaccagacgttttgagagtctggcagcccggaaaggtgggatttggcagctatgtgggaccttccttcaggcactaaagggcttcctgaaaaagttgcttacacattgaggtgtgttaaatggaattctttatcataaggctgcaaactgcttctgtgcaaaaggcaatgtgttagttccttgcaggaatatgcttttagtgaactcaatgagataccagaaatccagtaggagaacactttctttgaaagaaccacttgtttctacctacgtttttgcccacctttccttctcacctccccttggccacaccccacttttgtgtcttgggaattatctgctgtgctctgaatagccccgtcctgccaggccacccacctttgcccttgtttgaagaagctggggacagttgtccttgctctccaccccctggagtaggggaagaaggcttggaatgtggtgggcctaggcttcttggtgagggccttgtatttgttgacaaggaggtcagatccattccctgggccgtcatcagagacctgcaagcatctacttagggcagagttttcaagtgcagtctttggacctccaacatgagaaccacctgcagctctagacctggcctttggcccacaaccttggaatcttgggccatgaacctgcacactctccaggtgggccttgtgcccaccaaagtgagcgaatcactgcattggaggagtgactcttggcttttcacaaggacctctccctgctttcctcagtccctccaagatgcacccatatcccactgcagggatgcaatttgcatacatagccagggacagtgtcatctggccacagccactcccagccacctgtgtcagcagagttccccgttcccatctaagacattcacctcatcaggcatctctcctggaccatttcattgacattttccttaactccctttatgtagtgtttatggagttcaggcctgcactggttgctctcttctttaactcgcttcaagccctgcaggcacatactgtcattttcagtttcctaaggaggggaaggccatctctccattaaatatcttgccccaggcctcacagtaaacagaggtctgaattgaaacaaggaccttcagtcttcatctttaacaggcgggctctttgtcttataccaaaagtgccccagtaggttccgtgtaattctgtggagtctttgaagacgtggctgccttctgggtagctgctgtgggtcccttaccctttgcactcatgggaaagagagctggatcagaatgtctgtggtgtcaaactcaggaaaagagctgccattagccagcgctagcattgtagtcatggtgaaaaacgggatcattaccagtccacagccaagccatattgcagcctgaggcaacaggaaaaatcaggaataccaatcctatcttcatttacaattttgatattttgttcatcatggatttattttgccttagttttgatttctaaagcattgcattaaaatattatttatttttgattgcttaggtttttggggcctccctgatctccccctggttcagccatcgtaaagtgaaagcattttcattgcaatgaggaataagtcaagggtgcctgttagtgccattgttaactcctcagggaagtgcagggcagggtagttagacaagatgaccacatgccggaaaggggaagcaaaatggtgacttctgaaagtgacatcatttacctagaaaaacattatcaactaaaaactattaggatttaaaaatagcttagtaaaatctatttttacaaaatcaatatcattttttttctgtatgccaacaataaccaggtaaatatataaggaagagatctattcgcaacagccacagaaatattatatttaagaaaaaacttaatatgagatgtctacagctataaagaaaattacaaagccgttgagagacatttaagacttcaataaataggaagatttttttgggtgaaattgggtaaaaagactcagtattgtaagtatgaataatttctgaggccggggcacggtggctcactcttgtaatcccagcactttgggaaaccgaggtggctgatcacttgaggcaggagttggacaccaacccggccaacatggcaaaacttcatctctacaaaaaatacaaaaattagccggagggtgatgacacatgcctgtaatcccagccactcaggaggctgaggcacaagaatcactttaacccaggaggcagagactgccgtgagctgggatcgtgctactgcactttagcctgggcgacagagcgagaccttgtctcaaaagaaaaaaaaattccctaaagtaatttataacttaaagttactccagccaaaatttcagtggaatattggggatacttggaaccactaactcttaagttcttttgggagaataaatgtgaaaatagcaggggaagatgacaaaatgagaataatgagagagaacttgccttatgtcgtattaaaatatgctctaaattcataataatgaaaatggcatggtactgttgctgggcagatagaaatgatgtagactagaaagtccagggacagatctaagtttatgtaagaatttagtgtatgatggctgggcggggtggctcacacctgtaatcccagcactttgggaggctgaggcaggtgaatcatgaggtcaagagatcgagaccatcctggccaacatggtgaaaccacatctctactaaaaaaaaaatacaaaaattagctgggcgtggtggtgcgcacctacctgtagtcctagctactcgggaggctgaggcaggagaatcacttgaacctgggaggtggaggtttcagtgagccgagatcacaccactgcactccggcctggcaacagagcaagactcagtctcaaaaaaaaaaaaaaagaatttagtgtatgacacgcagggtgaccagccatcccagttcctgtggaactgagggtttcctgggacatgagactttgagtgttaaagttgagatggttggtcactgtaaaacatgagaaacagaatagtctatttagtaaagggtattgggttacctgagtaaagctgtggtgcccacactttgctgtatattggaatcacctgggaaacttttatgaatactgatgcctagttcctatctgagacattctaggttcattggtatgtggtgtgacctgggcatcagggttttcaatgggtaacaaaacttgaaaatcactggggtaaccatcgtggagaacatgaagctgctccctaccttgtgtgtttacactttctgatgggttaaatatttcagtgtcaaaaataaaggattctagacagtgactggatttgcttgctccaagggaagaggtttgacccctcccatgaaaagtctggaacttctggagctagggacaggtgcagcacacagactcagggagtttcaggggagcaccttattcctgtgcctctaggaagggtggacattttccctggaagcaagcagatctggctgaggacagcctatctctgtcatacctaaaaaatacaggcacctcttcacatctcaacagtgaagtcccagatgaccaccctgactgcctccagctcaccataaaatcctctcccactgtatcttacactgcccagccatccaccagtcgctgaaagacatgcactggtgtctcaggggccctttgttgccagcaagagcaaagacaggtcacatgctatatcttgctgaaaagtgagttagtgttttggaaggtcaaatggaggaactaatttataccacacagaaaaaaatgtgaaatgggtgctatgagtgtaaagttcagtgatttggagggcaaattccagagatattccagaaagagaaaaaggccattagggagagaaataaaaaagaaatagcaagaatcttcctgtaactaaagtaagatgtgggacttgattcggaaagggctcaccaaatgaatctcacataaaattaatgagaccctcataaaattaaaaaagacccttatctagacatagtttgctggaatttctgaactctaagagtggagaggaaattgtatcagcttccagacggaaggaatagatttttgtaccaaggtaaaaagaatctgaatagtattaaaatgcacatctgcgagactgtaagctagaagatagtggaacagtgttagcaaattattgtgaaaaggatgcaatacaataatcttatacctagcaaaggtatcattctatgtgagatcagagccattttatagatacaaaagagttacctcctaagtaaacaaaatgactctaacaattatttttacaaaataaaaatgaaatcccactaaatagttcaagagaaagaaatgcaaaaagtataggaagcagtggtaagttatgaattgagtaattatagtccaaattatattgttgtcgtagtgttatacatctggaataaatttttctgaaatcatctgaaggcttggagagctaataggaaacaccagtggaaaataaactcctggttctattgtagttctcctacaatgtcctcagtgttttcatttttgaaaacttgaataacattttaataggatctggactgttccatgttactgtaatgtgtattttagtccttatgtcctatattggcctagagaatattttatttagtgttggtatacatatttatatgtgcatattacagattttatccccccgaatgacagagattttgaagttaagatagcaagagtactgtgtactttagtttgttctcttaacaaggatgtgcataccttcaacgtgcacagcttgatgtcagagcctggcgagaaacagggatgctgtagagatggcaccgctatgcaaggaatgggagctgtgtgctcatgtgccagtgatgtaccatctgccctttgccgtcctgacgtcaagacatggacgtctggttgcatgttagcagctgcattcagcacatgcttctgagagaccgttttgaggaatgtagttactggagattgtgtctgagagttgtggttgctaagtccctgacatcactcctgcagcctctctcttgtggctggctgtcctctgtgaagataagaaatctggtgacaagttatatgtggtctttgaggcagctcagtgttcttgatgtgtcctctgacacatctgggttgcagatgtcttagtgagtgctggccccttgttctcttctagggaacagctctttcgaattgtcctgccagtttcagggtttgcgaatggggtgacgggccctgcagggtccatctcagtgacaattttcctggtgtgggacatctttgctgtctgtgggccactctagggggagtgctgtgaattgctccgcataccagtgatgctcctgaaacacggccatggacaagcctgtgcaggtggcggagtaaacattgcttctttagatgtcaagtgtccttggagtgaattcacacgttggaagcatgtggctccatcagtaattgtgcccacactctgagtgtctggactggatgaaataattatctccttcttcgttcttttgggaatattcatactgctgtaaccgtgaccatctggtacactcagtctcataacaagatgtgttttgggcaccactacaaacaaggtgctgtgtttggagctctggggggatacacaatatggaaggccttgagtttgtggcctaaactaaagagacaagaggggaagaggaggtacaggaaggcaagatgagagcccgggcagtgactgctgagggtcactgatagctcctctttcatcttcacttcctgctcccatctgagcccagatccctttgcttctgccacctaaggtcctcactgagccacttctccactgtcctctctactgttttagtttaagctctccttttttttctttttaaaaattgcagtaaaatagacataaaaaatttagcattttaagcattttcaagtgtgcaagctcttaactggactactggaatatgtttttttaaataattgaactatcatgcaagcaaaaaggcatgtgtaatgtaagagtacagtttaaagaatatgacaaacatttggggaagcaattagctgaagaagtagaacgttgctgggcgtggcggctcacccctgtaatcccagcacttttagaggccgaggtgggcggatcacgaggtcaggagatcgtgaccatcctagctaacacggtgaaaccccgtctctactaaaaatacgaaaaattagctcggcatggtgggggacacctgtagtcccagctactcgggaggctgaggcaggagaatggtgtgaacccaggaggtggaacttgcagtgagctgagatggtgccactgcactccatcctgggcgacagagcgagactccatctcaaaaaaaaaaaaaagaagtagaacgttaagcaaacttttggacgtcctctgtgccactttcctgatgctagccccttgctttcccccagaagagagaatagccttttcactggtctccctgcctctagcctctagcctctgtccccacgccaggcccagagagacagggctaaaagaaaaaatgttgaaaatggctcagtgactgtgcacatgtcttagtctgttttctgttgctataacagaatacctaagactggttgattataaagaatggagatttgtttctcacagttctggaggctgggaagtccaaggtcaaggtgccagcatctggtaagggccttcttgctatgtcatcccaaggcagaggtgagaaggtgagggagaatgagaaagagagcaagagagagccaaactcacttttataacaaacccactctcacaataaagaacttcctcccaagataaagacattaatccattcatgagagcacagccctcatgacctaatcacctttcaaaggtcccacctctcaacactgttgcattagggattaagtctccaacgcatgaactttgggggacatattaaggccatagccgtgtggtttgggggataaagtgcagagtcctgggcactgggtccaggccctctcccagtttggcctgccaggtctctgcagctgccctgtcaccccacgatacctgcaggctgcggctgcaccctttgtcctcttctccccatggccgagcagtgctgtcccctctgctgagccctccagcctgccacgctggggacttgtgtagagcttttctgcacattgctcagcctggatggtccctgcgcatccagttcctcggtgaacattgttcagtttgagggggaagaggagggagaggatgggataagcctgaaggggaaggtacccaagatagtctttgaggggtcatggatttagattgggaagagttattgtccctcctcattggtcctcattatgtcttcttaatgaaagctgctcattttcttcgtgagagcaaacaacctgatcttctgaccatttgtcttggtcacctgggctacccaaactgagtgagaagtcaggaatgagccggtaggttcctggggagaggcgtgtgtcctcgtgagttgccggtgcctcccttgactgcttttcccggagctctgtgtgccctcgttctccttggtgtggatgcgtgttgttctgatgatgagttagcgggggtggggatggcgcactgtttgaacagatgtgccctcacatggctgcgggaggacgtggtgggaggtgctgtggtgaagtggccccacacatggctgggctttgtggggttttgactctgtccttcccaatgttcctccccacagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtaggaccctggctgtcctggggaagggagcagaggggcccgagagcaagggacctcagggtacaggccttgcagatgctgaagcgaggcggtggggggtgctgggtgcctcacagttctaatggtggctgagctcttcattggtccagttgggagacatgttgcgtggatgctccggccactcttaagctcaccgctcagactcaggactaaagccggttgagggctgagtggcaactcgtgtctcgcagaagacacccctcctcccaccctagaagagaggttcgatttcttgcccactgccctggtctgctcatggtggggcagtatgtgtgggagagcccctcaatcctcaggggtgtactcagaccagcagggcagtggcaaagacgtgggggtgctggtgctcacccactgctgcggccagtgttgggtggcctggtggctggggtcggggccagagtgcatttcacaatggacgggtctctgaaagcccgggggccttggcctgatgggcaatcagctgtgaatacctatttggaaaaggattttttgaaggtttgacaaaacctcggggaagaaacgcatgctaatgagggcagtggatgtcagcataactgtattttaattatagcaaagtcagcgtgcattctaataaacacatttgaaaagccaccttccaaaaaaagcctcactgtgagtatataaagaagatgtgattattggacttgtgtgaaggaacttctatttggccaattatgtggacttctgtcatatttttttacagccttaactgttaaatatttttttccgagaagagttcatgaatttgagtgtgtgtgtgtgtgtgtgtgtgtgtgtgtgtgtgtgtgtgtgtactgagagcttgggtttggaatggaaatcattggattttcagcacttatattttaattgactcctggattttcagcacttgtattttaatgtcttgtattctctctaaagaacgttaagtgtcagttgacttcactttgggggtgttcctgtcattcacagcaattccgtgtttacagggggctgtgggatgcataggagctcccatggtactagtgggtgttgggagagttcacccctaaggccaggaggctctggaccctgggtctgggctttaggccaaagcaaagtgtttctttggtctttagcagggcctgggcttgtcccacaacagtggtgaaggcacctcagggattgacgtgggctgtgcagagcgtgtgacatgctgcgtcttattgtgacaaatggcatcgctagccaagttcttgtcaaagaagattatctttagagcgtggtggggagtaagcaagacctgatattttctggttttgtgcttcatgctaaccagatggtaatttgggtaaaaacacagagatcttgcgattggagagctgggaggtaaatgagtgggaatgaatggatggatgggtgatagtagctgtttaaaagggcaggtggaggtaggggaagtccccagccattgtggaggatcaagaggatgtctgttcttcccagaagaggcattgaatgaaaaagtatgtcacttctccccctaaggagaatgtgtccttgaaggacatgctcttgtctgagacactggaaaagttcatttaaactggttaatgattgtatagcttttgttttgttttgtttttccctccctccctcctttctgtcctttcctcctttcctcccttcctcccttcctccctccctccctccctccctccctccctccctccttctctccctccctccctccctcctctctctctctctctctctctctctctttctttctttctttcctatcagttcacaaattaattctgtcaaggggaacacctgctagttccagagttccaggctgacaagtaccctggtgccaggggccctgactactctttctgaagactctaccaggcccgctgcacgtgggcagggtctccacattcttagatttgagtaccccattccagatgaggacctctttgaaacctgaccagaaagagccgtagaattcatcttgaaagcaagattttttatgaaggatgtgcactgggagatttggtgctgccttgcttgaaataacaacctgctttcctaagaacaatccccttcctcccctgggggacagccaggccgtgccaggagccaacaaaggcctggcctcaagcaggtgcacagggtgccatgtgtcccatgctcacctctctgatcccagtgctgtccacatagtgtagtgatccctatggttgaggctgcagtaaaaaaaaaatctgaagggagaaatgggcaatattggtcacttagatgctgtagactcctgtttttaaccctaacccagcagcattggcattactggggagccccgcccccacattgctgaatctgaaatctgcatttcaacaagatgccacattccagctgtgatgctgtaggagactcacttggaggaaattgtgtagcaaccctcccctctcttctactcattttacagcttgaaaaagtgtgtcctggatattttgaagaggactgaatagcatttagtcattgcacgaatggcaatagtaaaatagagttagaaaaaatgggaagatgaaaaatgtattctccatggtccctactaccctaacggatgagctatttcatcagtgtgccttttcagaccatagcattgagcataaatgatgtacgtagctgtcatcataacccagatgtatttttgtcatacagtttttaaaatctgatgtatgataaatgtttctccatgtcaccatataattttcatgattatttgtagtgacctttccatgatccatttgggcgatgatgtgctgtataacatatttctctgtacacactctaccattgagcatgcagattgtgagtggcattttctcttaggtgtaaggctgccacagacatctttgtacaaaccatgttttccttctttggtttattacctgaggataaatccccatgccgtacatcaacgttgaccatttcccctcgatgaccttgcctaattgtttcccttcttctgtggatgttggatgcatgccctttatcttttggggtttggatgcatttccatctcatagaagcactctctacactgtaggtgtgacttcctgttgcgtatgtcctcatctttagtacattttcttttgaattttggttatattattttcaccatctctgcagcatttttaagatgttaatgactcatctgtgacccctccacctcctttcggtacagagggatttaattggatgtttccttcttccctgtctgggtagatgtattcacagaggacattgctttggtctggtcgatacgaaaaatgagttgccggctgggtgcagtggctcacacttgtaatcccagcactttgggaggccaaggtgggcaaatcacctgaggtcaggagttcgagaccagcctgaccaacatggtgaaaccctgtctctgctaaaaatataaaaattagatgggcatggtagtgtgcaccagtaatcccagctactcaggaggctgaggcaggagaatcgcttgagcctgggaggcagaagctgcagtgagccgagatagcaccactgcactccaacgttggcaacaaagtgagactcccacctccaaaaaaaaaagaaaagaaaaatgagttgtgcctgtactaagaagtaggttgtgtggcctttggagccctcctgagctgtaggatgccatgcattttgaaaaggctccagtttgcagggagccctcccacctgtgccactctgctgagaccaagaggtctgcccgggggctgggatatgagaggcacaaaggtgatagagtttctaaaattgtaggaagacaggttggggaacagagatctacacttgaattattttagtaaaataaaaaaaggttatttcaaagcactgcaagtttactgaggaaaatttggaaaatacaggcaaaaaaatcttttgccatgtggcattgtagaattccactgtagagttttcaaatcaaagagacaaacctaggtcaggatttcccaaaacacgctcttagaggtgttgtgtaaacaaagtaccatttgatccttactattcatggatttgatatttgcaactttgttaacttgctaaaattgatttgtaaccctgaaatcaatactcgtagcactttcccagtcatttgtggaggtacagagaggggaagaatttgagtcacccaactctcacgttcccagctgaggttgaacaaggctttgccttcttgtttcagctctcatactgtaaacagctgttcttttcacaatctatttaatgttctttgcatttttgttgatatgtgtgtgtgtgtgtgtgtgttggtgataaaatggccctcaagtgtggtgctgaagcctagtgatcctaagcacagaatggctgccatgtgccttacatgtgctagagaagcttccttcagggctgagcgacagtgctgactcgtctatgctgccactctgggaggtgctaaagtaaacttctgtagcgtatgatgaagttaaggaaaaggtggaggaatggctaaatttgcagattcatgggacaataactgattaaaaaacacatagtggacaggtagaaaacccaagaactttactgtcttgtgatctagggtcagggaaatgttaaactcttctcagctagtgttttatgttaaagaaatattgcatataattaattatttataagaaatctatattaaacaaggtgcgtataaacagaaacacacataaaacaaggttctgtgttgattcattgacaaaaatgtgtcccgaggctcataggaacctaaccctgtatcgcccctaggagcaatgtattcagtattcatcaactcagtgctcagggcagctttacagaacataactatgtgaatgagaattggttgtatttggttggcaaatgactttgggaaactttgctgcaaagtttttcccttcttgggggtttactgatttctcacacacaagtagcataaagtcccacgttcgctatagcggagacaccagccagcctggccagtgcttcccaaacatggtgtatcagcaagcccttttccctccatgcagggtctgtgggagaatacagacccaagctttacaccctggggagtaaaggacccgtacacatgaactcccaaggcctctccctgtatgcttcagttccaagatgattcagcaaccccaaatggtgatgatggaaaggttgtcattgtgttatcatcaggacccttggcttctgcagatttaacctttcttattttgtggtttgtgtaaagtccgtgggtgccggtggaggtggcagcagtgttggcggtgactgccagcaccatgttaggggtgttaggaatatgatcgcagtaaatcctagagcaacccagagagagggagctagggttagtcccgtgttgcagatggcacagttaagtagctcacctgtgaatagactgtggactgtgttatgccaaaacccgtgcctctgaacagtgcataacacagcccttgaagaacctgagaagagaaagcgtccagttctgttcagtccgcgtttgagcctgcctgctggagggtgagtcagtgtgggggaactgtgcagtgttcctcctggagagtgatggtctcttctcctctgttgtctgtttccttgctgttgaaaggcttggcgtgccctgttgttctcagtgagtgggatacggtgccagtgaggtgaccagtagatacggaagcctccggtctgtaaaatgtccccatctcagtgctaacgtgtcctaagttcaccagggctcaggccacagatcaaacaagtcaagtaaagattgttcatgtggcatttttcttaatttttttgagctttgttgacataacgtattgattttttttttcatgcagtgattaaggaatacatgagttgggtccagcaaggctcgtattgtgtgacctgatggaattagtattactacacctacccatgtggccctctactatcaggcagtgaagcgtgagtggagggaggaccccagctgggcactggtacctggctcagtctcacagctccagggatgagcctgtggacctggcacgtccttggtgccttcccttgaagagagtagtttgctcatcagtgctttccctggggcaactcacccacactcctggggggcaccataagagcgtttgtccagcaccaaagatcctagttctgtgggtctgtggggtggccctggatggcatgttctctggatgcctctgggtggcctgtggaacataaagggtttggcgagggctggacggattgttttggagccccatcccacctgttaccttgtgacgtctatcaggagatacactgaaaaggtcagccctgcctgaaattctccctgtagagacttactcctttggaccttggagatttctggagctgcaggcattccttgtccaggacctccatggctaccgagttgaggtatttgatttactcagcaagtgtagaatagctccacaccttggaatggcaaaccaaatatgcgttttgattatttggggttttcatgatttctgtttatccctgacccagctggtgctttctagaaagagccttctgccaatagaaaaaagaagaaaaatcaatacatggtagccaacttaatacaagttaaagggaagcatggtcgagggccccgaggccacatcgaatgcagaattgtgcatcattgctcattgtagagatgctttggccgtgacttggcattcagtagaggcttgctttttgaagaaccttctgagagtgtgataggagtctggtgccaagggagagaaggtgctaaaagcacaggtaactgggtgtgtcccccaggtgggaggcagtggtaccgtgtgtgttctgagccacggcctcacacacatgccccgctgggcagcatatgaagtgagtgtcagtatctgctttacagaagaggactgagacaagagtggcatggggttgttggcacccaggcgccccccctccatcagcgtgtggtggggcagcaggtgtgcagatggggtggtcctgcacagaggggctttggggcttgcactgcgcccaggagggagtggtctggggtttgtctaaacctggcccacagtaggatggaacttgggaaagagcctgtaggtggtgctgagggcagggggttatggggggcattggggcatggtctgcctgggaaggggaaggtcctctccagcccccaggcctcagtggagtagtcggctccctcctttctgcagccatgcctcagattctagtgtcccttgccccgcccacccatggcgtcaggcctagcactcctgctctgcatacggggaggctgcacgggagggttcttggggtgctcctgtgtcccctgtcgtctgtactgaaccccttcccgtgcagctctgctcccagcactgtgacagggtggacaccgcacctcctgctactgattcccaggattgccttgaaaaataaaatcctacgggtgtgcattgacgtttcaatcctggctggctccgcatgagcttctgaacttgatgttcagaagctcagggcccatttgctgagtcagcacagctgccttctttgatttgtatgaagccttttgatgttttgatgacatgtcaccatgggtggctgttattttcagggagcagtttatctatcaggatctgggattgcttcgggtacttttaaaatctaggtaaagccggggtttctaaaacattgttctaaaacattgtcagggcagagcatgtaaagctctcccactaccactaatagtgatctaaaaagtgcctctcccctcaaacacaccctagtcctcggggagaaagcagagtgcggtggttaggaatgctggagccacagtcaggaagccggcatcccacccggctgcagcagcttggggcccgggaacattctggatgggccacctgtgccagcagccccccatctcgtggggctgtggggaggggagttgatctgggtcagtgtctgtatgggtggggaggggagttgatctggtcagtgtctgtatgggtggggaggggagttgatctgggtcagtgtctgtatgggtggggaggggagttgatctggtcagtgtctgtatgggtggggaggggagttgatctggtcagtgtctgtatgggtggtgcggggagttgatctcggtcagtgtctgtatgggtggggaggggagttgatctggtcagtgtctgtatgggtggtgcggggagttgatctggtcagtgtctgtatgggtggggaggggagttgatctgggtcagtgtctgtatgggtagggagggaagttgatctggtcagtgtctgtatgggtggggaggggagttgatctggtcagtgtctgtatgggtgatgcggggagttgatctggtcagtgtctgtatgggtggtgcagggagttgatctggtcagtgtctgtatgggtggtgcggggagttgatctggtcagtgtctgtatgggtggggaggggagttgatctggtcagtgtctgtatgggtggggaggggagttgatctgggtcagtgtctgtatgggttgggagggaagttgatctggtcagtgtctgtatgggtggtgcggggagttgatctggtcagtgtctgtatgggtggggaggggagttgatctggtcagtgtctgtatgggtggtgcggggagttgatctggtcagtgtctgtatgggtggggaggggagttgatctgggtcagtgtctgtatggatggtgcggggcatggagtgcttgtgcagatgatgatgatgatgatgagttttcagtccatgggaagctcatcgggtctgggggaggtgggtgggcaagtccctgcacccagtttgggtacaggccatgctgggcaggggtgaggacactagtggacctgtcctcgggagtgacacaaaggaggtggtgagccctgcttgtgagataggatgagaggaggaccaggactggtcagggccacactggagctgctgggggtgaggtcgggtaagggcctcccaaggtgcccccacgctgtcccctctgcagggccctcctgaatgtggcttgtgccctgctggagaagttctcacatgcctctttctactccagagtcactgatttgggagatggggcaacagctgcacagccccaagggctgccctgattttctcacaccgaatatctaataggaagttagctgagaagcccacacacctcttcttccaggtaggcaagctgggcctgggactacctgtctctcaccgactccaaatgatagccaagcctctcttaaccttgggcaccttttttccagtttccaccccgaattcacactcttcaaagccagctcctcctgctgggctgctcctgatgtggggggccggccctccctgcaaatctctggcatggcccttgcaaattggcacctgccacgtggttggcactgggactgcaaaggtgaaagtggcattatcctgcatttgaaactcattctagagggagacggatacatgagactctccccgcccccatccaggtgtggccaggctccagacgagttccaggcaggcttccaggacaggctccagagttagggacaggcggagaggctctgtgactttgagaggggctttgggaagtcagccgacaaggtggggatgaacatagaggtgtgtgggtgtcctcagcatggaaggggctggaatcgtgatgtggctttgagcctgaaacaagacaaagggaaggcgagggacatgggttgggggatggtgatgagagagagacagagggttccactgggggcatggaggggagccaggagagaactggggagctgaggggagggacattaggaaggccagatgtagcagggcagttaggagatatcttactggggaagaaagcacccgttggcggtggccacctgttggcggggtcccctgagcctgagcagctctggtggattgggaaggcagaggcatgggaatggtagatggacagtgtctatagagacttgcacggagggcccaaggaggtgccagcaagccgaggtgctcatagtgtgtgtgtgtgtgtgtgtgtgcacgcacgcttgtatgtgagatattgacttgcattgtactcatctgccggtggggtgtctagggcagattgtggggagtgagagcattgggtatgggacccaggctgtccacgtgcgtctgcttcttgaggccccgtacctcccgttcttgggcctccgtgacacctggcatcatgcctctcttgcaccagaggcttgagagacacccagttggcaaaatcagttagtctgtgacattccctaggaagtgcagggctcggtgcaagaagttatagaagtatctgtttaggaagaaagatcgcatggctgaacacgctgagatgcgtaatgtcacccatggtgtgcttgcccaagatgtgatagcgtggtgatggcagacatgggagttttaccccaaagcattcagatcacaaccagtgccagtcagttactatgaagacatgtgactatggtaatagggggctgacctattagaataactcctaatcctatgtcagataataccatgggcagctcaagaaaactacgcacaactcagacatgtggagaaaggagatgtggaatggaatggagccctctgggctgatagaggcctccaggacttgccacacccacgtctgcccccaattccccagtcagccttcacagaagagaagttggtctctctccagctgagaccaagccaagacccaaagtgctggagctgaaggaagtttgggctaggctcacagaagctattgtcccctcctccagtgtcaacagctacccatggtccaggcctccatctggtcctggtccttttaagagacactgggtgctgactcacttctgggtctgtcccacgggtggcctgcctggtctgctgtgggtgcagccagactgtgcaggttcgggagcccgaggtggacttcaggtagggagacgctgctccccaagagctgctcgggtgtgacgtcagggtggaggctgttgctgtgtgtggcggcatcagtcatttaccctctttctcattagcccctgtccttcggcccatgtgcttgcaggtggcctctgattctgcttctggagactgtctgccccctctgattcattcattgcggccccagttatgtgaaagatagcatgttcattattcattcattgggccccacttttagatatacttgtgttcatcttcgagagagggaggtcatccagccattccccagtcctcaaaacccactccacaggcaaagcagtggtgggtcagggctcctcttgctgcattgcggccttgtatttgctcttctgagccacaagcatagcgagaaagtacaaaagaaaaggatttcaatggtattcaccctgaaaaaggaagaaaattgtgacacaggctgcaatatggacaaaccttgaagacgtcctgctaagtgcaatgagccagtcacaaaaggacaagtactgtgtgattctacttctgaggcacccacagtagtcagagtcatagaaacaggaagtagagtggcggtggtcaggggctggagagagcagggagtggggagctggtgtttaatgggtgcagaggttcagttgtgaagatggaagcattctggaggtcatcggtggtgatggtcgctcaacagtgtgaatgtacttaatgccactgaattgtacacttaaaaatggttaagatggtaaattgtatgttatgtatacttaccacaataaaataaataaagaaaagaagaggtttttcagtgaataactggtttgaaccaatttggatcctctaaaaccaagttgagccagtctgaacccatgtagccattatcacaccgtgttaggctattcttgcactgctttaaagaaatacctggggctgggtaatttataagaaaagaggtttaattggctgacagttctgcaggctgtagaggaagcataatactaacatctgcttctggggaggcctcaggaagccttcaatggtgacagaaggcagagtgggagccagcacttcacatggtgagaatgggagcaagagagagagtgggggttggagggggaagcgccacacacttttaaacaaccagttctcttgtgcactcaaagtaaaacctcacttactaccaaggggatggcccacatcattcatgaaagattcaccccatgatccagacacctcctaccaggccccacttccagcattggggattgcatttcagtatgagatttgggcagggacaaatatccaaactatatcacccacaaagaagcaaaaacattttgggccaaatcaaaactatttagatgtagccacagtggggatgaactgtgattatacccattcaggcctgtggacctgtggacctggcgtgtgtggtcgtgaggcggtgggtcggcacatccctgggaggtttcaggaggacattcaagaccaaaatgagccatgagtaaataacacaaccacatcctgagtgggagtaggggagcctccccttctctcctaggtcttgtatgggtcatgatcccgccttggcaggagtggaaggaacagatcccacaggctgtggcttatggtaaagtgattgtggtcatgccttgtgagtgtcattaaaataaacatatatcgttaaatccaccatcaaataacagctatttctgccatcctctcgccttttccacaagtttaaatatcccagatattctactgtgtatattcctaaaagcagacaggtagatttagtaaagttaactggatcattggtaccttctttatagatcatctggtgaaacttgtttttcaaattatgagttgtagggctttgttttaatgtctgtagccttaggcagttccattgagactaagtttttttcttattaagactaatcttattgactggaactgtggactcctcgtattaggagaacagagatgtggcctacataaattagtggaagttaaatactgtagaaaatgctctctggaaaccaaagtctaacatcgacttactactggtcattcaatttccttttggcttgggcaccatcgttacattcatttttcagatgtcaagctagttttctcagaatgtgtgcagggctcgaggccaagtgtggaggccacaggggaggtcacaggtcaagccttctgggagaactgcaagcttgagcctctgataaagtcacgcgattgaattttagccccagtaggttgctgtcgttaaactgtgcacacagggcttcttgcttttaagttagcaggatggaaaaattgcggatgtttgcagcaaatgtgtagaaccagtggcagaagcagccatgctggcccctaagcaatggtattagaaagggttgatgaagattttctcatttgagagttgaacaaaaccaaatggaattctccctagttccgcagcactggtgggtgactctccctgggccggtctcagccctgcagaaaggggcactgtctgcttagcttggtcagcgcagggtctactgcagcagagtgccaggtggatcacagccctcttgtgggggaaggatgggcggagctcccaccttccccacaaatggacacagaatggcacctggtatgtgaggcaggtgcaggtgaccaggagaaggggctgtcagtggttgatggacagctgcctctgctgcctggatgacccaccccctcccctggaccatctcccactttgcctgggtgtcagtcactggagggttagctcagtacaagctggcggatgacctccgtagagcttaggtgaaggggctctcacagggcagtatgtttgagacccttagagggctctctttactcttgcttctcctattatttttaaactgtagtaatacacacgtaacataaagtttaccattttaaagtgtacaattcagtggcatttatcacaatgttgtgcaaccacctctgctctttagttccagaacattttcgctgcccccagaggagaccctgtatttattaagcagtcactccccattcttccctccgcccccagcccccacagtgaaaaatctgttttctctcactttggatttgtctattccggatattccataaagataggatcagacaatatgtgccctttagtgtctggcttatttcatcatcatgttttcagggttcatccctgttgtagtgtgtgtcagtactttgttcatttttgtggctgaatgatattccactgaatggctattttacattttattaatccactcatccactgatggacatttgagttgtttctaccgcatgattaatgtgaatagtgccactgtgaccatatgtgtacaagcttttgtgtagacacttgctttcagctcttttgggtgtatcactaggagtggaattcctgggtcatgtggttattcagtgtttaccgtttttaggaaccacagatgttttccacagtgacagaacattttacattttcaccagcaatgcatgagggttctgattactttcaaaggaaaaaaattaagcagccctgtcaccttgatggtttggtctctggcctcaccgcttcagctcctctggcctgatctcccagggcctgcttttgttcatgtgtgtgtctgtttataccctggctcatcctgtggagggtctgaggctggcaggatcactgggttctgtctccacattggaaggtgagctgtcctaggtcagggtctttgttgcatgcatcgtcctgtccttagcaagagctaccctgtgccatatgggacatacaacaggcacctgttcaggcctggccatgtgggcccacctttggatggtacttgacaaagcctcaaaatgcagtgacaagtttagataaatatgattctgttctgaaatgctgcactggacacagccatccactgcctgccctttacagggctctgtgaagagacagtgaacaatgaagtggaggacgtgtgcaggtggccccagtggtcggtgatggaggagagatttcagcagaccaagcacggagaataaagccaggccagagtgtgctatcagcctgtctgccccctagagctgatggactcagcaaataacagtatagggtacccagttacattcgaatttagacgggtataggattttggtttttcaagatgaaaaaacttatagtggtgagggttgtacaacattatgaatttaataacactgaactgtacactcaaaaatggttaagatagtatattttattgtatgtgtattttaccataataagcaattgaaaaaataagttgtatttcaggtagatagcgaataattttttagtataaatatgttccatgagatgtctggataccgggatgcaggagggactccccttcctcctcccattcacaggcctgcctagagatttgtaagtacagactgactggctgtttttcccagtgtgtcttgtcgtgatacttttaagccacagatccgctttgaaaagatatgatctcccccaggggagtaactattataagaacaaatactctatccaagcttccattctcctcaagataaacatcacaggagtgacctgaattgtaaagaggagtggaaggaaaagaacaataccgtaatgttttctgagccacgcagatgtcaggggacggatccaagggcgtctgaaagaagacgtccacgctgctgagtgagaccttcctctgtgctgctgagtgagaccttccatctgaccagggggtcatgctctcactgctcctgcttggagttctggtgctgtagcgggtctcggccgccccttctgagctgggtggaggaagaagtccctgttgaaatatcagatgagtagggatgatcgcctcttttgaaaacaggagccgtgaagggattcccagagaagattgtcatctaacggagtcattcgtccgcccaggacttctctgtcacagggttacgtttgggagaattttcacaggccactggggatggctgtggctagcctggctttccactgatgccctctatccctaacctcagctcctgacatggctgtcattccagagagtgcttggaagcatcctgactatgttgacgatggcctgagcggagtgagtgtgcactagtttggtgttgtttcatccaaagcaatgtgattatattgctgtactttcagtttcatcaagcaggcaaaatgagaattgacactttttaaaatccaagctttagtttcaccacctggagccaaggtgtttattagaaagatttattggcattagtgtatttttattacaagcatttatctctgtgctgaacagttgcccctgagtcccgtgtgctgtgaagagtctgtgccacaccacacattaattttctgtcctcagagctccggggacacacgctgattctcatgctgtgcctgccgccttctccgagtgatggctgatgtgggtttcaggccccactacagttactcagcgacagatgggaccccgtgtcctctgttggctgtagggagttgaggcgaccctggctggcatcttgttttgaggggtggctggctgctgtactttggggagggcataacaggatttaaatagtatctttatctaggatgcctggagccccaaatccatgtgggcctcccactgtgtgaatttcagatgctgccagccccccaaccccgccacccctgagatggaaattagagcaccagatgggctctcccaaggagaagcatcacaagcccaccctcctgcctctttggaaagtaaccctggctgtttattgtgagatgtggttgtcatggtgacaagtggacacccgcttgggagggagatagaggaaacgctgttatggaggaaaggtcacccctagagacaaccttgtgttgcccgtggacaccccatactatggcctccgtactggggagtcccatgggtagggcatgggggtgcagccatcagtctgtgtccccagccaagccttgagccctggcttgaagttgcatgaaggtacagtggctggcccagccctaacccgtggtggatgcagcccctgttgtgtcccccaacccctgacttatctggccgcctgatgagagtctgtcgccctacatctgtggcgctccctctgcctgacaaattaaatcccgcccagcttgcaggagggatgttgttaacctgatttcatttgctggtgggctggttgatttctttggggtttttttggagatgaccagcacctgtccagcaactagtaaggcagggaaggcctccaggaacccaagtccatgcagaagggcactgtgttggggaactttcagacaagtgggtaaaataccgacgtgtgctatgtgcaccttgaaatagcaaagtgtcctcaacagagctctctgggggatgtcccaaataaggtttactttaggagaatgtgagcggcatctgaggcgagattctcttgttgcatcctttggaagcttttgcttggtgttccttggccatagcaggaagatcagtgccagggatgggtgaggggaagaaaccttgcaggagcggtacctgggccagtctcagccctgcagaaaggggcgctgtctgctccacttggtcagtgcagggtctactgcaacagagtctcgggtggtcacagccctcttgtagggggaaggatgggttttgctcctgggatgctaggcttcgaaaagcagggcagtgtgccagcagtcccagacaaaccagagccgggcctttggtcatgccaggacagcagggtgtggtctggctaggcctgtgagcccctgtggggctcaggggtaggggcagcaggactgggggaggcagggaccaaccagacttcagaactgctgggtcccagctgcacccctgcaccacctcagctctaggaagggcagccccatgtagctttcttgagatgtagcagcagtgctctcccttctccctcgccatccttaaagcccggtgcccgctcccctgcatcccccactcccattgcctctgaaatccggtggtgtctgtgatcctggaggggaggcttagccagcaatcattccaactacctggggcacggcatatctgcccccatcagtgctgggagggtgggcccagatcctttaatttttctcaaaaccccagagaggcagagttccatcaaagagcaagacactgatagactaggacaggggatagggctggcagccatgcctcgtggcatcacctgactccgagagaagccagcccaacacttggggtctcagttttctcacctgtcaagcagggggaagaatattcattgtgtacacaagaggcttttgtaaaccctaaggtgctaggtaaattaggtaaatgtaactttttttttgagactgaatctcactgtgttgcccaggctggagtgcaatggcgccatctcagctcactgcaacctccgcctctcaggctcaagtgattctcctgcctcagcctcccgtgtagctgggattacaggcatccaccaccatgcccggctaattttttgtatttttagtagagacagggtttcaccatgttggccaggctagtctcaaactcctgacctcaactgatctgtctgccttggcctcccaaagtactgggattacaggcgtgagccactgtgcccagctggtaaatgtaacttttatcatcagtgtcttccttgccatcatcatattgttatttctcgataatttatttccagaaagttctggaactggacttaccatgcaggctccggaacctcctctgggaggtggacagggatttaagggctatggatctggcttctgtcttctggatgatataaggaactaaatagagaaaatatacctaaccttaaattttattaattgaagtagaagcagttgtagtttggtgtcttctttaagagaagacttatgacatgtacttggggcattttctatgttgtagtaacagattggctaatttgcatttattctcatccaagaatttaggttttttaaaaatatggcttttaactttttgggcactcttggtgggaacgtaaatagtactactgctgtggaaaacagtatggaaggtccttaaaaactgaaaaatagagttatcctatgatccagtgatttcacctccaggtatgtacgtaaaggaagtggaagtgaagactcaagagatatttgcacacccacgttcatagcagcaccattcacaatagctaagaattggaagcaacccaagtgtccatcaatagatgactggataaacaagaggtggcatgtacacacagtagaatgtgattcagcccttaaaggaaggaaattctgccatgtgcttcaatgtggacgacccttcaggacattttgctgagtgcaataagccagttccaaaagggcacatactgactgcttaatcactccacttacatgaggggcatagagctgcccaattcacagaaacagaaagtagaatggtggttggcaggggctcaggttggggttggggttgggcatattgaggagtttgtttaatgggtacagagttttagttttgggaagaggaagacattctgaaggtggatggtgaccatggttgtacgacagtgtgaatgtacttagtgccactgaactgtacacttaaaaatggtcaaatggtgaactttatgttatgtgcattttactgcaatcaaaagataacaaatttcaaaatgatttaaaataacttttttagaagtatgaaaatagaatattaagtgcatagcagtttaagtataattaaatagacgtctgcacacacacctatacacatacagacatacacatgcattttacaaaattgtatcacattgcatattcaggttttgcatcttgcatttctctaacatataaaatcacgatctttaacttccccgtttccaggtttgcaatggtctggagcagccaaggaagcagcagcgctctgatctcaatggacctgttgacaataacaacattccagaggtaatttttttcaaggatgagagttctgggctggaacactcatctaatgatggagtggcccaccgagttgtggtctgctcactttgtccatgatgttctcatcccacccggtgcctgggggagagggagtccaggtcaggccaagttggtgtcaccatatggtgaggaggtgagggcacactggcctgggaggagggaggagagggcctccctgatgttaggaccatgccatggagtgctcttgtgttgcagatggtgtgtgtgtgggggtgggggaccattggtactacttaattttataaaaagccattctattcattgtctgataaccatgttctaaactagggtttctcaacaatgacaccattaacattgaggcctaggtaatactttgttttggggactgtcctgtgtattgtagttgagcagcatccgtggcctcaacccactagatccttgtacctaccccatccccatccctgatttgtggtaaccaaaaatgtctccagacattgcctaatgatgtccctttgggaacaaaaatcatcccagttgagaaccactgttctaaatcaacaacaggttttaacaaacaatttcctataagctaacagtgctatgatggaagttatttcccctttctggtaacatagtttagatgagattatttaactttgatgaaataacgatggccaccgatggagtggtatccagtctcctttatcttgcttttaaagatgggcctggatggctctcatgccccctggttggagcgtcattgtgttggatggtccctaggctcccttctagtcaagatatgctagtctgagggcccctaagttttagatgatgggcttttgggccactccccaacatcatgttgcctgcagcagactggtttcctgtatggagctgacatcttcagaacaccatcactcatggggggtttgcttttctcattatggctcatatcacagccctgcttagccttcaccttgtgggctacctacttaacaattgttatgtgttttatttttccatatttcctaacagacaaagaaggtggcatcatttccaagttttgtggctggtaagtgactttgaattttatttctcaaggggcagttgcattttacatcaaaataaatggtgcttttagtttgggcattcacctgcaaagcttgtttacaaagcgtgcctacctaccagcaaggtgcttggccattgtctgtttgaacactgtgtagccccacttagtggggaggggaggtccagctgatctgcccgctttgatgcaaggaacagtagacgatctcctttaattataccctcactaattgcatcacagacgacactgatgactgaatagattgagatgtgtctttataagcagctggttatagctaacacttctgatcagggtggatataatgcattcaaattcaggctttttttttttttttagatcctttgtttttctttaccgttccaccctttttgaggaggttaatagtgcatttcaacattcagtaaagaatgaaactggtcgatatgttctgtgtcactcttggggatggggagcacacttgcctggctttgacggagctgagcatctggagaccttgcagggcccctgtaggagatccactgggtttgcttctagtgctccaacctcagagtaaagagcttgttcggcaggatttctgtctttgccaggaggatgtttcctgcccctgctaatgtgttataataaacaatgtgaatttcattaattctttcaataagctggtaattaattcttataaatatttatgggagcaaggtaaattagttttcagaaataaatgactttcagcccttcccatgctgcttttctttttttagcaaacaactaaagcctggggaactgaagcccccaaattcgcctttagagaactagtttgaaccaggctaatccagttccaattggttgaaactggattaactggctcaaatcaattttgactgttataactggcttaatgctgctcagattgggtgagaatctgttttaaaccatcagaattaatatcatgcaattgagatagacttggttccattttgaccaattcagataggctaaaatgggttttgcccagcagtttacatgtggttttaggtacattttatctggttcaaattggttttcttcaggccacagcaggttatgatgattcctggaagagaccacactccccacattcccgcttgtagtgtttgattgggttcctggtttataggagctggcacctcgtgagcagggcgaatgcagtacgtcactgtgccattttccttggcaggcagaagccagggtggggttgccagtcacactgctccagtgaggcagggtctcctggatccaagaagctcacttgtcagtgtatcatagtgtcatctggacagaactctcacactaggaggtgatttagacattaaattccccgacccttgaaccaatctcatatctgcagggagtgggatcgtgagggatcgggaagcagtgtcagtgcctggggtacctcggactctagctcctggcatcccagaagacttggttccctgcaccactcagactgttccaaagcaaatccaaacaaggccggtggcttaaaacaattcagacaggctaaaactgctgtgaccagctagaaccaatgtggaaaacctgaatttatagtttcttctgtaggagagaagccctttgattgttatgaaaacatagaaaactgaagcaaaacaacatcctttactattacagcatttatatgcagcgaggccttcatggaccaaaatcttactcagcaacaggaagagatcatcataatggtgatgccaaaccctagaatataatggatatgggaaaagtttctccaaattaaacaccgttatcagtttgaatgcctttgggtacaagtatcaaaatccccacctaacgttacacaaataggtgtgtgtcttacataaagaagtccagggttggacgtggtggctcacgcctgtaatcccagcactttgggaggccgaggcgggtggatcatgaggtcagcagatcaagaccatcctggccaacatggtgaaaccccgtctgtactaaaatacaaaaaattagccaggcgtgatgctgagcacctatagtcatgctatttgggaggctgaggcaggggaatcgcttgaacccaggaggcggagattgcaatgagccaagatcacaccagtatacgccagcctggcaacagagcgaaactccgtatcaaaaaaaatataaaaaaaatattaaaaagtctagaggtggccaggcacggtggctcatgcctgtaatcccagcactttgggaggccaaggtgggtggatcacaaggtcaggagttcaagaccagcttgaccaatatggtgaaaccctgtctctactaaaaatacaaaaattagccaggcatggtggcgtgtgcctgtagtcccagctacttgggaggctgaggcaggagaatcacttgaacccgggaggcggagcttgcagtgagtcaagatcatgccactgtactccagcctgggcggcagagcaagactccatctcaaaaaaaaaaaaaacaaaacaaaaaacaaaaaaaaaaagtccagaggcaagaggccgccggttcgatggctctgtgatgtcaggattggcgctgttgtgtctcttggcctcctcttcaggcttgtcacctcatcgtcacacagtgtgtgggcagccccagccattgcttctcgttctaggcaggaagaaaaaaggagaagggctgaagtccacaccagctggacgtcctccccttgacattaggaaagcaaaggttttctgtggattaagaggtgatgacttctctgcatgagaatcggaccctctgttacctttcatagtgtgctccctgggtaacctgaaaggcagcgtgtcagctgtgtctccaggcaacattgcttatggtgagatgctctttttgataaactgtatctagatgggaaaattctaatgcttgcggggcagggcatccagggctttgagcttctcacagtggtgactttcgtgactggcatgtctcttgaaggtgaccctggaagctatgccccacccatggggtgattgtgagagatactggctgctgggagcatgaggctcttagaccagatgggttccacatgcccttcttggtgggagttttgtacccttgcagctgacccatccagggagttctgtaccattgcagctgacccatccaggggcccatgagactagctgtgtgggtgcagtgtggactcccatcagagagtccaggaggcaaactggcgtctgtcttgttcccttggagtagacggccccatgtctagctgagccttaggacactgcatgcttctgaatatctagttgaaccttacttagaagacccagaagcctcttcgacacactgcttatttctttgtggccagagctgtgtcacatgaccagcctctcagatgttagtgttggccagacaatcaaaccctgggctttttatgaaggcagggcaggtctggaatcagccctgggtgcctgccgccacttcccatcccactgcgggcccttccagcctcctggcgtgtccagtgctgaggctgagtatgtgagttcctgggaagcccctgtgtaagggaggagcagctcctccaccctatttgtgtctgagaagttgccctgaagggaaatgttcctggagtattcatgagtatttggtctcagcttatgccttatttcatatcagataattgttgataataatgaaaaaaataatagtaacaatgcacatgataccgtctgaaccctcgttggggcctggtgtccactccctgtgccatgcagcatctctctatttcatgtcgcctggtcaaccaccacgtgaggagtaagtactttcccccgtctgataggttagaaaactgatgcacagtgaggctaaagtcacttgtgtgcagtcccatggctgtgcgggggacagagcctggacttggacccatgtcttggtgcttgacacataaactcgtagccgaggtcattcctccctacccagcatgccttcatataccaggaataggtaagacctgtcaggtgctttctttgagccaggcccagatctaagtgttttaagtatatcaacttaacaatcactatatccacagctcagggagagtgaatcccgggccgaaggtcaccaggtagcaagtggcagagttaggattcgaaccagtctggaatctgagctcatcaccacactgcactgcctggcgaccctcacgcagtgggtgaggaagaaccttcacttagagaagacctaccatgcaggtgccagagagttcagtggaggggagcgttccagatgccagagctcctggccttgtcaggcgcaggatcacagccttctctcagcagaggcattgtgaggaagggcctgccacaatcactgtctgtggaaagttctcggggtctagcgaccctctcagactgggaaggttaacgctgcagagaaaacctccttatgaaagtgcggattgcacagaggatgcactgcctgtcctgcggggaggaatccgaaagcagccaccctcaagatgtcccctcctacaggacgtggtgtctggcagcagcttgagcccaagctgcttagagggtcactgcctctggatgagtatatgtgaatgaccagcttttctatacaggtaaacacgtgctcattaaaaccaaaaggctgatgttagtcccaagcaatggggcctaacagtggcagcttcagtacaaaataacaaagactggtaaatcttactctgctttttgtactttgttctcctcatccaaagctcatacaggatgttttgaaacccaccaccccaccagcagcttgaggcttatgccaaaatgctgccaggccttagggtcctggggtcctttacagcctgtctatagctcatcaacttgcccagctccgtgtggatcatgtggaaggcatggagattacatgccccagacctggagctgagctcacctatcaccccttccttctctcaggggtcctcacagtggtaaagctgctttgttggtttcatacagtgggcacatgggatctgagacttagtttgctcttaaaataggcagttggggtgaacctgttcagataagactcttaaagtgaagacatctcccacctcctcctctttggtgtatttgggtgggggatggacgggaggaaggtcaccctgtgggaccagaggggatgtggcgcattccaaagaggagttatggaaacccagatgactttcctttttctacaaacaagatcatgtttctcctgtactacatgcagtcagcaggaatagggattcgtcgttttaaaatctgaacttttattcactaagtagaagttgttaaagatttctcagaatagtgcttgtatcagaccaagagctgcaagagttaaaaatgagaaatccccacagtacctcttgttctgcctatacatcccagatccctagtccttctgtatagtggaagccacttacatttcttgtgaatttctccaggaatttctcagctcatccataggcccttttccttaaatagacattgcactggccacatggctctgtacttagctttttcctttcttgctagatcttggaaacagcaataggtccacctgattatttaagcggcagcacaggatcggttgagtggatgtgggatggggtattaaccagcccccttggactgattgttgggagatttccagtcagtgcagcagtgaacagccttgtggctacgcctttgtgtttgggtgtgggttcttttatggaggcggttcctggctatggcaggggtacaggccaggagcacagcaactctgatagacacgggcagaatgccttcccaaggggggacagcgtacgctgctgttggtcatgtatgagagttggttacgtatgaggttcccacactgttaccaacactgcatgaccggctgtttgatataagctccaggccgatgggtgcaaagaggtgtcttgttgatttcacgtgtctttcataataagtgaagccaaacactatttcgtatgttcataggtggtttttcttttcagtgcactgccagtttgtttcctgtgctcattcctctgttagattttcacccccagctttattggcgtataactgacaaataaaagttttgtatattaagtcatacaatgtaatgtattgatataagtttacatggtgaaatgactaccacagccaagcgcattaacatagccatcacttcacatagctacctttttgtgtgtgtggtgagaacacttcagatcgattgtcttagcagattactagtatacaatacaggattattaactacagacatttactcatctcataactaaaggtttgtaccatttgaccaatatctccccatttcccccacccctcagcccctggcaattgggaatttgggtgtttcttattgatttgtattattctttacatataaaggaaatgaaccctttggtttgtactgtaaaagtttaccccagcttaccattcttttcttcttcttctttttttggtatgctttttactttgctaaacatgtcatttagtcaaatatatcagtctttttcctttgagcttactgagtttttgaggttagtgtgaccatcacactcctaagattatttttgaaaataaagttgttggccaggcacagtggctcatgcctgtaatcccagcactttgggaggccaaggtgggcaggtcacctgaggtcaggagttcaagaccaggttgggcaacatggtgaaactccgtctctactaacagtacaaaaaataaactgagcgcagcagcacgtgcctgtaatcccagctactagagaggctggggcaggagaattgcttgaatctgggagttagaggttgcagtgagccgagatcgtgccacagtgctccagcctgggcaacagagtgagacaccgtctcaaaaaaaaaaattaattgattaattagttaaataaaaagctgtcttccaggactttggtattattttaaattatttaaataattgatttatctggaatttatcttggtgtatttatacaggaaaagttacattttaggcattttgtcccaatagctagccagttatgccagaactatccaaggaatctttcccttgcaagtttgaaatgctgcctttaccgtacccaaatcgtcatgtgggtctcggtctgtttctggatctgttacagggacggtccattcaggttccagatccaggctgctttatttactggggatttatggtgcattttattacctggtagggctactttcagaccttgccaccatcattccatttcagatttttttcctaggtatttttgcacttttatttttccatagtaactttaaaactagcttgtctggttattcactgcaaactcttttgtttgttttgttttgttttgagacagagtctcactctgtcgcccaggctggagtgcaatggcgcaatcttggctcactgcaaccttcgccttctgggttcaagcgattctcctgtctcatcctcccgagtagctggaattacaggggtgcaccaccatggccggctaatttttgtatttttagtagagatggggttttgccatgttggtcaagctggtcttgaactcctgacctcaggtaacccatccacctcagcctcccaaagtgctgggattacaggcatgagccaccgcgcccgggccactacaaactcttactggtatttttattaggcatgcttaaagtctgtccatttaggggaaaaaatgtcagctttacaacatagtctttctagccaacaaaggatttatctgtccacttgttcaagctcatttatcttcatcggtaaagttttttcataaaaattcaacacatatcttgtttgtctgtttcttgttgttttatcccttttattgtttttgtaaatgctgactttcattatttttcaacatgttgctgtttgtaggtacaaagaaagctatcgatttttatatattaaatttgaaaccattgccttagtgaattctcttattttttaaaaatagatttttagttgttttcttgagtttttcctggcatgcaatcataccatctgcaaacaagaatgatttttgctgcttcctttcttgttttctattacttcttcttgcttaatcagattgggtagaacagaaggaacaattttacataatagtagaatatggcttcctaaaaataacacctttttgaaagatctatgcttttaattttgtcataaaaacttcaagcatatgaaaaaatagcttcagtatttacccattcatggctagtggtatttaatctacaccctgaccctttcccagattattctaaagcaaatctcagatcttacatcatagcctctttaaatatttcatattgtatctctaaaatataggagttctgtttttaaaaataatttcaatgctgttatcacaactaaagttaatatttgtttatgccattaaatatttgtttttgtttgcattttcccagtttacagggcgctgtttgaatggggatccaaacaaaacccgtctattgagattggtcaatgcatttcataattcttttatgtctcttttaggttgtccatccgtctcttttttctgtcttacaaatttttgttggtgttattgtggaagaatctgtcatttatcctgtagattttcctgcagtgtggattttgctgattgcatcttcatggtgttgtttaatgtgttcctctattctctgtgtcctgtaaaatagtggttgtttttagacatagaggcttgatcagattcagtttgattgggcaaaaactttcgtacatatttttgtgttgttctattgaggcacataatatctggtcatctcttttttggtgatattagcaaccattaatgatcattgtctagatctagtaattgattagaagttgccaaatggtggtgttctaatttcatcatttcttcttcattagttagctggaattcttctatgtagagaaactttccctcaagtatttggttaccctgaatattgttcatataagaaaagcagattaaatgcttgatttcttctcttttttgaaaaatttaaaaattaatgagttggctgggcgcagtggctcatgcctgtaatcccagcactttgggaggctaagacgggtggatcacaaggtcaggagatcaagaccatcctggctaacacagtgaaaccccgtctctactaaaaatacaaaaaattagccaggcgtggtggcgggcgcctatagtcccagctactcaggaggctgagacaggagaatggcgtgaacccgggaggcggagcttgcagtgagccgagattgcaccactgcactccagcctgggcgacagagtaagactccatctcaaaaaaaaaaaaaaaaaaaaaattaatgagtttccccgacagcctttaaaagataaccggtgaggttgtgtatgttgttgttagcacagttgatgtgttttgtgtgtgttaccatgattattggtgctcaagttttctatggccaataagagcttctttaggttgttttctgagtcccgtcaatgtgaacccagtagtctttgattgtttcctttctttctggtatattccaggatcatcttaaatatttcttgccccaggtctggaaccagttggttctttctccatggagccctgtgaaataacatttagagactgtaatctgggtagtgtggttgctcgttgttgtagatttggtgagagtgtatatgtctatgtggaaggcgcctcctaaatggcccccaaggacccctgcctcttggtattcatggctgtgagtccttccctccccctgtgtgggggatggacttactgagctgcttctattgaatagaatatggtagaagagatgggatatggcttccaagatcaggttacaaagagatgtggcttctgtctcagcttgtcctttcttgttctctcttacttgttccctctgaaggaaccaagctagcctggtgtggttggcagttgccccatccagaggcccacgtggcacaggactgatgtttctggccagcggcctggtgagagaacttggaagtggatgctcccctcttcaggcattcagatggctgcagcatcactgagtaccttgctgcctgtgacagacgagaggtcctgagccaaagtcacccagctaagccacacccagattcccgatccacagaaactctcagataatccacggttgttgttttgagccactaaattcccgagtaatttgttatgcagccaacaataactaatacacaacatattttttaagatcaaataacgtcatgattcctaatgatactttgtcaggtttataggttctaacatttgtagtttctttttcctgtgccccaaattcctgttctcaaggacaccagcataattttgcattggttttattccattaagcttacagcagtctcagaataacaataccaaacactgccaaggacacatgattgtagatacagattatgatttatttgcatttacttttgtgtttagaatacatcccacaagggatgtacagtcagacaactgtgttttaaaatattttggaatagatcacaactggatacacttttagattcattggtttcatttttctcttagttatttggactttgctttttccatttaattttgttttataattatataaaataattacatggtatgaaattcaaataaacaacacaggatgtatgcaaagaggtcagtttcttcccctatttatccccccacctcccaatttcttcccttccactataggtaaccattttgagcattttacatatttttattgtaagcatgtcttcccctttcttaggtaaatggtagtggattagactcccatatctccatcttgccttcttcacttcacactaaaccctggcggtgatgccacagctctgtgctgttcacaggagcatggagaggatgttctgcagaactccactgtgtggatagatgtctcctgttcaggagtgtttgggtggtttccaggtttttgctattacaaatagtgctgctgcagtgaaccgcctatgcatatgctttttcccatttttgccatttttttttaaaaaaaattatttattatgctttttctgggaagtcattctccccactgcaagggttaggatctgtcttgggcaactctgtgcgttttcttgagcttggctttgaccttccttccctgactctctgttgtggcttctcttcctcccagcatccagtgacttaatcttgctcattgggtgtctaaagttcaacactgtggaacccccaaatcccttttatcagtgacaaagcctgtgctgcaggcccaggtgtggccactccctggtgaatgtcccataggtgtgattttcagatggtgtcttctctttcgtatcagccatattatagggtcaccttcagtgggggcatctcaaggcacaggccctggcagtactggagagtcgggcctggaggccacgccttagctctgcagcagaaggtctcacttgagacgccagttacacgactctgatactcacccactcctgcctcctttccccactccagacctagggggcacttcagggggcaggctctcctgctgatctggtggctcgcctcctcccagtcctgtcctgccccattagagctgcagcccctcctcccagttgaggccaggtcccgtctgcactttggaacctcacacgatctgatgtcgtttgtctcctgtcccttttgctcgcccctccactggcttttgaccacgtctgtcccaccctgcatctatccacaccaccccgctctacctgccccttttctttcacagccggaatctgggagtggcagcctcattgtctgcacctcccctgcacctctcagccccctctctggctcctgccccggttcctctgaaacagctctttgaggtcacgactgacttccttgacactgtgcccaatacacgaggtctccttgtagttggcctcctgctagcatgggtgtagatgggcaggcctccctttctaagccccttcttttcttggtacttagcagagcagagtcctggggcttcatcctgcccccttgcccatgaccttccttgcagactcatccatgcctgcagcttcacttggcacctgcagatggttcattcccaaatctgtttttctaaccgggactcccgagtccagccgcctactgagcatccaggctcctgccactaaacttgcctggaatccccaacccaagctcagtcctcttccaggcaccctttctcagtgaggggcaggtctgtccatcgagctctgcaaccattgtctagcgtcctcatcttctctcagactccagtccacctttccgtcctgttgatggacccctaaatccccatctgttgctgtctctccatttccgttgtcaccctgtccgtaccatcatcaccactcatgtgctgggatggctacagtagcctctcagctgctctcccttcttcctctctgctgcctgcccctctgccagagttcatttctaatgaaggagtggttgggccacttccctgatggataccctggagtgacagtccttatggcctgtcacccgtggccccagggtcctcacatctggccagcgcttcctccccaccctcgacttgtctcagctgctggcccatgccctaggcctcggcagtccagacatcctatagatcttctaaggtgtcattgtctctgcaccctagggcctttgcacctgctcccgcctcagcctgggaggctttctcctccttttgccttatggcttgttgattccttctcctcctccagacctcagcttaaacagcagccacccccaaattcctcaccagagcagcctccctgtcccttccttcccagggccatagcctcccttttgagcattcaccatggcccatcctgatgcatttgttctgtggctgtgggactgatgtcagcctcactgtgtagcctgtgagctccatgtttctgtcttaacaccggtctttatacagtgggttcagaaatgctgagcacctgaactcatgacagtgaacttgggcaaagccacgtgacccacttagatggtccttatttgtaaaattgggaccctgagattgcttcatggcgtggttgaggactgggtggaactgtaccattgttgcacagaggtctggtgtgttgggcatgagggctgcactccaagactccgtgcctttgcagagagcagcgggccttgtggatgcacccccacactcccacatacacctgtgctccagctccacccagccacctcctcccagacccccaggatatacagggacaggtcttggagctaatgagaccccctggggccacactggcaccttagaagcctctgtccaccacccatgttcaggataattttcttcaaaggtggcaggagtggagaccctcaggcttgaagctgtgggactcccctccccttccctctccagagggcctagggttttcctaagcggtgtttcaaacagaggcttcctctggcaggggagaacctggagcgccttattcttctccagactgtgcagatacactgtgcatatgcctatgtgagtaagatatacggtgtgaaaaggataaatcactctctggggagacaagatctttaaacctgtatcttgattatcttgtcattttgtctccctctggtggtctcagcttagggtcagtgcaagacttgagcaaaataacagcaatttctacccaaacatgtagggctagctgctttcattttctaacgaagctgttagatttgggttctgcgtttcctgcggaagttgagagctgtgcccatgaatctgatatactccccacaccatgccgcccccactggactcttctctgggtctgggttctcctcccgtggtgcgtgtgagtgggaggcaggatgctggggccaccttggactcgattgtttctcgctgaacaaaagagcaaggcaggcatggaaggcccccaggcagaggtgggtggtggctggagttgcagcaaggcccttgagtgcttcactggcctcatcccggaagcaggcatccgtgggtgccagtggtgaccccctgcctgggatggggcatccttcacacacagcagtctgtgcccagatgggccccagagctactgacgctcacttcagggggagacgaggccagtctttcccaaatctactcaaggacatgggtcaacatggaaatgtgaacctcagaagggtctggtgcactgaccagggccaccctgggggctggcgagggagaagccaaggggcagtgcctagaaaggtaggagtcagattccaaagggagggctggcctcccagcctccccagggcctggggctgacagggtgccaggcagcccctgccacagaggggacataaggacactcgcccaaggccctgctcacctgctggggctgtgaggctggggtacctggggcgcctggaagaaccagagctttcctgcagaacaaagtgacgccatctagtggtcaatgagagccactgcattgggccccactgggtgactggggcttcactggggggtgcctgttgagccatgctcactggggacggcaaggtggtgtgaggtagtagaaacaggcctacctcaggcgctgggagccttcccagccccacagccagatgccataaaaggcagcacagggcatgtctggcgagcctgtggcagccagggctgtcatacacgctctccaagccccccagctaggcagatgtgcacacttcactctgaagaagcgccagggtatggtgggggtactgcattgggatagatgggtcctgttccctctgtggggctgcctctgattctcctggtgacaggagaatcccggtgtaccctctgagagacaggtggacaggggttcctcccctggtgccacccctgaatcccgcagtcccccacattggtgcctgcagccctgcccagctgggagaaggtttatcggctccagggcaaggggtgaatggaggatatttaaaagccgtgggaggaccccattgataggactcagttagatgcacaggggagggatgggggtccctgtggggagagacggctgggagcacaggtgatcctctgaccccaggggcacgcagacccactactgcccaggaaagcaggaaggagggccaagtgggctgagcaccaacgcgaagctccccacttggtctgtctgagcaggtgagggaggggcagccaggagtttgaggcagtggaggggtctggaataactcttgcatggaggaagagtctgagtttcccagagagatagatgagagttgtgaggttgtttggggggcatttggggtcaagaatttataatacatttatcatggcactcatttgccctcttgggcagctttttccagcctcaggtccagagaaaacaggttggagatttgctgaactcctgtgggcagatacacaggactggggtcagggaactgaggatactgggcggatgttattgaagtggtggatggcagcgcccaagctgggccagttgatgattttagcaacagaatgggttagaggtgagaccagggatcagctggctgagggagggaagaggtcaggaggttgctggcgcgagggctggggaagtgcaggatggctgggcccgtgatgctggagggactcagggaggggccagctggagcaggaggggagccaggaagccagggccaaaatccccagtggaaggggctctggccaggaggtgggcagtcgggagggataaagcaggtgacatggccaacatgggtctgagaggacagccaagccacggtctaggatagctcagaggtcggctgactgcagccccaatcgcaaatcctcctggccccctgattttgcatataaagtttccttggcacacagccacacctcctgttttacatactgtctacggctacctttacgcctcaggtacaacggtgaatagttgcaacagagaccacaaagcctaaaacacgtaccatctccccctttacaggaaaggtttgcccacccctagctggagccttattgtctggcataggagccactcaagattggtttgtgggcaacatggacaggacttgggggttggttggatatgactctaacatgtggctctttatatttcaattaattaaaattacatacaagaaatgggtccagtccctcagctgcaggagcctcagtgccagtgctcaaagccacatgtgggtagcggatcctgtattggacactgcagagatagaaccttccattgtggctggcaggaagtttgttgggtcacgatggtctaggggcagcagatggaacaagcatgatgttgccaagcctgggcctgcggtgtgatgggtgtgaggagctacacgggtgtcctgagaggctacagacaggcaggagcccctcaggacagatgcacaaggacaggccaaggagaagcccagggcacagtttcaggtcaccagcatgagttccggggctgtggggaaggcatggaaagtgctgttgtgtttgggatgtgacgccttctggatttgcagcctgtgattgtcatcttgagtgacagtcaactggaatgctggcattgtcctcctgacactgtttgtgcagagttttctggcccaagtgttgatttcgcgcagttacttgcagcacggggtagtgagggaagcagaccggccgcccgtggctggctgcagatggcaatggttgggcccttctagtttgccccgcatcctggctgccgtgttccttgtgctatggccaggcatgcaagttctttgttcaggggacttctcctctaggaagactctgactctgtgccctccttcagttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaaggtagaggtgcttcgagggcccctcgcggatgcccgcacactttggggggcactagcaggagggaatatggcggggcgtaggccctcttccagctcggactgcacagccctcagcacagggggcaggagcggcccaggtgccaacgaggctgagggaggcttgcgccttggctgggagaaagctggctgggcagaggcaaccagctccttaacaagaggcccacggaatcccagaaatacgacctttaaagatcatcgttccaaagcattctagtcatcaaacaatcccaaatcccagttcaacagtatgtgtatttttagtgccattcagagtgcttcaagaaagggtgaaaaataaatcacgttttatttaaattcaggacctcaagaaaaactttgacctgcttgtagctctaagtgctcattggattgtctggttttgaacatcgggtgaggccgggcaaggggaagatgaggccacgtcagcaaaattaaatggggtcggcggggaggggatgcagccatctgaggtctcagctctctgagcaagacaggatctgcagaggcccgccagcccaggggtgagaaatggcagcaacctcctccccagccctcaccatacacaacctcctctaacagaagcagagaagcaccatgaggccatccggggtgggcaggagaaagccaggtaacccagggcagtgctgagccctgctggccagtgcctctcagcagaggcccggccctcccatcccagacccttgccttgctccgctgcctggagctcagctccccttcctgccggctgatggcatctttcctgtcctccatagatggggtggttggcagtcatttctagcgctccagggacacctgtgtgggcttctcttggtcagtgtgtgtgcttgaagtgggcaatggctgtccacccgtccctgctgggctttgctaggcaccagacctgagagtgggggcatcaaccaccaaagtgacataacctcacgcaccttccttctctctgtgccaacttgtttttcttttctcttccatgctgtcagaggatgcaaaaggctgctaagatcaagaaaaaagcggtgtgtagggccttgaggccctgggacagtgttgtttgcttgtgtttccgtggcttgtcctgggcagtgggggctggggggttcccctggggatctaaataatgttgcaaagcagcttttcctcttcccttggtaggtgaatcttagatgtttgtaaatgaaactacagacacttcatttttttaaccacccatttatggaaggatttattaattcttctttcttagcatctcctgtgtactgtatggataatgctgtgatgttcctgttttacgtggacattttaaattgatatgacatttagttgatatgacaacgtggtgggtgtagggtctgggcctcctgtgcagtattactgaattgttctgatagttaaagattccttaagcttaatttactaagtcaggagggtgagtagctcagtttgcccgtgtggtgctttctttattggaaatgagtttttgggctgggtgctgtggctcacacatgtaatcccagcactttgggagacagaggcaggaggatcatttgagcctaggagtttgagattggcctgggcaacacaatgagaaccctgtctccacaactttttttttttttttaattagctggtcatgatggcacatgcctgaagtcccagctgcctgggaggctgaagtgggaggagcacttgagcctgggagtttgaggctgcagtgatctgtgtttgcaccactgcactccagcctgggcgacagagtgagaccctatctcttaaagaaaaaaaaaagaaacaaaaaaagaaaataagtgttgaaacactggcagacttttaaaaatgggttgacactgaggccgggcgccgtggctcacgcctgtaatcccagcactttgggaggccgaggcgggcggatcacctgaggtcgggagttcgagattagcctgaccaacatggagaaaccccgtctctactaaaaatacaaaaaattagccaggcatggtggtacatgcctgtaattccagatactcgggaggctgaggcaggagaatcacttgaactcgggaggcaagaggtcgcagtgagccgagatcatgccattgcactccagcctgggcaacacgagcgaaactccatctcaaaagaaaaaaaaaaaggattgacatcgagtcatttgtttgtcacctggtcatttagtaaatgctagagcttttccaatcctcctcatacagaaaatatcaaaatagttggtgtcacaaggcctggggcaaaccccggggtccttggcactggcttattgcccactgttttcttctgtttaaacagcaggagatttagttccccctccctgctttgaagtaatgccattttctggcgctttggccagaagacccatgtggggactccctcttctggagtgagactttggtccacctaggatgtctgccttttgcccagcagcgtctcctttgattctgctcaggagcaggagaggaaggatcatgctcatgctcctcttcccgggctgatttcctccaggcaaggcagaatgtgccacacattgcagacttgcagttggggtgtgcttttctcaaaagagaggggccctcgcttgcagcctcctagtccagctggagcagggagtccctacggactgcagctggcttctgggacctgcaggtccagcaatcctacagagtcgctgccgcctttagaggggttggtacaggcagacccagctcaaaaaggcctctgcggccagtcaggtggccgcctgattacatttaattacggtttgttcttcctttttggaaagtgggatgctcagtgtcattgctgaaggtccctttcctggcccggccacagccatggggatgactgcaggtcatgccccccatccacagacatgccgaggcccaccctgtggcctgttctctggtgtctgtaggatccgtactgtcgacaccctcccttcttctgccaaggaggatgatgggtgtcctctccctgccctgttactgatgggttttccactggaggctgggtggcttcaggctgcccctcttctcccatccagggatcccagcctcaggtttcctccacaattgtcactaatgccaaggtccacctgcaacttttctcacttctggcttgacctactttttagcaagaggattttgagccacaacccatgaatataacctttaaatgcatgctgatgctgaatataacccaattttaaaaaacagaaaaagttcctccgcggctgcggattgtcagctgcactgctttcaactcctttctctttctaatgagttaaaagcaaagaaagcccaaaagaccctttcccttgaaaattgagctaaaatacacatttattattacaataccgggcctctctaaaactcaaaattcttgaggaattgtcagcagggagatttcttatttcagattttctagtgaataattaaatcatagtttttgctgtttcgaaatggaaaatagaccaccctgggctccccagtgaccacggagaattattcacctcggtgggcaaaccaatagaacttgaaattcattgccaccgtgcagtggtaattaggattcttacaaatgtaaaaaccaattaaaggctatcctagtttggggcagactctgaagagttcactcagctcagaagagcccatgaaactcgtctcacaaccatatgccagacatactacagtggctacaggtgacgaattaggccatttgtgtggcacctctcttggcttctctctgtcgctgtgaggacagcacttaggccagccccagggctcagtcccccaaggacgctgtgggatggacatggtggtgactgattaaatcagaaggaaaggctgacattttcattcagcttctctgacaatgtcttccccatttcttaaggatacttagaatcccaaatccaggaaacgtaacctgagtctataaattccacaggggtcagccagagggccttgcttgccactggcaggaggggctgtggcgacagacccaggcgtcccgccccatctcggtcaagctcccgggggctggccctcctccctcccaggtgcctcttacagactgcctcgagaactcacacttagctagatgatgcggccggtggcgtgcaggtagatttctgatggccagtagcatttccttctacgtggactctgggtaattgttaaaattgccgagccttccttcgagttattactttttacattgacggataaaattgtatgtatttgttatgtacaacataatattttggagcatatacacattgtgaaatgactatatctagctaattaacgtgcattacatcacctagttttaatttttgtaatgagaacacttcattcactatcttagcaatttttaagaatatgaaatattattaacggtagtcaccatgatgcacaatagatctcttgaactcatttctcctgtctagcaggagctttgtgtccgtggaccaatacttcccccttcactcctttgccccagcccctgataaccaccattcagctctctacttctgtgagatcgacatttgtagcttccacctgagtgagatggtgcagtatttatctttctgtgcctggctgatttcacttcacagcatgtcctctagggtcatccatgtgttggaaatgacatggctttttctttgtgaaggctgagtaggcctccagtgtgtctgcgcgccacatttctttatccattcatcgtgaatggacttcgggttgatcccatgtcttggctgttgtggatagtgctgccgtgagcatgggagtgcaggtgtctcctagacacgctgatttcacttcctttggaaatatgcccagcagtgggattgctggatcacatggtggttgtagtttgaatttttggaggaaccgccattctattctccacagtggctgcactgattcacaccctcccacagtgtaccagggttcccttttctccaccccacgccagtgcttcttatcttttatctttttgacgagagccattctgacagatatgaaatgatatattgttgtggttttaatttggatttatctggtgattagggatgttgagcattttgtcataatgctatttgcatgtcctctattccgagttggtttttggactttaacaatatccactgtccttcttagaattctgagggggatgcccagacgctgacggaagtggacctcttcatttccacccagaggatcaaggttttaaatgcagacacgcaggtaagcgtttaagacagttgttcaaaatcaggtaaactcctaagttcgactccttcttgtcccatggtataggccctcgttctcagcagcttctctcctgtgctctctgcgcccatcaacccaaggcccatagcccgggctgcgggaggagcaaggagcgcacagcaggtagcagtcgtgctggcgtcaccccagggctctgcgggcgggaggtaggtgggaagacctgctgggctacctgggccctcccctgcttccccactcccgggtagcctgacctctggggacagaggaggcagcagcccccactatgtggctcacactgcagcccaccactcccaacccagtgccgtgccctgaccatcctccaggccctcacataccctgatacgggcacaggggcgcccttcctcatcccatgtctgtcctgtgtccaggcttgcaccttgtcccactgatctttgtgtcctgcacccccctaccctggaaccagccccctcctggagcctggcacttggtgaaaactcagggagacaggtgccagggctcaggcactgggcttgcgacgcttcacagactttgacttcattttctgatcttttgtgggcaaaccatctggactagatccccccaccaaccctccgagccccatgcctcatcacccacctgtgctgggtgtccccaagaccaccacaggctgggtggtttggaggactgacaggactcagtgagctcacagctgagatttatttcagcagatggctccagagcagaatcagcaaagcggatgcaggcttccagagccctccccgcagtcacacaggacacactgaactccctggcaaggggctgtgacaacagagaagttgtgtctaccagggaagctcatagacactcagcccaaggtgtttactgggagttggtcataggcaccctctgcctggcagctaccaaaattccagactcccagaggcaaaagaggtgtccagcctagaccacgttgtttgcacaaacggtttaggcaaaaggaaccatggttgtcagttcgggtgctgggtaccctcctgagatccacgttcccagatgccagagagggccagccttgcaggcgggcctttctgggtacagctgctaggcctgccccagtacctcttcttgccagtgtacatggagggtgccacacctggggtgggaggatgggcttggggattgaagctgagccccatcctcatgagctgtatagccttaaacaagttcctgaacatctctgaacctcctaatacccacagccccagctgaaagagtaactcttccgctggatcctgtgaaggagagatgagaaatctcctaggctggcccagttcagggttcactccactggccccttctcccttcctttcctttcccttctggatctttggattctggacagggcatgcaaattaaagctgttggggcagaggagctggagaggagggaacaggtgagagactgggaaggccaaagtagccattcagagcaggagagcagatgcggccatgttggtaggcagcctctgtgaggaggaggagggatctgccattgataggagctggggaaggaacatgtttctgacacctggggattgattcaggcatttatgacagtgacagaaatcaggagatgctgaagagccactccaactgtttcctttcagtgtccctccctggaaggtgactcttgtggttatgaaacagcctcatggctttggccagaaaaaaagtcagcagctgagacaaaggtgaagcagcatgcactgcaaagtggattctgtgaggaagaaatgaggtccagaggttgcagaaacactcgagtttcttttgtgaacagaggacaaaagcataaaagaccagttgattagtttttttgagctttgtgtgcagtcttgttaggtaggggttgtgggcaagatgctggctggagattcctgtccaaggacaaaaaaccatcaagagtcatgggcctgccagaggccgagggaattgaagtcaggtgggctaccttggtgtcttttgacccaggcccaggctgtttgggctccctgggaagagctcattgaatgacaaacattggccttgatgctttcctcttctgcacagcaggaaggccaggccaggccactcttgggcccataggagagcacctcgttcagaagggacccttctccagagccactggtggcctctcatccgggaatgtatgggtttcactatatggcaagcccctgctccagcagagacagcccgagagctcacctgacatcacgcctccctgggttctgcacagtccattttggaagctgggactgagatgagggcagagtgactttgactgtaaatcattaccctaaaacgctctgttaattagggccgtggttctcaaccagtgtgatttttgtccctcaggggacatttagcaatggctggaaataattttcattctcacacttgggaagagggaggtgctactggcatctcctggggagaggcttggaatgctcctaacaccttgcagtgcacatgacagccctccacaataaagaatgatccggccccaaatgtcaggagaatcagggttgcgaaacccgaataattggagtgccttttttttttttttcctttctttttttttgagacggagttttgctcttgttgcccaggctggagtgcagtggcgcaatctcggctcgatgcaacctctgccttcacagttcaagcgattctcctgcctcagcctcctgagtatctgggattacaggcacctgccaccacgcccaactatttattttatatttttagtagagatggggtttcaccatgtttgccaggctggtcttgaactcctgacctcaggtgatctgcctgcctcggcctcccaaagtgctaggattacaggcttgagccaccatgcccagccctggagtacttttcaatggattgtcccagtagtgttccctgacgtggcactgtctccctcccgacaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgtaagtaagcccttgccagggcactcccctcccaaagttcacagcccagggcggctccaggatccaggcgctgtggaaaccaccctcaggtggaaagcctccatgctgttactgatgtttccagtggatcagtgatcttttgcatactctttgggtttgcaaagatagtgaatacagttttattctacttcttgaaataggttcttcaggagctgtttataaattgagttgtggttaaatatatgagggagctatttgaagaaatccctttacaaaacattttctctactaaaaatgaagttaatctttgcataacttttgttattaaaatgcaaattttcgcatggccctggcatgctgtataaagaaagcacatctgcacatgaggcttagttctgcctttgcgtgtggtcttcagaggaagtaaaaagtgattctgaagtataagataccaaagactcaggaaaagatcacaagccctttggctccctccttggctggagaagagtgttgtttttagcctggagggggacagaggggctgaggaaggagcagcagggccaagaggggagctcagagaggaactgtccttcctggaggctgatcttactcacagaccagcagggggcgctgctggtgagccagttttgtggctgttgccagagtgaaattttaaaatatgatctatggctgggcacggtagttcatgcctgtaatcccaacacttttgggaggctgaggtgcgtggatcacctgaggtcaggagttcaaaaccagcctggccaacattgcgaaaccctagtctctactaaagatacaaaaaaattagccaagcttggtggtgcgtgcctgtaatcccagctacgtgggaggctgaggcaggagaattgcttgaacctgggaggcggagattgcagtgagctgagatcgtgccattgcactccagcctgggtgacaagagtgaaactccgtctcaaaaaaaaaaaaaaatctatccttcaggggcagttggccagggcgttctttttcacataaggacttgaggctgtctcagggacctgggcaatagggaagggtccccatattgtcatgatcctgacatacagcatggaaactgaagacagggttcaaacctttggctggcgcagtcatcttcttcctaagaacttgggtccacttgaagtgcttcggcgcaatggcagatttacaggagggagagagcatttcaacagcgcactcacacattccttccaccgctacacggagacccttcgaaacctggatgggtatttctgtgtgactgagggccgaggatgtgtgagagacctggcttggggatgggccacaggtactggcggaatgaggccaggagcaggcccggtggcgaagggtggcagtcagctggtgagagtttccaaggggcactgagagcccccaggtgcagccgatgcggagggttaaagccagggtatgccgtattgggtagatgaggccgcagggtggtcctgccagcaacagcagcctcctcttccccacctctccagcgcctgcaggctctgcccacagcccacttgcaggaggccgcttgagccctgaggtggggcctgggctgggctcctggactcacagcagtgaacgcccacaggcttggctgcgagttggggccggcagggcgaccccttctctgaagcgccagccgcagagagagccccctgaaccccacacctcccaggaggcagccggtacccggcgtggagtgacggggaggcggcggctggcggcacaccagcggcccagatgacaccggaaggaggcgcagccccgcggagccggctccccgggcttggagcttccgcgggggcggaggatgtcgtccaaggggaggaagaatggcggtggcccgagggagcccaagtggagtccgagggccgtgggtggtggagccgggcctccggggctccagggctctcaggccgtccttcccagccaggtggcctcgtcaggcggagacagaagcagaggcctgggggccgccctccgctcttcccaaaggcccgaccctctcctgcgcgggcgctgcccccggccctcctgccgagccccatcagctcgccaactccgcaggccagcccggcggcgccatctggcggtccccgggcgtcgcgcctccagctgggtctgtgcgcgcggcagagatgctgggcgtgggaaccggcaagtcctggaaacggcttagggcccgtcagggagggcagttccacgcctgctggagggcaggccgcctgctgcgcgcttctaatccggcccagcttgtctttcccaatgcatacattcatctgctgctcttacatcctgccacgtggagagtgggaagggaattgaggccaaagcccttgttttcacctgttttgggatcctgttgagtaggagtttgctgggggcgcccgtgcaggacccccttgagggcagttggggaggcacgtgaggagcaggacagcgcataaggagggctcacacagcccagagcctggcgggaggccccgctgtgggctgaggcgtcaccaaggccgccaagagccccgccgcgctcccagggctgcacagctgccagcctgcttggcgagctccgggagctcagtacagccctcacctcccactgtctcctgtctgcgcaccagcaggcggccggccaggccctgagtgctgtttcagtgtccaggcctttgccatgtcagagtcggtgatgtccactgaagcagctcagcggaagtagaaagaagtgacgtgcttcatggggcctgtgtggagtcccaggtctcatgtcttgcaggcctggcctggcacagccacacatccctagaagagcagccaggcacaccctctgcctccagtgggcactgggttctgttgctaccgataaatacatgcggggtagacaactagcagcacgatgctcccggaaaacacactgaaagtccattttcggcatcagatgagtggaaaggaaatacagatggggtcaggtgcagtggctcacacctgcaatgccaacagtttgggaggccaaggcaggaggatcacttatgtccaggagtttgagaccagcctgggcaatatggcaagacccctatctctacaagaaaactttttttaattagctggatgtggttgtgctcacctacattcccactccagtctgggcaacagagccagacctcatctcgaaagaaaaaaaaagcaacaaaaatatgacatgtagtaaataattcattgttgtcccagactttctttgaaacagctttgacctggagcatctgggccgtgccacagcttaggcagggacagtcaggagtagaccctttggggttcagggcaacactggggttcgctcacggtggagtgctggtgggagacagccttcatcagatgagggagggcccccagtttctttcttgttcttctaagcccgagcaagggctcccttgaaggcttatgggtgcatcctgcacccagccctgccgcagccccctgctgaggaggctgcggggagcctgtgccacgtgcctgtctccagctggcctgccctctgcacaggcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggaggtaagccacacccaccagcctcagggaggccacatttgccagcttctgctccctgagctcctgcagagcgagccttcccggggtcctcacgcacacccttgccttcctatcagactccagtggggcccggaatgtgcacctcgctcctgccttccagctgagcacttgggtgtgaaatgaggtgtttgtaacaaagaagctgattacagtcagctttaatgacctcgaaaatgcgccttttaatgctgctattatcatcaaccagcactcagcacccaggagatatttctgaaaagcatgtggcatctctaaagggagcctgggggctctggcagaggaggctggaagccaccagtagcagaggccttagctggtcccagtggcttcccccaggggactttggaaagttcttatgggcagaggagcaaattccctggggatggcccatacctggactgtttgttaaatggctgaatgattgtgtctgctgtggatgagtggatggtctctgctgcttgttgaatgggtgaatgcatgatcctggtttcttgctgaagacattccaggcagtttctgagacagtgacctttgagaggaaataaaagtagaaggacttttccaacaagagtgaaggccgggggcaggatatgggtatgggagcctgagaacattcctctggcctctgtgggtgtggaaggagcaggaaccaggacactggagccctgcttggggtgggaaggtcagtgttgggcacgggtggggttggggtcaatgccaggcacgggtggggatagggggtctgtgcttccaggttcccaggattgctgggtggaccccaggaaggtgtgggagccagactggggtgaggctgggggtgggtgggcagggctcccagcccaagacctctcctggctgagatgagccagccttggatcccagggcagggcgggatgtgccaggacagggtcagcctcatcctcctgtgggtccttggcagaggcctcggtccttgccgccagcccctctcacactgctgatccctttgcagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaaggtaggcaccctgggatcctccgcccaggggtcacctcaaccctgcctcacttcatccccactttgctgcaatccccacttcactgcaatccccacttcacccatggggaaactgaggcccagggagacccacccggtgactggtcgatgatggtatcagaatttgaactcaagaccattccccatgtctgaatcagaggtggacccgggctggcctggggtgggaagggaggggttgtctgagccctgtaccgagccatgtggccctgggcaagggcccaagaaccagtgagtatagggtgaccagcttatcctgctttgcctgggactttgccaggttagcactgaaagtccggcttctgggaaaccccctcagtgctggtgggctggggaggtggggcaccctgcatgggttgggttctgggacgcaggttcccttaagtaaggaggccaccctgaccgtcagactcgtgagcttgcagctttgggaggtgctgcctgtcgctgtgaggggtcaggcagaagggtcaccggcagctagggtgggggccttcacactggccgcctgcgaaggaatgggttctgcctgctgctggcggctcttgtgacccagctgtggcctggcccccagccctctgtggcatgttcctccccaccctgctgtggtcttggtgctggaggaagcgccttcctcctctttgttcggcatgagagatgaagggcattccccaggccagagcatcccatagactggctctcggagctggcccggcagagcgtctgcccgatgggcagccacacagagagacatgggagaggcctccaccagtggcaccagagggctcagcagttgaggccccccctcccagggctgcagctcccaggtggaggcttgggttcctccctgtgcctcctcacccccaccggaccccggcggcctggcgcacccgctgacaattgcgtcctcactcacagagatttgctgtgtggtcactccctgccctgcaggaggtccgtccttggagggcattgggttttgaggaaggtgtctccacatccttccgtaggaagctgtcccgaattcggcatgatgatggccccctcgacaccctgagggtgacctggtgccaggtgcgttggttctgcccagtggcactcagaacctgggctcgctcctgcagtggctaatcttccccagggcagaggcaccctgcgcatggtgggacagagggcgcagtgctgccctggaaacctggtagctctggtaagggccagggcgaggcttgtccccgctgcacagaggggctaccgaggctgagaggggactgcctgcctctcccattgtgtgttctcactgcccccggcctccaccaccctgccagcctcgctcatcctgggtcaggcttgatgtctaaggcccagcctgtgactcctgtccccgtgctctgcagggcctgaagaaccagacacaggtgaagctcaacattgtcagctgtcccccggtcaccacggtccttatcaagcggccagacctcaagtaccagctgggcttcagcgtgcagaatggaattgtgagttccccctcctgctctgggccaccaccaccactgcagggcccagggagggggagcagctcccgtccaatggggcaggctatgtctggcagcctggtaggacctggcctgtggttgcagctgcccacagccaggccacctggggcaggaactttccatggctctctgggaggtcctggctagaaggggagggccagggcatggccgtggattgggcccctccagcctttcccaggctcccttgtccccatggtggttgtcccctgctttggagggagggcagcagacttcaccagccactgtagcttggacacaaccaattgtggcatcacttactgtgctcaacaaacagacgttcactcattcattcattcatgtactcatcattcgcttgttcactcagccattcagcagacatttgtgaagtacctgctctgtgttaggctttgtaccaggcaatgggaaggcaggagtgctgcctggaggaggtgatgctgggcttgagtgagtgtggttctggccaaaaacctgtaccagttccccaggccagagttctttagcccagagtttccaccctctcactgacctgcatttgactggcctgaattcttttttcctttgtttttcctcctgcaaaagacccagagggcagagatgtggccactaagtggagtaaagaagaaaagggctggcaatacccaaattgtttaaaccagccctgagtatgaaggagcccaggaggagagacactgcgggctggagtgggagttttgtggaggtgatggggagggtgtgtgcccacccacagtcaggaaagacagtgggagaacattctagaaggactaccaaatcttctccattgttttctggtgaagcagcatggagggttacacccaccgtcagggtggagtcccagggcttgggtttagggtccatctctgaccctgctgtgtcagagcaaatttgctgctataaaaaagagtctgcaaatctccatatactgagagcttattgcttattcatgctgcagtttaatttgcagtgggggcggtgggggtgagcttcactccacaaagccactcaggggcccaggctctgccctcagctgggctttggcagcccccactgggtgctctgtgtctcgctggcactgcaggaagagaggcagctcagaagaccttgtgaaggttttcagggccagggcagaagtggcccttgtcatttctgcccacagcccactggccagatagctcagccacggacccatggggaggctgggaagtgggggccagctggtgcccagaacgaagagggacaggggcatcgccagcgtcagccataccttccctgctgtgtgaccctcaacaagtcactgaacgctcactggattcccctcaaaaggtgcttgtgaagatcagctgagaaaatccataaagtaccccaagctatccaaggtgggcccgctggtcctcgtctctgccaaggaggaggccccgtggcccctggacctggcacaggtgccaggacgagttgtctgcaccccacttgggacttcaggacagtgcgcctgccgcaggagctcgccagctggtggtctggcctggtccggctctgcctgactgctctgcacacatgtgacctgggcacaagcagttgccccagctaatttgggggctctgcagaaaatcagctggagccctgtctgcagctgctgtgcgcactttgtggatgggcatggctgggccccagggaggagggctgggacatccttctgggctactgcacccccgaccatcaccaggccctgcctgtgtgcctcccaccccagcactggggacagtggaggaagctggggactgacagccctgcagccctcatgaggagccgtgctgtgcagagcctggggtgctgtatggtgtcccctgggctgcccctgcctggctaaacctggtgaccacactgcctttgcctcctgagtggcactggggagctgcttgtcctgttcctgcacccccttgcccagcctaggaggcaggtgggcctgggttggtggccagtgctgctcactgacagccctgtcgctgtgagccctgcaggagaggctggctttccccaccatggggtggcctgggggctacctactcgtagggcctgtgaatatagccctgcccgggatgagtttgatgccccctcagtctgctggtcttccccaaactataaccccatgaggagcacaggaactggagaagctggggcacacagaggtttagtgacttgccccaggtcacacagccatgtggagcactggtggggagagggggagaagagatgaggaagggaaggactccggtttgtgttttgtgggggctaacatgaatgggaaaggaggggacagcctggagcagcccagccaagcccaggtgcagggttctgtgcctttcttcccagagagctggagagtgcaatgggcaggtgtgaagtcaaggcggagggcagcagacggggaccagggctcgctccagctgccttctggggcaggtgcagaggggtctggagtagctcccaaagatggggcaaggtgggtccgagtggccaggaagctgagggtggtggtgcggaagggggtttctcagaagatcagggggtgcagggttgagggcagcagcagacttgcggggcctgcagtgaggaaggagtcatgtgcaattctgaagacaacatctccggggtggcaatacgaaagagagggtgccacccacggctcggtgtctctgccctgggtctagggtctgagttccggagtgatggagggggccaagcgtctgtgaaacttggggggtggtctgggtcacgactggggacgaggagggtctggaggtcccagccctgcttgtggatgcgctgttgttccaccctctggctctgcctccctgtctgtgaaatggggtcccacttccttgaggcctcagtgctcaggatgcaggggagatgctggcagccgaggagaggggcaaatgctggctgtcaggggctttctccaggatacaggacagctcaccctgagagtgccagggagggttagatgaagcaaatgaataggcatggttatgatccatctccccagtgatccagaaaatggcatgcaggcggccatatggatcagtcaccatctctgagtggctcggctgcctggcggtaaacaccgggcccttcaggcccccaggtgcggaccacaccctctgcacctgctccatgagtgcccgtggtcatggtgggggttgagggtaggggtctggctgtccccatttggccctctgtgcacctagacacagaggctgtcacagtggctgccacttgtgcccctgcaggccagggctcatccaccccagggccatgtccaggcatctgcctggctgaggtgcactggggctccactgcccagccgggacctccagggagcaatgagcctgggataacattcaggagacccgagggtgctggctactctggtccaagcccctcgtccctcacagcgtgctcaggataggacccgcagtcccaagggccctggcctctactttcaggagcctggaaccccgggctcctgctgtccccggccctgcagcagtggggcgcttcccttggtgtcacctctctgggcacccccatccccaccatgcccagtgaagctctcacctgtgtcctcccgtccttgccaggcccttcgcctgaagtcctagctccagctggcctggggcagccactcggcaccttgtatcccgggagctggtgggcagggactggggttcccctcagcctccatgtgcctggccacctggggagcatatgcaggcgctggaggatgcctggctaggagtctatcagctcctgtcccgacctgcagcggttctccctgatgaccacagaaacattccctgtggcaggtggcaatgcttagcacccagagcgagcagtcagatgagatatgggccagctgcagaaatctgggtgctggtgtgtaggagacggggaggccccctcacagttgtctgtgtctgcatgtgtgtgtacacgcatgtgtgtttgggacaggtgagtctgtgcttctcccatcccaggccactcgcctcctcccagggctcagcacagtctcctttctccaggataagagggccctggggtggcgaaggagctgccttgcggtatggaatctgcctctctccacccccttctcttctagtcctaattctccttggacatccatttttccggtttttgttttcatttaaaaaataactgtggtaaaatatatctgtaacttaaaatcgagcatcatagccattttgaagtgcagagttctgtggcagtcagtccatctgcatgtcaggcagccatggccactgcgctctcctgcacgtcttcctcctccccaacaggaactttgtccccactaagcaccaccgcccatttctccttcccagcccctggcggccccccacttctactttgtctctgtgattctgactaccccaggtacctcatatcagtggcatcacacagtgtttgttcgtgtgcctggcctgtttcatgcagcatagtgtccccgaggtctgtccgtgttgtagcacacttcagactctccctcctctccagggctgagtactgtttccctgcaggcctagagcacattctgtttctccgctagtccgtgctgtcaccctcggctgttgtgaacactgctgctgtgaacacgggtgtgcacggcgcctgttttccattctgtccagtctcgtggtcacaggcgctcccaggccctcctgtccatctgtttggcgtcacttttaggctggaatggaagcccccaccgctgcactccagcctgggtgacagaatgagaccctgtctccaacaaaaccagaaccagtatatttggcacaaaatgcccttacgtcacttggcgggggggggatgtaggaataaagtgactcttccctgtcgatgtagaccatttgggcatccggcaaacagagccttcccttgacagaacagatgccccacctttctggtggccaggggacaggctgcctctcctttcccgcccgcccatcagctaagtgcctgtcttccaggatggtaaccaggctgtgccgtaggaggccaggtggcagtggccttgggctgtgtcaccagtctctagcctgaccacaaagggagcggccctgggggaggtgcagctgggggacaggttccaccgtgggagtcagaaaacttggtggttccccacacaccatggcattaactctcttgttttaaagaaacatactgcatatcataaggatctctgtctgtgagtcagcgaattgcacgtgcacgtattcatcatgtggcgcttttccctctgcatgtcccatctttggggacgtggtggagcgcctgtcgggtgtggcgggaacacgtgtgctgacctggccatgtctgcttagatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagaggtaaggagggactttgagtgtgcctctgcatgccggttcccacgtgctcccgcctgccctccatgagcctcccccgctccagaggacacagggcatctgaaggtcagccaggctgtgtctcccatcggggctgctgtgacaagggtgaatggagcggcaggtgatgcggagccatcccggtctggctctaactgagcaaccgggagggcacaggctgctgggggtgctccctggacactacttttgggactggacctgtatgtccagttcagaagctctgcagggcacacagctctggccaccctggcaggcttgcctctctgcccttgctggccatcccctcccacagccaggctgcttgccctgtcccacttcactggctgaaccccccacagtccagttctttctggcatcgcttccacggcagtgtgaggatggtgtgggggaggtgcaggttttcctccagagctcacaaggaggcaggatcattgggaggggggatggtgctggggaggtggcacatacaccgggggaggcctggccagtgcgcagcgggtgtgcgtgtgtgtgtgtgtgtagtgtgagcgagtgtgggtgtgtgcatgtggatgtgtgagagcatgggtgtgtgtgggatgtgatgtatgagtgtgggtaagtgtgggtaggtgtgggaaatgagtgtgtgcgtgcacgtgggtgtataggggtgcatgagtggatgggtgtgggtgtgtggctgtgtgaatgtacctgagtgtgcgtgtggaggagtgtgtgtgtgtgggtgagtgtatgcggatgtacgtgtgtgtgtgagagcatggggtgtgtaggagtgcgagtgtgggtgtgtgcaggggtgtgtggctgtgggtgtgtgtgagcatggggtgtcaagcatgagtgtgtatgtgtgcacggctgtggctgtgggtctgtgagtgggtgtgaggcatggggtgtgaggagagtgtgagtgggtgtgtctgtgtgtgtgtaggggtgtgtgaaggggtgttcagcacaaaggggctgcaggctctctgggaagcgtggtggccgcacgaggcgggaggctgagagctgaggagcccggcctacagaggggcccgctggggaccgggcagggaatttgggtctggggacagcagcagcaggccgggccgtctgtggtgctccccctggtggctctgtgaggctgagtgcgtggcgaccatccttgcagcctgtgggtgggcgggtgggtggaggggtctctagttcctgttcttcggatgaggtctccaggagccacatcgggacactggtattttgtgcactgcagggtcggctgggagctgggaggcctgttttccctggactggtgggggcaggggtctggctcaggaggaggaggggccaggcggacaccagcctccctttgatggcttcaaagaaaggaaaagccagtgttcccaagtagatgctttgaagcggccgcccccacggccagcagccccacacctgtgaggaaatccacccgtggaggagcgggcgggagaacggggaagaggcaggaggcggccggggcgttggaatcctttcagccctgccgaggttatggtgcctgtttccagcagctctgagcccacgcggaacatgagtcgctgataaacaaggcttgcagttgcgaggggcctcggggtgggtttctggttgaggaacgccggggaatggctgatggaggaagcccctgccgggagcaggagcagcggaaacctacatcggccacacagatcccggcgggggagggagggcaacgctcagaagcagagctgcgcgatgtgcctttctgggctgctcagcccagggcccgagacctgcttgcctgaggaggggcagatgcacggcggctgcaccccgtggggaggccagcatgcctgcggcagctgaccctggcagtgcgagggccccccatccggaggccgcagcctagcacagtcccgggcaggacaggggagagcgtcgtgctcaggagaggagaagtgggcagtagagctccctttccgttcttgaagcagacgtttagagtctgctccttcccagtgtccgcaaagaaggattacaaggcgcgccacccacacggttggtctccctggggcggtctgaggccttgcttgtatacccagctcctttggagtcagggctcgaggccaggccccaaagggtcatttgctcaccgatccccaaaggctaagaacttgaggtgccctgggccccagcgagcctgttcccagcccccagcacactttcctggcccgtgtgtgttttgtaagaaggggtgtaggccgggcgcggtggctcaggcctgtaatcccagcactttgggaggccgaggcgggcgtatcacgaggtcgggagattgagaccatcctggctaacacggtgaaaccccgtctctgctaaaaaatacaaaaaaattcgctgggtgtggtggcgggcacctgtaatcccagctactgaggaggctgaggcaggagaatgacatgaacccggggggcagagcttgcagtgagccgagattgcaccactgcactccagcctgggcgacagagcaagactccgtctcaaaaaaaaaaaaaaaagaaggggtgcgtgtgtcttcccccattgagctcctcctcagtgaagcagagtgcatccctcgcagtttctgccgaggcctggccacccccagccagccccagtggatgggcaaactgttgtcaccactagaagtccaatttctcacccctcgggtgtcagctggactggaagcaaaactagcactcaactgtattgactcctctggagccaggggtggggacctggagtctcagtctgctgcatctggaaggcatcataagtgtccccaggcctgggcaggctggccttcctccttcactctaggagatgggcatttgaagcagaactctggggggtttgcctctgtcctttgctttcacctgattgtgggaggggaggtgggagggcagcggctcagcctcctgtttctgtccgcagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgaaaagccgtgtgtgtgactggtctgttacctcagcggcgggtgcccgcctgtcctttcattcacagcttggatgcggctctgcaaattcactatgcggtggcagccacagctgctctgtgctcctcctggatcctgaaccttggaagctgtcactaatgagttcggtgggtgggtgctctgggcaccaggtgtcagctgggcaacgccccgctgcaactggaggtgccagcaatgctaccaggtcacggggtcagcgccaggttcttgacccacttgccccagcagggagacacgtccgcagagcactcactaatggaatgagggagccagggagccttgggcttcttcagatttcaacgtaaatggcccctgggaaaggtgtgcatgcgtgtgcgtgtgtaaaagccggaccgcccatcccagcaccctgtctgcacctgtgggtcctttgcagcctgtctagagtgacaattctggcagctctgccagcacttacctttcttcatggccaccgttctggtgtcacctggtgtgggaaagccaggtagcaagcacgggctttgttcagaggcggtggcctggggtccagctgggttaggctgtgggtcttggatgggcaggagccctcctctctggcctgcccacagcagcgtgagctccttgctgtgggcactgaccaccttcacggcccaggattcttggggaactgcagagtaaggagaagacttactctcacctagccgcccagagggtgtgggccaagggcttgctccagcatgaccttggccatcaggggcatataaaagagacggcctttcaaggcgcacaccagctttgtgcctccctcttcccagaaagtatacatggtagaggcaaagaaagctgttccataggagactgtcacagagagctgcgtatatgccgaaatgtatatgcactcgctctgaatgaatatgcttaagaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaattaaaaataaataaataaataaataaaataaaataaaataataaaataattcacaattctagcaaaaaaaaaaaaaaaaaaaaaaagaatgaaaagcaaatacaattctcgacgtggccaacaaacaagaatgccagggatggccacatccttggggaatgaagagaaatgtcgcctgagtcaaagctggagggaacgggattccactcaggaggccaagggggacattcctgccgtgcccaggacaaggcggggaagcaggtcccggggagagagccctggctagctgaggacatgcaggcaggactcccaccaaatcatacacatctttaaaaaacctgtatttaaggaaacatctgagccatggcctgcattcctcccagcagcccttggaggccatgtccatggaggggctgccatggccagcgtggacgggcgtgggtgtgtccaggccctggccctccccactctgccccggagttgaccctctccggaaggcttctggaagcacagctgagtggcatgggtatcccaggctccccggctggctactgcaaggtcctctcaggaccctgcccctggccactggggtacacagcctctcagcctgcctctgtcccagttagacctcagagacacagaggccagaaatacttctttttattaaaacacggatcattattaaaacaccttgaggtacattaaataaatacagcctttccagttgtacagacaggtctctggtggcttgaaaacaatttcctataaattctgccttagcagcctctgagagtcagcatgggtggggagaagcatgtgtgtgtagcgagctttctgtggcctggtgtgttacaagcatttaatgtggatcctcatctccagccaagggagacctgaagtccttgcggatgatgctcccccttctgcgatcttgcttgccatagagttggggtccatgttctccccactcagcaaccttgtggcccccaggctggggtcaacggtggtgtcacagcaggtgccaaccccctttgggtctcaggggagggcaggggatgcccggggcccagctgagttggagaaggagcgtgtcacccccaaagcagccacagttggcccatttcagatcccagatggaacatgattggagcgggggaaagacgcatagggaggggaagcagccagctttctcctgggctgtgagctgacgtgcagcccggggcctgggctcttgctgctggtacccggatgccgtggagccggggccaaggggaccacagcttctgggtcaagttgccagcacattccctagtctaccagcacctctctcttctggggaccttcccaggaagcccagaacctggaccctcctagagtccatgagtggccctgagcagcggggctgatgggggcaccccaccccgtccctgactgcctcatttcgaaggggcagaaggttccagcccagcggcatcaagttgggtacagtttccgtatccacaaaacagagctgccaccagcgcaaacccagagctgggtgaaggtggggtgcaggtgaggggcctacagggaggcactgctggggcagcagccccattggccattgggaccgggccctgctgcagagaagggaaggatgctgagcagcaggctgagggggtccagtaggcctctgccccggctgcatgaggagaacaccccagagaccgagtccactgggtggctggtggtcttggcctcgctggaattgcagccatgtctgaggactgcagctctagcccacccaagggctcagcccagggacaatgctgtgtgaacccccaagccctagtgtggacccccccaagcaggtgaaacccctgcggcgtggccccagcgcacctcagagacagtggagattcagaggccagggcgtcaggcgtggctgaagctcggctccagggcggccattctgaaaatccaccaattaatttcacctgcaaagggacttgccttgagggaattcaaaagcccccacttgaggaaaattagagatttcctgttttatagtctgaataaagtgctcaaaaattcatctctagtacgtctctcctgcaaaagtgcaggttgtcatcaaaaggcctggcttatgtgttttcagctctctaaagcaatcgaagccttttcagccgaccacagctgaaggagtcccacaccgcagcccccagggcagggataaaggactggaggaaggctctgggcacctggattggaacctcacccccttcccagcttccagccacacagaagctccccagcacactggccacagtggcattagggaattgggggagctcaaggacaagccccacaaagccgagggaacagcagcgtgagccccctgccctggcacccaggagtggaagacaccctctggtccccctgcgcccccatgccaggctcatgggctctctggggagaccttggcctctaggctgttttgttcaccgcagggcccacccaacgcagctcaggggctgtggctgctagtggccctgaacaggcatttccatcactgcacaaagttctcgtggatggcgctgttccacggccattgttgggagcagctgccactgatgccaccagaaaacaaggggatgggggctaagaaagtccaaggtccccaggctgtccccaagctgggcgtgtctgcttctccataagcagcacgttgggtgtctgcttcccttctcgtgtgggtttgtaagtggtttatgatcctcctgcgcaggtgtgtctgctgccgcatgcccggggaaaggtcagctctgggtcaaagggacctgctttatcaggaggggctacttctcagagaaaccggcctctctcctgcagaactgtgacccgctgagctcaatcaagtgagctcagacacaaaggagctgggaatcggcacttgttgttacggatcacacaactgctccagggacaggatgggagcctggagaaagggggcccaagaggagggggggaaggcaccccacggagggaggccgagctcaaggcccaggagatggtgggttcctccaacccccgcaacaccggcctgttccctggggggggccgggctatggcagaggcccgcactgcacatttgtttgcacaatagccctgtggacagaaagttgggcccaggctgccatctgtgctaacactacctatttcctttcacaggaaataggccagagcgtgatgaacgcctaatgatagagccatcgagccacatgagaaaatgtttcatgactcgatgtcaccctctgtccactgaacactaagttaaatgggggatgggagactcctgctttggaaggccctgattttggagatactttgagtctttaggtgacgtaagtgtcgcctgttgctgtattcacatttgtgcaacactgctcagttcaaggtgctgcacgccagataaaaccagagagttcactgtggacgtgaaagtcatctttccgaattactgggctaggcaggaaatgcaatccccaaagagacactgctcggctcccctcgagagagggggtaacagttccctgcccacaccgcccccagatcatcctgggtgtcccccccacatttatcctccgccaagctgggcctgaaggcctctttgtcaggcatgatggcttctgccaagaacatctgtggcgccaggcgttggtgtccacggtcagaaatgtggctccttcatacctggtccagaacgtcagcgccgaagacggcctcctcctcgaggcgctcctcgttggtgacagccaagcgcatggcacccaccatgtgctgtgcctcggtggggagggcacagtgtgagtgttccaaaaacttggccaccaaaaccctggcatccgcataggccttgctgtccactaaagagcgtggccgctctttggaggtcgctgggaagggctctggtgttggccgttggtcagttttccaggtatctgggtcccccgctggtgaaagctgggcccgacaggcagccgtggcagagcgagacatggaagctaaaaatcaagggcaaaagtgcagttcaaaactcactgaaataagaagttaactcaaaagcaaagaaaagcctgctcgggaggagcctcctgctggggtttctgtgttcctggggctggcgctctgggcatgccctgctgtccccatccctcctccccttctcaaccccaaactgaactagtgtcaacctccaggggctgcagcctccaggagcgaaggcctggggggaagggccaccacagcaggcagcgacccacttctgccctctgctagaatcccaagggcacaggggctggtccttcccagtcttctcgcctccacgacctttgcccctttgggtctgatctcttgctggggcagaatcatggcatctagagacagggtctgccttaagaccagaactgggggtggcagagggaacatgagaccgccccccccatcatgccaggtgcaggcagccaccactcagtgccctgctccactgcctgccaggccagaggctggggacctggctccagctccccacagagctgacagcctctctgcatgacccacaggctggacactgggctgagggtccctgtaagacggccagctccgggctgtcagtggcgagggacgccaacaaggaccagcgaaggcccggcttgcccagcctgagcttcacgccacacaaagttggaacattctgggtcgtctgttctggtgtcttgtttggtggcaactggaaagcctagcaattaaacatgagaaattaagaaactcccaggtggggcccatctaccccagatgaaatctcataaagtgggctgagcagtcacaggtgtgttaaattagtgctagccctggatataagtgcaccgagagacaaaggaagagaaaggccctcaaagccagacagtgggcagcccccattcccgggggtggggtgaggagctgcatttggaaacaatgtagccaaggacccaccaacacccgccccacctcccagcaggcgcagtcaaagcgctttagaaaagaagcgtctcaccgctcccaggcacagcctcagacagtcccgcttccaggtcctggctacacgacggcctgtgtgaagaggcatcgccttaaccagaaggagaattcagtgaacacatgaaaggaaaaaggaattcctgagaaagctatcataacccgcctgtgactaagacattttagatggcgagcaagcaggagaagcctgctgagctgacacccaccgagcggcagatcagacaggaaccgccctgcagctggccaggcctgccgtgggtcaagtggtgtcccaggtcccaccctgacacagtgcaatgggccagtggctcaaagaaagcccagcacccttcatgggaattcccaccctcacctgaagggctccaggcaccctggaaggcatgtgcctgcggcgtgcacatcagcctagccaagaggggacagaggcgtcaggcgggtgtgtgggtgccgaggtgtgaatttcactgagagggacaggcccaacaaagccatcagggggccacagagtggacccatgagcccctccaagtacagggcatcctcctccaaacctcagtgagtgaatgtgagcatggtggagagaggttccggagctcaagaaaccagcagaggggggtgtttcagaaggtttgacgggactctctccctgtgagctggcaatgggatgcaggaaggaggaatacagagatgaccgcagccagggagtccacatgtgccaaacctggtatttccaccaggagggtacctccaggcaactggccactgcgggctctggttcctttcagggactcggttccgggctccagtagagatcagctgggcaagaccatcgaggggagactgagccaggacccactgcgccctcttcagggttcctgcacttccacttcatgaaaagtccccacagcaatggcatggaggtcaaaggcccaccaatctttattggcagaaactgtgcctcctctcaaaagacagtgatgaggactgggtgtgagttctccagcgccgggggtgcccaagactcccggggagctactgtgaaatgcaaattcctgcgctgctggccacagggacctggtgccaggtcctaggctccagggcactgcccgcagacacagtcgcatggggcgatttttgaaagctctgggctgtgtggagagccaagctgcctgggaaatgctgctgaaaacgcacctgtgtctgcgtggggcggctccagctgatgacacccccatgcccagagctatcgttgggggtcatctgtcctgtgccagactctaggccttttctgggccctggagcacgtgtgcagcacttatagctaatgtcctggactgggccccgggccccttgaatccttcctcccctgccagagtgacaagcctggtggggtgcagaggggcccacaggctgctccccacccacccctggctcaggggccatcaagaccacattcccagtgtggccccagacaggatctgcagggccgggcctccactctcaggggtcactgagacctgcagcatccaaggaaagctggccacactctggggacatgggtgagcctggccaacctacctgccatgctagatgtgcacaaggtggggtcgctggtggagcgggacacacgcccgggacctggctgcacctgtgagcccatgccaggatcctctggagacacatggccagggggaagggcaggttcggagggtgctggggcgcccacagggccatcgggggatgggctggaacctggcgtagcagtgccctcggacaccaggaggcttgtgctgtcagctggtactgcaagagaagggacatggcattagagtgggcggccgcaggggacgctggcgtgggacaggcctgcccctcaaactccagacctagatgaactctgaaaccctgggggtgcggaaacactggataagattgacaaatgctgctttatgctgttgaaagttgggggcaccagatgagctcccagaaatcattccaggaatggcatggttcgggggcttagacccttcacactacacaagagactaaaagtcagaaatcagacactttggtcacaagacgctttggtctgggtgaacagggccagtgcaggggtacacagcagccccaagggacatcaaggcatccccaccaggtcgcggcaggccagatctcaggcccgcccttgcaggggtgcagccccgggcctggagtgcagccagacagggtggtgcaggcaggtgggataaactccgcccaccagacactggccttggctctcagggtgtggacgccacgccagcagcagcagcagccttgccctgggaacaagcggggaatgcagactctcagctggaccccagacccatggaagcagagactctggcgctgggcccagccaccggggttgaagcgagccctccagggaattctgatgccctccaaactgtaagaactgctggtctggaccgggatgctggtcagggctgggctcttgccgggaaccactctacgggggctggatcggagtctgttttaataccatctccacggggtgtgcatgcatgtgacagtgtgataagctgctcctgcactctcccctcccatcaccaggtgccctcagagccccctcctggcgccacagtggagttgcctgcatgggggacacttcatagatcacagaagcctggactcctccaggcgtgggggctttgggtctgttcctgccatccctttctgtttttccctgcgtctgtgagcctgcccatgggcaacaggcttttcaggccacctcccacttcatccttcctgtccgtctgtgaggcagccccaggttacccccaccctacagctgcagaaatgggcttagacagggaagggttgagggtcacacagccaccaaggtggtcctctactcaggagagtcctgacccctgtaccccagcagaagcctcggtgctggaagctctgctggtccctgggtcagctgtagagttcaccgcccaggtcccaggagggaggaagatccagccctgctgaattctgggtgaggagcacccctgtctatttccacctgccctgagatgggaaacaggaaggggctcaggtagcaccagcccccttcagcccaaaccctggaatgctgcaggtgtggccgccctgtgacagtgactgagatacactgtaccctgggttggccgtgggaaagtcactgaataccttcttgaacagcctctgatggcttggagtgaccaaaggaaggaaaagattgcttccaaatcccacgactgcaaagatgctgcgctctacaacccccggtggcctcagaaagatggctccttcctgtttctcttagatgctgagtgagtgttcagcaggggacagagcgccctggggcgatcatcctggccctctgtgggatcacatgagttatctaactttgttctccaaataagccagcccatgtgacccctcgcaggggcctcaagacggtggctctctggctcacttggcctccgtgccctttctccctctgctgctaagggcccttctgctttcctggagccttagaccacctcccccgccccggctctgcacgcgacacccaccctctgtgtctggggatttgacccttgcacacgtgtccttcaatgccctcaaggacatgacttccagcctgcaccctcctgccagccgcccagcccagccaccttcttcagagggaggtgccgtgtggacatttgcccggtaggtacaactttggctctggaaaggggaccctagatggagtcgtgctcttcttcaaatccatatccctcaagtgagaaagtggggcagaggaagacaaggtctccccggagagcgcaggagatctcctgcatatgctgactgtagtggatgcagacacaggaagaaatgtggggatatacagggtatttaatgggaaagactgctgcaaactccaccctcttaaagagtaagaaatggagggaggaggaggaaaaagagaagagaagagaagagaataggacgaggacgaaaaagagacacccttgaaaacaggaacaccccacttcaggagctgaaagaggtaagcttacctggagtgctgaagccagcactggtgtttgggtccccggagctggactcggccacctgctgacctatacttgtaacctacagtaagaaacagaaagcgtcaaggcggctggtccgtgggaacgcagcacagcagcctccagtagtgtaggcgcttaaacttgtctcctggtgggaagcgctgagagacgttcatccacacctccactcttctcccctacatttatgaggtggggtgtgagggttcaagttgcccttgccaaggccaaagtctagttttcttttttctttttttgagacggagtcttgctctgtcacccaggctggagtgcaatggcacgatctcagctcactgcaacatccgctgcccggattcaagcgattctcctgcttcagcctcctgagtagctgggattacaggtgtccaccaccgtgcccagctagttttttgtatttttagtagagatggggttttgccatcttggccaggctggtctcaaactcctgacctcaggcgatccgcctgctttggcctcccaaagtgctgggattacaaggtgtgagccaccgcccctggccgaaagcctatttttctgaacttttgcaatcagagagcctggcagggccacagagccacctgagcctacgagttgcacagtcatcgagcttttgtggctttcgatttctttttcttttctttatttatacattttagagacaaggtctcgctccatggcccaggctggagtccagtggtgcaatcatagctcactgcagactcgaactcctggggttaagcgatcctcaggcctcagccttctgagtagctgggattataggcatgagctaccacgccctgcttttttcagctttcttcttggatatactctgattccgcctggagaggcctcagaataaggggaaggctatacctcctctgctctctgccccatcttcattttgcccattctgcgtgggccatggtttccacctcagagggcatcagggcctcccggatgcgatgtttggatgtgatgccagctacacacatgttgcatgagcacccccatgcaccccatgctacctcagaaaacaattttttgaatccctgtgttatttcagaattgctttggggatacacttgcaaataatgagctccagaggagactgggaaggtgaggggggctcctgcgacttgctctgattccagctcaggtaattacatttctgcctcccttatctcccgccacttcaatcagatagctggtctccttcatctctcctcttcaaccaggctgacaccagggcgggggctggggctgcagccttcccacccacacaaagggtgtgagctgcccccacagcgtggggctcgagaggtggttccgagacaaagagaagacggagagctgcccaagtgcgtcctttgatctcactaagatgctttcgcataatacggtccatactatttttcttccttagccctctcattctgctgggagggaatcggtgagggagaattcaccccaccatcagcacccacctgctttttcactgaagtcattatgtgccaataaccagtcctggaaatctctgtccagaaccttccactgaatcacaaagagcgaacaatgtcctaacggtttgtttcatcctgtgtctcccctcccgtatctaaccctctctcggacttgcttttcttttggatcgtagacgggtggttaacttagaactccgctgtctaaaagaaaatcttctggtaataaagaaatataaataaaacaagagaaagaaaatatacagtgggacaaggtcaggaggaaactggattcacttcatgttgtgcagaagcatcattcacttccttctggctcccggtcagatttggtttccagaggaggcagctcctgggagcctatctatcacctctcgcaagcagagtgtcaagagtttaatttaaatgtggcccttccctgatgtcagaagccaccttgccacgctaagccatggggaaaatagcacttcctttcatacagcatttttgatgaactataacagcagtagaaaagggtggggaagaaatatatttgtggcatagaatttaagttgaaatttgagttcagtgaggaagctcataaacacagctccttacagaaggagagcggggagagggctgttgacaggagacgctgtgggaatcacttcacctgggtcttactggtttgcagatgtgctattctgaacagtcatcgtaactggaaaataagttggcttttcaacaaataattcaaattgtatgaagctaagacacttgcatggaaattctgccccattctgtagtttcccactcctgggtgaggccaaccattagaaacagatttatgaagagctcttcgtttggggcaattccagcgattatggaaaatgtgagttaaaattttaggctggtggctcaaggcaaactttgaagacactttgctaacagattttatgtggatcgtaagtgtcaggacctggtgctgctcctggactctgctggtccctctcccttctcacaactccttgtctcgcactcaggttcccttccacctggcatgctgccaccaaattaaactcctaaagcatcactgggtcgcacccaagacgccaaactcctcaagggcacttctacagtttgacatccaaagccataaaatatctgcccaaatgatttcagccctggggtgctgaagctcccacagccaggctccaggctgtcctgccatgcgccttagctggtgctgtgaccttcacctgcaccacctccccctccttcacacaccccagcccgacaagcccccccatatcacctccccctctacacgcaccccagcccacccagatcaccaggcccgattcctctgcagaagcctcaaaggagttcgtgtctgtccggtctccatgtgagagtgcgagagtgccacgacagggggattctgtcctacatcctctggagggccaccgtcgtcagtggcccctgaaccatacgcttgccacccagacaagaagatcaaactggtaatttctcaatcactttcctgctatcaaaagaaactcactccttgaacactggctgaagagtacagcctcaaaccacaggaaagagaatggcatctgacctaagccggaagggaagtgtgcacggcccgtcacccatgcgagtgctcacggagcccaccctcgtggaggccgccccctcttgggttaaacctcttccccagcacaccccctgccccgccccagagtcagctcctccccgacagagcccgccttctgcagcctcctctctttatccaaactgaggccgagggcactttctacgccatttgtcctaacaaggaggagcactactgaccctgcctcgcccgggctgcggggtcgtgctgtgaaggggtgctccttgctgtctagtcagaggggccttgctgcctggggaggggacagctggtggtgcagctggcggcacggccttccctctgtggacggtaatgggtttctttgacttccagactcccagacacggccgtgaattgaaaagtgctcccaggccatggggtcaaagacagtgggcccgagggctctagcggccccttcatcaccagatgctgccctgctgccaggcgggcgcccagggacaggccctgcaggcggtcgtgctgtgcccctgccagcactgggagctgggggtctccgagccaacacatgctaattcgagatcagcctctgacctttcagctgttctcaccgcagttctgagaaagagatctcaactgagagaattccccagagttctggagaagggtgtcgcattggtttcagaaccagccagatcccttccaatatattctattcttcagagaaaacagtaaaactgtgaacacaacaggaacccattccttccgggggccgctgtgaggtcagacattgaatggcacacccaggtccagaagctacttccagcaggcagggccctcgggaagccagggtctgggctccacggacaggggttcctgtcgtcaggaggcagaggggtccaaggggcagggagaaccgggaagcaggctcagagccagtcccagtgcagagccggaattgtgatggcagcaggcagggtcactgagcagaggcggtgaaggggacagagctgcccccgcgccacaaggcagccatggggaaccacacacccctgccgccttcaggggtttccgggtccatctgccgccctgcccggtgcccctgctggctacagcatggagcttcccattgcaccctcggtcagcctcccctctgccttcccaggggcttccctcacggagggccctgtcctgggcctgccatccccagtatctaggtccttccacatctgcctggtaacctcctcaaggtcctagatccacactcccctctacctaccatcccatcttctctcctctttaccaaacatcctgcgagagtgatctactcctgctctcaaagtgggagcagcagcagggctgaggcttttatacccccaacttcaataccccaattactgactcaggagccctgggggtgggcccagtcattaggatttgattatcaagttccccacagggacacccactggtgtctgaaaaccacagccacacctgcgctcccctgcgcacgtgccgtccactcctttacctggtgtggtccagccctgccctccatcgcatcaaagctgctctgccaaggccaccagcagcccctccatggtgcgccacgtggccctggatgttagcttctggacagcacctgacccattgctttcttccagaactgctggttttggcaaatccaggctcctgggagccctgcctagtgccctgtagcctgtcgtgtgtgggggtgcctttctcctgccacctgcaatggtgtcattctgtggggctccctctctcacatttcccaggccccagtgacagcggcagctaactctgatcactatgaactacagctcctgtcatctggtggacactcactcagaattcaacccaccacacccagacaggtcaacacccatgcacactcatccgagactctttacggacgaccttctgtttgggggatacgctgtgcctgtccttcttccctctgagcctttgcacaggctgttccctctctcaggagcccttccagccccactccctgcacctcgcatgcctgatgcccacccagcctgacctcccagaccttccatggacccccaaattgggcctgacatcatgacaggtgccccacagtgtactgggctccccttgcagtgctgatgacaactattatcacagccaactgtctccactgataacattgatttgaattatttttatcataaatggaaaactaaacaacattgggaaggcagaggtcccagctcagctttataaaaacacctaagaacatctccattactgccagttcaggaatgggatttcagggccatgcccacctcctgactaaaggattcctctccacaggcagctcccacacatctgcttctagcacccacagtaaaaagggggtcctggccggggctcagggggccactgtctgcagcctgcctggctgctccaggtgtttcagggtggctgcttggggactgtctgcttgtgtgaggatgtgctgggggctcacgggccagccggaagctgatctggcccaccacaagccaccctgaaggaggtccctgtggtatatatgactccccaggtgcggggcaccttacagcgtctgaatgcgctgtccatatatgactccacagggcacagagaagtcacatctcttcctgtcctaagaccaccctgcctgcaacggtgaccagtccttgtgggtgtgattgtcggaagggcttgtgagcttattcagccaacatggaaactgctcctccacccacagaagctcctcagggtcagcgctgccttggtcactggttgggacagggaccagcattgccacctggcttgcgtgcatgtgggctctcgggatctcaaagtgacagggagagcattgggggtgacatcaaaaggtctgaaccctgtgctagggtgtctttacaggagtcagcagacagcgagcagctggccaggcctgatctgatgcccggtaccagtgcctggccagtgatctgggtagagataaccatccggggctccacggctgctgagaagcccaaagcaggtgcagttctgggtgggcctggatgcttctggtcatgctgtcatctgctctcctctgcttgttgcttgggctcagaattggcttcagcccctacccccgcccctccctggtgaatctgcaagtctcccctgcccacgccctctgctccaactcactgctgtgttccccagccatgccccagtccccgaggcctccaggacctccttggccacctgtcacgggagttctctgcatttcctaaactggactgtcggcctctctagcaggattggggcaatgttcatggatgatatcctaaaatatgttttccagtcgtttgctttctctccctgtatttcagggacaccagtgagctgtcgatttggtctatttacataaccccatgttccttggagggtgggtccttggaagatcccttgcactatgggccacgtgacttttccagatgtccccatctctctgtcctggctagcagcattccacactgagtcatgacaacaacgatgatgaggaggaaacaataccccaaaagggtgactgacttgctgaattcagaacttcccatgttccaagtcctgttggctccattacggacaacatcccatttcgtcccataaccctggtactgttatgatcctcattttacagatgaggaaactgaggctccacgaacatactgcctgtcacgtgtcaggcaccatgaggctgcaggagtgcctggcatgcccagctcagagaaggctgaaaggacctggcaactgaggcacttccctggcctgaagcttcttggcctcagacaggaccagggatccagggctgctttctccccaccccagagggcggtgatggcagtgtgtgatcaagacaggccggggcgccctgggtactcggtccatggacccagctctgctcctgggggctctccccttgggtcaggagctgtcccaggtccttttacctggatcccagaccacctaccagcacaaagctcagacgcacctgggctgtgactcgtggctgcagaaatggaactggggatctaaggggaaaagcaccagcactgggttccccaggcccgggctggcgtctctgcaggtgccgctctctgagcctgtggcctcatctacagcacagggctgataagaccaacatcccacaggtttgctgaaaggcttcaagagagatgaatgcatccgggggcctcggcacagggcgctcatgagtgttcacctcacagccagctcggacctggcgcggtgtgaggtgccttccgagggcaggccgggacggtgtccctagcattcccacgggaactggctttgtctggggccccaggcctcacctggctggcagggggctggcccaccaccgcctcgtacggaggggggagctcagcaggatagagcaggccggggctattgatggccacgtcatacaaagtgccgaatggagacggagcaaagtccaggtggaggcccctgaaaagacagaatcatcacatcgtcattgcccgaaggaggaggcagaagtgctgacagctctcaaagccgccagagcaggggcggccagggcttcccctcttctaatacttcccatcattgtgaaatcaaagcttcagtcactgggcgatttgcacttttgttttttttttttttctggaacgacatcaacattttcaataaactctactgacctgtccattaaaattcaaataatcatacagctgattacatctttcattaaactgtacatgttacacaaatgactgcaacgtgaccgcagctttgcacgtcatgagaacttaaggcagcaacacctgtctgcctccggcttctttcgggttgcgttgcaaaggtgccacggggaacgctgtatgtctaagaccctctccttccactgcccctcctctgttctcaccgccatgcctgcaggaccactgcaactcccaccacccggacactgctgcccatcttagtggtttcgagatgggggcagccgcgggagaccaacctctgggcctcagtggacggtgtgcaggtgtactctggggggtaatagggtggaggcgggagtggggggatgaactcgtcgaaatccagggtctggtggagaacggtgccgtgaggagtcacgcaggtggggttggcaggatgtgacctctgcggaaggaactggaaaacagagacaaccacagagttatctgggacatcttgtgtggcttgtgtctcattaagctaattatacgagagctttaatgatcagtttggaatgcctgtaatttcaactgtcaagccatgactgctaagcacacactttaaaatgaaggcgccaggaggaacgcctcgtctcagaagtctcaaaacgctttgttgcccacgctgttatacagaatgcctctttttaaagaaaacatatggtctgggaagtctttcatgctgtccctaccactccaactggcccctctgatgacagtactcaaagactgcagacggaaggctgcctgacgtgcgtggtttaagacggcacttcggctgggtgtggtggctcatgcctgtaatcccagcactttgtgaggccgaggcgggtggatcacctgtgatcaggatttcgaaaccagcttggtcaacatggcgaaaccccgtctctactaaaaatacaaaaaattagctgggcgtagtggtgcatgcctgtaatcccagctacttgggaggctgaggcaggagaactgcttgaacccgggaggcggaggtggcagtgagccaagattgtgccattgcactccagcctaggcaacagactggagtgtttttgagactctgtctgaaaaaacaaacaaacaaagacggcatttctcaaagtgtgttcatgagaaaacactagaccctcccctcgaaatgtccccaccccaccccagaattcccgtggtcaatctgtgggaaatgccacatgctcccttcttggagtcctgcattgtgcattcgtgtgttaaaggctctgagaagggctgtgctgaagtacttatttagctgtttaacattttaacccagcatttctcaaatatttcataatgggcccctttggacacgtagtatctattaatattttgcagtctcaggatttcacacagtttgtaaaacactgctctgaggaaagagagacaacttcatgagttccagaacattctactggccaaccttgaacaccgagatgctgctttaatagtgaggtgaaatcactttaacaaaaatgaaacctgtttctgcctagttttccgtttctgaaggactaaccaacaaccaactgcttttctttccaccttcacatctctgctgcccagaggtcacctgtggcgtgagatgcctgggacattgctccagctccagtcaatgccgccctatgagtgtctacacggcaagaagatccatgctgcaaaagctctgggccaggggccctcctggcgcagggcaggtgaggtaaggagaggaagggtgagtgcgtgtgtgtctgtatgtgtgtgttgtgtgtgtgtgtgcatgtgcatgtgtatgtgcatgtgcatgtgtctgtgtatatatgtatgtgtgtgtttgtatgtatgtgtatgtgcatgtgtatatgtgtatgtgtatgtgcatgtagatgtgtgtgtctctgtgtgtatgtgtatgtgtgtgtatgcgtgtgtgtgtgtgtgtgtgtgtgttgaggggaagacagggacccagaatcaccctacacaagcaaggacagctccattagaaaacagtgaggtctccaagcactgtgtggggactgcgctccccaaagcattcatgaagaacgcatctgaacgggtcttgaaagattggtgggatttcatctagtgggcgctcagggagacactcaagccccagaacaggtgagccagggaaggatgtgtttaagaaaagcaaatagataaggctctggaagtcaattcttaattctggggcactggggagcctgtaagggtgttggagctggggagcagggggactggagctgcgtggtaggaggtgccttctggcagcaggggtagggtgggctggagctgacagaggccaggacgtgaagcacttttgcacgggtatgggtgaggtgacgattctgaatggggtcaagcgctgtgaaataagcatgctctaggttgacgaagaaaggctggtggccgtgtctaaaggtctaacacatcacaggaaaatggctcccgtgggcctcctaacacacggagcacactcctcgcctctctggctggaccgacccacggctgcgtgtgtttaattgtccgaaacagaggtgaatcatccgctgtgagcgggacgcatgtgcgtctgtggtcctccgccttggaggctgtcagtcctgatgcctgctgcacagagctgagaagcagggcgagggcaaatgccctcaggtctaatcaggaaatattttcaattagtctctatcagaaattagaaaaaatatcaatgacatacccaagcaaaactaatgacatgcagacaccaaaacactttccaattcaaggcaccattccaccaggaaggagaacaagcatttgaggaggggcagaggtgcaagggaccctctccgcaggtgcaagtgagcagaggctgccacacactggaggctatgtaaaggtcaaaggacgcggctgcatctgctccgggtcgcctttcggggacatgttggccccaccttcctggacccttttcccaggaatcctttgaccttgactcctcagcctccccagcgagaatcctgcaagtggcgcttgacgtctcccctctcttccccaccatcagtgtgtgtttaattaggtctgggtgtgtctcgcggcccagggtggccagctctgtcctctgctctgcaggctggggctggaggtctgcagactacgcttcccaggctgccgtgcctgggctgccggcaggctctgcctgtagggggtgccagagggcacctggccggcctgcggggcgaggagggagctgcgggtttcctgcgccttcccacctcctcccttctgttccccggctttgcgggctgagagctgccctccgcacttattccactctctgtaagctcagcaccctcttctgttccttcagccttccacacccaagtaacctgctccccgtaactgtgttgaaatcctaagggcaatttcttttcctgaccatctggggcacatctattttacccacctctgtacccgtctcacaatcgcacacagcgggtactcagtaaacttctgcagaggagacgggcagacgcctccttgcggggcaactccactcagcccctgtccacctcctcctcgcaggagcttctaacctgtgtgcctctctgccttgattttctgtctctgtaatttggtcgccatcctgctaccacagctgtttttaaatcaatctgatgaggtcactgcagttgaaaagactttaatgagaccctggctcactgaactccatctggtttccagcttcctaacccagcgcccccaaactccccgctctttgaacaaaccagctctaatccctactatcaaacacgtattgttccttcttcccagctccccacctccctttcacctggcgcctcccagtcaccttcaggaccagcggaaatgcctgtgaccctgaaaagccagtgggcagccacccctcccccatcccacccaagctccaggctctgcagcctcacctgcatgttgactgccaggtataaagctcaactctgcacctggaggtggagggcaaaaaaggggctgtgaacagtcccttctttcccaggtggctctgtttgccctgatctgtaactgtcttctctgatccatgtggtgacaaaggtacacctgtgtctggtgcccagctggggctcatgcacccgatgtgggcatcactagtgcccagggctgtccccgcacaacaggagtgaggatttgagaccccgctggagaagagcccctgctcagtctgctccggggagaggggatccgaactcaggtgtgtgctgtccaccttctcaggtgggtgcacgtggaagtgatggaggatgagaactaaggctacctggccttgggcagcttcccaaagcccacttaacacagagccccgaacatttcagtctatccacacagcccagagtctgggatctgagggagatcgtgaagaggtcaacctgcctgggaccgggagtcagaccgcaagtcagttgtctctgggccctgcctgggcactgagggcccacaggatgtgagcacatttctgatcctgtgagtctcagtccccttccctgagaagcaccattgctcacacagacccagacagcagtgctgtgtggctgaaaggaaggcttggatcattagtatgagctcatccagcccatgcctccatctcctgccatcgggaacaaggtggggcagggcaggcatcaggggtctgtggacaagggccggggatttgcagaaacaccgtggagctctgagctgcctgttcctccaggtcccagccgggtctgctcacctccctttatatttagtggtttcctgcccagcacccactctccctgctccctctaccaatgtccttgccacatcctggctcctgaagggagcacacacacctctgaatttttccagaaagactcagaattacagggaagggccttctccctctgccttccttagacttggtagaaacagcaggcttgttactaccgaagtttgctgaatcaacttcctcctggacaaccctgcagatgagctggagctcccgctctgcgctccagaccctggggagagcccgccctgcggccccctggtcctgccgccacccccaggtaggttccatgcccacccagggctccagggtgccttactgcacagggtgaggcctgtgttcattatgactgtaattgcataaggaaatagggatgcagacaggaagagctgctcgttctgtgaaaaccaagttgaatgctttggaaagactcaataaaggagggcagccaagcagaaaccgctgccaagtcaagtccaggcaaggcaggtctaagagcagagaagaatcataaaaatctagggaaggtctgtctcccctggctggcttcccctggctggctccactttagaggaactgaatctgaaaatcattgatggtgtgatttccacaaactttctgcaagaaatacacccagacaggacaacagacccataaccaaagggatgaccacagccccaaatgagatgactggttgacagatgctcattagcatatctgacgtcaaagaaaaacgattgtgtgtccacatcatttttatgattgtctgcattagctgtttggatgaagttcctggtctgatagataagtagcacctactgtccagagacaattctgtggagcccaggcctcaaggacctcaaggttactgtgggtccccagagtgccctctccagcaggtgcagccagtgctggggtgaggcggagagaagacactggtgaacttggtgatgctgtggctcccatggggtggtgtcgtgtccctgaccagccagcaccgcttaaccagctccatgggcaaacccacagttaccacgcgatggaaggcacagtgccccctctgcactgtctaaaggaggtcaactctgtagggcagacagctacctaaatgacaataatgaaagatgaagttaataagcgcatgcctaatggagatacatgtcatagtagatgatattcctgaggctgcagcagctggcgaggaagtaagtgaagaagaaaacaatgtatcagaaaagtggaagaatgagatgacatttaaaaacaaaaaaaaaatgacattacagacacttaaatgatcaaaaaccttttctgctaaatgatgtcaatcaaccacattgtatcatcagaatgtcttttgccacgatttccacacatattagagtagctcagcttcatcagttctgacaataggcagaacgctttgcttctcatggatacaagcatgcattatgctagttccatcggcagttaatgatcccaaattgctgatccacagaaataagatgggagtttcaggttctttggagacttgttcttgctattcctagattcccaccagcactggacacatagcaaagcccctgagataattgctgactaactgaatgaatgaatgagtgagcaaagaagtgaacagatcagtaaacacaaaactgggactcttcctgaaaaatggttacggctggaattttgatcaattgtgtaagttgtcagcacatcaatcacaatagaaatcacagcctgggtccttcctgctaacatggaggagcagggagaggggctgggaaagtggggctgagacccgcacagtggagcagagttgccaggctgcagggctgccttgggggcaaattgggaagaggtgctccttcctgtgggaggtcagggcatggctgtcatcccctcagcccagcacccctctgtagggcgcagcacaacagggcaccagagaagggccgtgggggctggagctgtggctcggggggcttcccacaggttctttctgagaaaagaaattagttgattgggaaagggtggccgaagggcttacacacacttgcccacagtgaccttcctccttaattatgctccctttataaattagtgcttctcacttggaaggtctcagatacaaataaacaccagaaatgaagagttagtacaaccaaagccacaactgaatgcaagaaatgaaaacccgctcagaacaaagaggccgacatacaggaaggtaaagaacacagaaacagcagtgagcagtaaagcttctataaaattaaatctaaaggggtcatgaagatgtgaagggatgctgtgatttaagggctaaggaggagtgacatagaaaagacatcccaaagagcttacactctaacacatttcgcctggaactaaatgactttaaaccaccgcaggaaaacccagaagctggccatggtgtgggaggaggagggaagtgacgcactccaaagaaatgacagggtaagaagaaagtcatgctgaggaaagcacaaaacaccaagacacacagatgccaagagacgccttcttctctgggactagtggttgcctggttaatgaataagaaagttatttaaagtggggagtttcacacacacatacacatgcaaacataatacatacatactgaacccattttactttaacttaaatcctgtatatgtggagaaattcatagaaagacacaaactaccaaaacagacttgagaagaatagaaaatgtgacaagagattgaattagtaataatacaactacccgcaaggaaaagtgcaggctcagatggcttcactggtgaactctatcaaatatttaaagaagggccgcgcatggtagctcatgcctatcatccaagcacttggggagcccaaggagagagggtcacttgagcctacgagttcgagaccagcctgggcatcatagagggaacctgtctctacaaaaaaattaaaaaattagctgggcatggtgacgtgtgcctgtagtctcagctacttgggaggctgaagtgggaggattgcttgagcccaggaggtagaggctgcagtgaaccatgatcgcacctctgcactccagctggggggacagagtgagaccttgtctcaggaaaaaacaaacaaaaaaaaacatttagccgggtgtggtggctcacacctgttatcccagcactctgggaggctgaggcggctggaccacctgaggtcaggagtccaagacaagcctgcccaacatggtgaaaccccatctctactaaaaataaaaaaaataaaaaaataaaaaattagccggatgtggtggcatacatctgtaatcccagctactaaggaggctgaggcaggagaatcacttgaacgtgggaggtggaggatgcagtcagctgagatcaagccactgcactccagtttgggtgacagagagactccatctcaaaaaaaatttaatgaataattaatacaaattcttcataacaatcttccaacaaacggaagaggaagaaacacttccaaactcttctattaatatgaaaaggattacttatcataaccaagtgggatttatctcgcaaatgcaaggttggcttaacatcagaaaaatcaatctgtgtaattcaacatattaatagaacagaggacaaaaaccctatggtcatctcaatagatgcagaaaaagcatttgacaaaatccaactttctttttgataaaaaagacccaacaggctggacacggtggctcatgcctgtaatcccagcactttgggaggccgaggtgggcagatcacgaggtcaggagattgagaccatcctggctaacacggtgaaaccccgtctctactaaaaatacaaaaaaattagccaggtgtggtggcgggcgcctgtagtcccaactattcaggaggctaaggcaggagaatggcgtgaacccgggaggcagagcttgcagtgagccgagattataccactgcactccagcctgggcgacagagcgagactccatctcaaaaaaaaaaaaaaaaaaaaaaacaaccaacaaactaggaatagaagggaacttcctgaatctgatcaacagcatctatgaaaaacccacagctaacatactacttaatggtgacagactggatgcttcccctagatacaagctaagaaagtccactctcactgcttctattcaacatcgtagtggaggttccagccagggcaatcaggaaagaagacaagatgaaagacatccagagtgaagtaaactgatttctatttgcaggtgacatgattttgcatatagaaagaatccagagaaaagcccaacaacaataaagctcaaaatgagttcagcatggtttcaggatatgagatcaatataaaaaatcatttgtatttctatatattagcaatgaatgatctgaaaatttaattaagatagtaattccatttatgatagcatcaagaagaataagatactcaggaataaatttaacaaaaaagcaaaacttgcacactgaaaaccgtgaatataactgaaagaaattaaagaacatctaaatgaatggaagggtacctcatgtccataggttggaggacttactattgttaagatgacaatattcctgaaactgatccacagattaaccacaatcctcatcaaaatcccgggtggattgtttgcagaagttgacaaactcaacctaaagttcatatgaaatcaaagggcacagaatatccaaaacaatgttcaaaaactacagaactggagggctcacacgtccacacgtcaaaacttactatgaggctacagcaatcgaaaccatgtggcactggcatcaggacagacataggtcaatggaatagaattgagagtccagaaataaacacgtatatctatggtcaattgagtctgactaatgttaccaagaccattcaacggggaaagattcattttttcaacaaatggtgttggaaacagaacaaagctggacccctacctcacacagtgtataacaatgaactcaaaatggtctaaacacctatgtgcaggccgggtgtggtggctcacgcctgtaatcccagcactttgggaggctaaggcaggctgatcacaaggtcaggagtttgagaccagcctggccaacgtggtgaaaccccgtctctactaaaaatacaaaaattacctggggtggtggcacacgcttgtaatctctgctactcgggaggctgaggcaggagaattgcttgaacctgggaggcagaggttgtggtgagccgagatcacaccactgcactccagcctgggtgacagagcaagactccatcttggggaaaaaaaaaaaccaaaaaaccctaagtgtaagagctaacagtaacactataaagctcttaggcattgctttcttagatgtgacaccagaagcacaaacaactaaagaaaaaagcagagaaactgaacttcatccaaattgaaacttttgtgcatcaagtgaaaagataacccacagggtgggagagaaatttacaaattatatatctgataagggggttgtgcctgaaatacagaaataacttttacaactcagtaataaaaagacaaataacccaattttaaaaataggcaaaaggtctgaaaaacatttctgtagggaaaatatacaaatagccacaagtgcatgaaagtatgttcaccatcattaattatcagggaaatgcaaatccaaaccacaatgaaataccacttcaccaccactacgatggttataattaaaagaaagatcataagtgttggcgtggatgtgaagaaactggaaccaaaatgaaataccacttcaccaccatgatggttataattaaaagaaagatcataagtgttggcgtggatgtgaagaaactggaaccaaaatgaaataccacttcaccaccatgatggttataattaaaagaaagatcataagtgttggcgtggatgtgaagaaactggaaccacaatgaaataccacttcaccaccactaagatggttacaattaaaagaaagatcataaatgttggagtggatgtgaagaaactggaaccctcatggtctcacggtgggaatgtaaaatggcacagctgctttggaaaacaatcttgcagttcctcaaaaacagaatcatccttatgacccagcaattcccctccaaggtatatactcaagataaattaaaacatatgttgacacaaaaacttgtacaaggatgttcataacagcattattaataacagccaagaaggcaaacagcccatatgaacatcaactgatgaataagcaaaatgtagtatactgatacaacaggatatactgttgagccgtaaaaaagaatgaaatgttggtacatgtagaaacatgaatgaaccttgaaaacatcatgctaaatgaaagaagccagacacaaacggccacatgttgtatcattcaatttatatggaacatgcagaacaggcaaatccatggatacagaaagtagattagtggtttcctagggctgagaggtgggaaggaaatagggtgactgctaaaggctatagggtctctcttggggataataaaaatgttctaaaatggattgtggtgaaggttgtacaactctgtgaagatattaaaaccgctgaattttaaatggaggaattgtatgataggtgaattgtatctcaagacagctgttacccgatcccccatctcacagatccctggtaaaagaaaaaaaccatttataaagtgtccctctgaatccacaaggaattgcttccagaacctcctctgccactggatactaaaatcggtggagggtgaagtcttttacataaaataatgttgtatgtggacataacctacacacatcctcctgtatactttgaatcatctctagaatacttctaacacctaatacaatataaatgctatggaaatagttgttatactgtattgttttttatttatatttttgttgttgttttgttatttttattgtgttttttccttgaatagtgtcgatccacggttggctcagtgggggctgactgtacatacatggactgacctttttctgcctgagtaaagccttttctgagagtcagtctgctgtgtggagtgcctcgtggtctttcctgcataagctgcatccataagacatgaatctaacaacccttttctgtgtttttaaagtggggctagagctgaaaggcacttgtcaagcaatgtgtatgtggactccctccagatttttttttaatttttttttttttttaagtctcaatctcgctctgtcgcccaggctgtagtgcaatggcacagtcttggctcactgcaacctccgcctcccaggttcaagccaatttcctgcctcagcctcccgagtagctgggattatcggcatgtgccaccatgcccggctaatttttgtatttttagtagagacggggtttcaccatgttgaccagggtggtcttgaactcctgacctcaggtgatctgccggcctcccaaagtgctgggattacaagcgtgagccaccaggcccggctcctctagatttttatcagcatttatcgcaaccgccatagttgtctcacttgcatctaatggacagcaatacattcagcagcaccccctttcaccgaacctttccaaagaactcgactgtgctgtaccagaaacaattatctttctgcactcatatttcatggctttacatagtactagaatatgtaattacaacaaatatcactggcataaactagttaggaatagctacaactgtcccttggaaagctcatggcccagcttcctggagcagaaatggcgcaggggtgaactgcggaagctactggtagggaatggttcgcacagccagcctggctcaagcctcggcccacatggcaagagccgacctccatgtggccaccacgttccttcaaatcccattcccacagatgagcggactcatcccatcagcagctctgtgaggacagcagggcacacgcttcatctttagagccgaggaaacggggtcccacaggcagtgatgtgcccaagattgtgccagtcccatagggcgccatggccaccctctgaatccacagggaagtgtggattcacccaccaccagctctcttttgcctcgcccatgactctcaagcccggcagcagagccgggggtctcatcacgagagcagagccttgggctcccgcggtacccgtcacagaccggaaaggatgtgctggcaggaagccggatatttctgcttccaagccagggtgtgaggcaaactcacccacaaagtactcagcgaggaaacaacagggcttctgacggcagccgctgtcgccgcagcctgcctttcccttgcacagtattttctgctggtaaagagcctcagcccaccgcgtctgcagacattgctgcgacgtcccagtgacagactgatattccctacacatttcaaatccaacacatcacacgtattagggatctccaggcatcccattcattccacttcacaggtgaggaaactgaggcacaggtaggttcagtgacacacccagagtcacctgcctcgaatgcagaagaggtgggactcagaccctggagcgcctggcttgagaagcacggctccacgcctgctcatgccccacccatcacaactacagagcgactctgcacactgctgttatactcgtatatgctcttataaagagaatttactttattcttatttagttggcaattttcattttaaagcataaaaccaggagaatgcaaacttttagcatttacatgcctttagttctgtaagtttggtcaaatggatgtgatatttacagatcaatagtaaaatctgctgaggtgaggagaagcccctggtacttaacctttcctttacagaacacgttggagaaaattgccaacatgaggccccgatgaacaagggcagaagttcaaggctaccttagaactgcttaattagatacctttcagaaagggcagcctggctgtgacagctgtgtggatatacaccgggagggagagactcccatggcatgcaattaggaccaaagaatttttaacgtcttggtaatgatgctctctggccctgtatcttgattaactggatgttgactgccacagggtgaatgacaaagaagagcacattaaaaaaacccactataagaaccagctgccttttcttgcataagatgcataaatcattgcgtgggaagcagcgtaggtctcaaaggggcaaattgagagacagagagacagaaagagaccgaggcagaaagacacacacagagacagagagagacagacacacactcatacacacacacacgcgtgcgcatagatattcctacccttaccatggaagaacaatattttttcatcaatttctctttgttgtactcagtagcattctgatcagtaggctgtgttccattcacattgaaacaggaagagcgttcattatttatgagatgtgtatttataaatgtgtattaataacccacatattataacatgtgttagtgaaccatgctccgggcctcctcgctgcccctgggagtgacaggtcttcttgtgtatgaccctgggcaaagggtcaaatgatggccagtgactggcctctggagtatgagctcagggttcattagcaaatcaaaaatgcacaggttagcaattttccaactggaaaagaactgatcttctaacacctctaaacttcccggattaaaagagaattctgaagcccgaggaaggcaccttgctttggaggtgctgggtccaggggatgtccagggctgcaggaatttcactacatgactcaagggcacatgccaggggccatcctagagaacacgacagtggcagaaccctgtcaatatggagctccaacaacacctaaaataaatacatcagcggcgccacgtgtgcagatgcttggtcttccagagggcaacacaaggtggcctccaggtgccatggactgtcaggggccgctgtcctcacagcatctggctgaagccagaagcgtccactcctacactggtttcaaaccgcgcagaggaggaggggatcaggccactcaccatctgcaggacatcggaggagaccatctgcatacagcacatggctgtggccagcgcacacacgatagtggacaggacgttgagggcacacacgctgaagaggagatcctgcgaggaaaggtgcaggagaatgtcagcctcatcccgaaatagatagcagaatccttagccctcctgccagggcccagaatgagccgaggtcgatgaccatccacttcatggaggttttgttttgtgtgtgtctgtgttttcctcataatcaaaattggcctttcatagaaacacattcgtttattccgttacaatgatgagcaaagtattcataatactcaacaatgtgttttacaattttgataattattaggtagtcagtaacatgtctaaggaaatcataaggtggccaacatttaaggaggtgggccatttttatcaaacacaacctataactcaagtgaaactttttatcttgagataattgtatattcacatgcaattgtaagaaatcctacagagagatcttgggtaccctttactcattctcccttaatggtaacatttggcaaatctatagtacaatatcacagccagatactgacattggtatagtcaggatgcagaatagtcccatcaccacacgggtccccccagtgttgaccttttatagacacactcacctccctttccctgctccccatttaacccccagttctgatcccctgtcaatcgctagtctgttctccattttttataattttgtcatttcaagaatgttgcataagtggattgcacagcatgtaacctttcagaattggctttttccactcagcataattccctttagactcatccaggttgttgcatgtatcagtagttgacttctttttattgctgagtggtattccaccatatggatgtaccacattggtttaatcctcaacaactgaagaatatctggttttttggtattccagttttccagttgtgggctattacaaataaagctgttgtgagcctttgtttataggtttttgtgtgaacataagtttttgtttctccgagataaatgtccaggagcacaattgctgatttgtacagtaattgcatgtttagttttattttaaaaactgaaaaaatgccttccagagtggctgaacaatttttaattcccaccagcagtgtatgagtgattgggtttctctgcatgattgccaacatttggtgtcactgtttgtgttttagctattctcataggtgcataatgatactcctttataaaatgttttattttgcatttccctgatgctaatgatgtcgaacatcttttcatgtgcttatttgccatctagagatcctctttggtaaaatgtctgttcatgttttttgcccattttctaattgattgtaatgtttacttttttttttttgtagtgttgagttatgagagttctttatgtattctaggtactagttctttgtcagataggtggtttgcaaatattttcccccagactgtagcttgtcttttcatgtttcacatagagtcttagtcagctcaggctgctattacaaaaataccatagaccaggtagctctaacaacagtcacttctcacagtcctgaagtctggaagtctgagatcagggtgccagcctgttggattctggtaagggcctgcttcctggttgaagatggctaatgtctcactgtgtccttgcttagtgaaaagagggcaggggagctctctggtgcctcttttaaaagtgtattaatcccatcatgtggaatctaccctcatgacctaacaacctcccaaaggccctgcctcctattaaataataacatattgggaattagaatttcaacatatgaattttggagggacacaagcattaagtccattatatctgagtttttaaagaacaaaaaattttaatgttcttgagatccaactgatcaacttttgttccatacttttggtgtcaagtctaaaactttgtcaagccccagattgtgaacagtttctcccatttttttctgaaagtttttatagtttcatagtttgcatttaagtctatgctccatttttgttctgagacagggtcttgctctgttgcccaggctggagtgcagtggcacagtcatggctcactgcagcctcgaccttctgggctcaagtgatcctcccacctcagcctcctcagtaactgagaccacacatgcataccactgtgcccagctaatatcatccattttaagttaaattttgaataagatgtgagttttaggtttaggttcctttttatgtttttaatttcattttccaaatgttgttagtacatagaaatgtgattgatttttgtatgtctatgtgatatcttgagactttgctgaaattgatatcttgggactttgctgaaattattagttctaacaattttttgaagatgccaggggattttctgtgtagacaatcaggccatctgcaagtgttttattgatttccttccattttattaccttttattattattattgttctttttttttgcctcgtggtgctagctagaaccttgagcattataaataaaaatataagatgactaagatcatgaaagcagacatctccatcttgtgctcttagagggtaaacttgatggagttttaacagtcgaagtgcaatatagccttcattgagaagcttactctcaaatccatgtcagaaatagaaaaaaaaaagatttagaatgatagtatgtccttcaattaaatcttttcatatacaagtgtacaaaatactggacacactcaaaaagctatcagaaaacatgaatctttcaccacaaaggctatggcattaatcagattagtttcagttatctaatcaaggggttggcaagtgctcaagaggagacggggaatgccaccctcactgacatgctctgtgcgtgtgctaggatgtgggcacacagagtctagcagcatcctcagggctcgttcatgtatacatgagcccatgtgttccaatctgtaacatcctctggacaattccctgttctcctacaaacatcactgcccaatccccttcctcagaagctgctcatcagttctcaagcccacactgtgaaacagtaaagaagtgtgattaggataatatcatggaaggtggttaacatacagtgtttaaacactttcccaagtttatagaaccccatgcacatgtgaaggcagaaaaatgagtcctgaacttaagaagcgttaggcagaaccggccgggcgtggtggctcatgcctgtaatcccagcactttgggaggccaaggtgggtggatcacaaggtcaggagatcgagaccatcctggctaacacggtgaaaccccgtctctactaaaaatacaaaaaattagtcgggcgtggtggccggcgcctgtagtcccagctacttgggaggctgaggcaggagaatggcgtgaacccaggaggtggagcttgcagtgagccaagatcgcgccactgcactccagcctgggcaacagaacgagactccatctcataaaaagaaaaaaaaaaaaaagaagaagcgttaggcagaaccaaggcaaggctcagtttagggctaactattccccactttggaggtaaggcctatccgagtccctgaatgatgtgggaacaggcactgttcctgtgtgagcaccaggcactgttatcactaatcctttcaggcagttcttttcccagactcaggtcgtttcttcatatgcacgtgctaaccagcatccaactgacaactccaggcagaccctctgaagacccccatgtttctctcctggtgcagctctgccctcgatggtgctctgtcctaagaactcttgtctccaggccttgatccccctcagactctcagccctctacgcccaccccagggagtctgcagggaccctgctgtgttccctttccagcactgaacctggaaactgtctcaaggcagtaagctggggcaatcgtagggctcacctcatttatcacccacccctcagggatcagggttcttcattgcctgatagtgtcttcctacactgtgttcattttggggggctgtttcaggcaggaggttaaatccaatgtcctgctactccatcttggccagaagctcttggtggcttttttgtttgcgttttctaatgtttgtagcaggactaggcggactgccttagggatcctactataggcatctccactgccctccctgctcctacagctgctagacatggagcaggatgggggcttagttgtggcaaacagcaggcacaggtggggctggagggaggctgaggagcctagattgtattttgcaggtaatggaatgccactgaagatgtgtgatgctgggaaagaggtcatacaacctgttttttgttgttgttgttgtttgtggtggtggtggcgtttttgttttgttttgttttgtttttgagatggagtcttgctccagtccatgctggagtgcagtagcgtgatcttggctcactgcaacttccatctcccaggttcaagcgattctcctgcctcagcctcctgagtagctgggtctacaggtgcccgccaccatggctggctaattttttttgtatttttagtagagatggggtttcaccatgttggccaggctggtctcgaactcctgacctcaggtgatccaccctcctcggcctcccaaagtgctgggattacaagtgcaagccacggtgcctagcccatgcaacctgttttgagaattgattgagaaagacacctttgcagggagggcctagcacagaactatagatggagtaaacatcggttgaagtgagactggacacagggcagtgacccgtgaggcggtaccggagaggagtcaagcagagcccaggaggaggcatgcagatgccggtctgagggtgactctgaagttcagaacaaaagggcgtggctgtttactggagtaggggagaccgggatgagggtgcagatatagtagaaagatgattctggtgagtggaaacatgagatgcctgcgcgtgggccagggactgtgggagagaagcagtcttaacgaacacctcagcaggccaggcgcagtggctcatgcgaggcgggaggatcacttgaggtcaggagttcgagaccagtctgaccaacatggtgaaaccccgtctccactaaaaatataaaaaaattagccgggagaggtggcacatgcctgtaatcccagctactcaggaggctgaggcaggagaatcggttgaacctgggaggtggaggtagccgtgagccgagatcatgccattgtattccagcctgggcgacaaagcgagactctgtctggaagaaaaaaaataaaaaataaaacacctgaagtggtctgggacatgtggaggctgagttaccagtgggcctgacccactgagatgttggcaaatggttggaaatttggggctggggctgacgatggagatcagaactggaggtgtggaccaggagtcatccctacagagttcaaatgtgccttcaccttgcggatgtccttgatgtatctgcgggcccctgtgtgtcctcattcccctctccagatccatcagacttcaggggcctgggggcctccgcaggctccctacagaagagggcatttctttgatgaaattaccattctcacctcaaagatacacctcagcatagttttcctctaagtgacatgaattttgtgctggattctagaaaactgacagatttatccatgtgcgcagtagctggctgagtgccttttctctcctgtgaggaagagcttctaaaatgtcttaaggctcagccagaagctttagcacatttttgagcaggaagttggactcactgtagtcttaaaacaatcctgctggtgaatgaagtcataattagaactcttaagtatgtattttatatatctcaggagaacaattcaaagttataactaaaatagcgacatcttttttttttttttttgagatggagtctcgctgtgtcgcccaggctggaatgcagtggcgcgatatcggctcactgcaacttccacctcccaacttcaagtgattctcctgcctcagcctcccgagtagctgggattacaggcatacgccaccacgcccagctgatttttgttatttttagtagagacggggtttcaccatgttggccaggatgacctgaggtgatccagccgccttggcctcccaaagtgctgggattatagacgtgagccactgctcccggccaatagcgacatctcttaatgtaccattgctaaaatataagcaatacctttactttgtcctcaatctagaaatttcaactttattgaccacataatccactgtcatttaaatgaatgcctttctacaaataatattaatttcgcatatgctaccaaatgaaactactcacagacagaaacaccaactctgacctctgtttgcatacgcatcatgaggcagcctgctttacgtctcatgaaaggtattcatttgaaatacatgccagaaagacttttcccctccagctgtttaaatacttgatgtttttctaagtaaccgcaaaccacctggtattgcgtttatgtgtttcttcagaattcttttttggcttaaatgacattatctctgccttttttttttttttttttgagatgtagtctcactctttcgcccaggctggagtgcagtggcgtgatctcggctcactgcaacctccacctcccgggttcaagggattctcctgcctcagcctcccaagtatctggactacaggagcacgccatcactcccgtctaattttgatgtatatttttttaagtagagatagggtttcaccatgttggctaggctatctctgctttttgaaagttttatcagagtcctttacaaatactgaaatccacattctataaaattcctttacaaggtgattcaaaacggcgaatatgagagagaggcgggtctttcattgctgatactgagttttgctactggatattctgatgttattagctttttgatgttattaatgttataaagttaaggaagttatgtatctaataaatgatgtatagaacaaaaacaagagaaaaaagttttagatacttgggcaaagctacagttgataaattattttgaaaatctctccagtctacgtaagttatggatattaataataagattaacagagaaaagcgacagcaatgacaatgtacatacatatagcctacacgttaaaaacattaaacagttcaggacattgagcgggtcgtggtagtgtatctggaattggtgggttattggtctcactgacttcaagaacgaagctgtggaccctcgcgctgagtgttacagctcttaaaggtggcgtgtctggagtctgttcgttctgatgtgtttggagttttttctggtgggtttgtggtctcgctggcctaggagtgaaaccacagacctccgcggtgagtgttacagctcttaaggcggcgtgtctgaagttgctcattcctcccgataggttcgtggtctcgctggctccaggagtgaagctgcagaccttcacggtgttacagctcataaaggcaaggtggaccgagagagtgagcagcagcaagatttattgcaaacagcataataacaaagcttccacagcatagaaaaggacagggccgggttgctactgctagcttgggcagcctgcttttattcttatctggccccacccacatcctgctgattggtccattttacagagagccgattggtccattttacagagagctgattggtccgttttgacagggtgctgattggtgcgtttataattcctgagctagacacaaaagttctccatgtcacaactagattagctagatacagtgtccacacaaaggctctccaagtccccaccagagtagctagatacagagtgtcgattggtgcattcacaaaccctgagttagacacagggtgctgattggtgtgtttacaaaccttgagctagacacagagtgccgactggtgtatttataatcccttagctagacataaaggttctccaagtccccaccagactcaggagcccagctggcttcacccggtggatcccgcaggtggagctgcctgccagtaccgcgctgtgcgcctgcactcctcagcccttgggtggtgtatgggattgggtgccatggagcaggaggcggcgctcgcccgggaggctcgggccgcacaggagcccacggagacgggggaggctcaggcatggtaggctgcaggtcctgagccttgcccagagggaaggcagctaaggcccggtgagaaattgagcacagcagctgctggcccaggtgctaagcccctcactgctccagcaggcagggccagctggccactcccagtgcggggccgcggagcccacgcccacttggaactcctgctggcctgcaagtaccacgcgcagccccggttcccgcccacgcgtctccctccacacctccctgcaaggtgagggaaccgactctggccttggcaaacccagaaaggggctcccacagtgcagcgtgggctgaagggctcctcaagtgccgccaaagtgggagcccaggcagaggaggcaccgagagccagggaaggctgcgaggactgccagcacgctgtcacctctcagtagctcacacctgtaatctcagcacttttggaggctaaggtcagatcatctgaggtcaggagtttgaaaccagcctggccaacatgatgaaaccctgcctctactaaaaatacaaaaattagccaggcgtggtggcaggcacctgtaatcccagctactcaggaggctgaggcaggagaatcactcaaacctgggaggcagaggttgcagtgagccaagatcacaccaccgcactccagcctgggtgacagagtgagactctgtctcaaaaaaaaaaaaaaaaaaaaaaaaaatcaggacgttgatacctttgcttgctggacaaaatgaggacaaactatcttacatttatttccgctagttcattcagtagtttttttcctatgtcttctctctttgaataggagagaggtctcatgggaacctattatcagtcaagatataatgatagaaggtatgatgataaggagagttccacagcataaaacacaagcggaagaaatatccagcaatagctgtatatgtggtaataattataagggatgggtgttgggctttatctgaattattatcttaaatgcccacaccatttattctttgttgccttgtgatggtagacattggtcatggacctgacgttccgtgcagatctatgttgggagaggcagtctgccatgggccctgagcatgccctgaagttcctgctgggtatgccaagaatgtaaggccttgactgctctttacctgacccatttcccagggctgtgtttgcaccaagaaaccttgaggaaggaggtaacgtctcccctagacaaagtgtaggttctctacaaagacagggattccccaagctcagtgtttctgccccataacgcagctcaccacacatgtgcaggcatccgtggtgggcccttagcatcaccctgagaccccagggcatggggaactgacacacactagcctagagctctggctactgcttttgccatgaataataaagtcccttgtctctgaaccaggaatctcatgtctttttgccaggaaagtaacagtaaacagtaacagactagtttgttagcttgaaagtaggttaaaagctcagaccctgcagttcctggcagtttatttccatctccatcttgtaagaacatcaagagcagagaccaagtcttttgctactctgtatggtagaatatcttattcaaaataggtggttgctaaatatttgaaattttacaggctcattgttctcttctgaattgtaagttcagactagaaggaaatgcataatttccaagcttctaaccacacacagaaaattcaccttcacctttaagtaaagtaatgcagcacacataggatcatggtggacgggaggcaggactagattgcagctctgaacagagcaatgtgcagaggcttgcattgtgaattttagctccagatcgactgcaagaacaaaccagcaaccccgagaggaccgacagacctctgaaggaagcagactgctcttgcaggacctggaagacaccccaaatactgtgagtgcccaaactgcggaagtgggaaagggagagcatcctctcccaaacacacacgcccactggagaaaaggaaggtctgtttgcaggagaagtttccgaccttacctggagctgagtcaatttagagagtcgagcgaaatacagaagtagaggaagcagcgggaaaggccctgggagctccctgggtccccaagcaggtcattcctgcctggcaccacagggatccaccaggagggcagccagaggagcgagggtaaaactcaacagggagaaggaaatctctagctgaaatttgtaacaatttgaacagggttagaagcctcctggccagaactcgggggagggcgcaaatctggtgtgcagattctccacaggtgggaagaacaagccctttcttttgcagctgggaggtgggtagcctgaggcaagttctcaagcctgtctcacccactgcccgaaaacagacttggggcggttggatgggggcatggtgggagtgagactggactttcagtttgcatgggagctgggtgaggcctgtgactgccagctttccaccacttctctgaaaacctgcatgactcagcagaggcagccataatcctcctaggtacataactccagtgacctgggaatctcacacccatcccccacaggagctgcagcaagaccggtccaaagagagtctgagctcagatacgcctggccccacccccacctgatcgtccttccctacccactctggtagcagaaaacaaaggacatataatcttgggagttctacagcccagcccacagccagtccctctcaaactactacagctgatgctttctggaaagcgccacctcacagcaggaggccaacccgcacaaaaatagagcattaaaccaccaaagctaagagccctcacgaagtccactgcacaccccccaccacctccactggaacaggtgctggtatccatggctgagagacccatagacggttcacatcacaggactctgtgcagacaaccctcagaaccagcccggagctgggcagacttactgcgtggccagacccagaagagagacaacaatcactgcagttgggctcacaggaagccacctccataggaaaagggggagattactccatgaagggagcactccatgggacaaaagaatctgaacaacagccttcagccctagaccttccctctgacagagcttaccctaatgagaaggaaccacaaaaccaatgctggtaatatgacaaaataaggctcttgaacagcaccccccaaaatcacactagtttaccagcaatggatccaacccaagaagaaatccctgatttacctgaaaaagaattcaggaggttagttattaagctaatcagggaggcaccagagaaaggtgaagctcaatgcaaggaaatccaaaaaacgatacaagaagtgacgggagaaatagccaagaaaatagatagcttaaagaaaaaaaaataaataaaaaatccaggaaaaattggacacacttatagtaatgcaaaatgctctggaaagtctcaggaatagaattgaaaaagtagaagaaattcagagctcaaagacaaggtctttgaattaacccaatcccacaaagacaaagaaaaaagaataagaaaatatgaacaaagcctccaagaagtctgggattatgttaaatgaccaaacctaagaataaccagttttcccgaggaagaagagaattataaaagcttggaaaacatatctttaggaataatagaggaaaacttccctggccttgctagagacctagctatccaagtgcaagaagaacaaagaacacctgggaaattcattgcaaaaagatcattgcctaggcatattgtcatcaggttatccaaagttaagacaaagtaaagaattttaagagctgtgagacagaagcaccaggtaacctataaaagaaaacctatcagattaacagcagatttctcagcagaaaccctacaagctagaagggattggggctctatcttcagcctcctcaaacaaaacgattatcagctaagaattttgtattcagcaaaactaagcatcatatatgaaagaagatacagtctttttcagacaaacaaatgctgagagaattcgtcactaacaagccaccattaaaagaactgctaaaaggagctctaaatcttgaaacaaatcctggaaacacatcaaaacagaacctctttaaagcataaatcacacaggacctataaaacaaaaatacaagttaaaaggcaaaaacaaaaaacaaaaaaccaaagtccacaggcaacaaatagcacaatgaatgcaatggtacctcacatctcaattccaacattgaatgtaaatggcctaaatgctctactttaaggatacagaactgcagaatggataagaactcgccaaccaactatctgctgccttcaggagactcacctaacacataaggactcacataaagtaaagaggtggaaaaaggcatttcacacaaatggacaagagagtaggggtagctattcttatatcagacaaaacaaactttaaagcaatatcagttaaaagagacaaagtgggacattatataatagtaaaaggccttgtccaacaggaaaatatcataatcctaaaaatatatgcatctaacactggagcgccaaaatttatacaacaattactaatagacctaagaaatgagatagacagcaacacaataatagtgggggacttcaatactccactgacagcactaggcaagtcatcaagacagaaagtcaacaaagaaacaatggatttaaactataccttggaacaaatggacttaaaagatatatacagaacatttcatccaacaacctcagaatacacattctattcaacagcacgtggaaatttctccaagatagactatatgataggccataaaacaagactcaataaatttaagaaaattgaaattatatcaagcactctctcagtggaatcaaactggaaatcaactccaaaaggaaccttcaaaaccatgctgatacatggaaattaaataacctactcctgaatgagcattgggtcaaaaacgaaatcaaggtggaaattaaaaaattcttcgaactgaacgacaataatgacacaacctaccaaaacctctgggatataagcagaggtggtgccaagaggaaagttcatagccctaaacgcctacatcaaaaagactgaaagggcacacactgacattctaaggtcacacctcaaggaactagagaaacaagaaaaaccaaacccaaacccagcagaagaaaggaaataaccaagatcagagcagaactaaatgaaattgaaacaaacaaacaaacaaaaatacaaaagataaatgaaacaaaaagatggttctttgaaaaggtaagtaaaactgatagaccattagtaagattaaccaagaaaagaagagagaaaatccaaataacctcattaagaaatgaaacaggagatattacagttgacaccactgaaatacaaaagatcattcaaggctactatgaacacctttacacacatcaactagaaaacctagaagagttggataaattctggaaagatataaccctcctagcttaaatcaggaagaattagataccttgaacagaccagtaacaagctgcaagactgaaatggtaattacaaaattaccaacaacaaaaaatgtccacgaccagacagattctaagaagactttctaagaagaattggtaccaatccttttgacactattccacaagataagagaaagaaggaactctctctaattcattctatgaagccagcatcaccctaataccaaaaccaggaaaggacctaaccaaaaaagaaaactacagaccgatatccttgatgaacatagatgccaaaatccttaacaaaatattagctaactgaatccaacaacatatcaaaaagacaatacatcatgatcaagtgagtttcataccagggatgcagggatggtttaacatatgcaagtcaataaatgtgacacatcacataaacagaattaaaaacaaaaatcacatgatcatctcaacagatgcagaaaaagcatttgataaaatccagcattgctttatggttacaattctcagcaaaattagcatacaagggacatacctcaatgtaataaaagccatctatgacaaaaccacaggcaacataatactgaatggggaaaaactgaaagcgttccctctgagaactgaaacaagacaaggatgcccactctgaccactcctcttcaacatactactgaagtcctagccagagtaatcagacaagagaaagaaatacagggcatccaagttggtaaaaaggaagtcaaactgtcactgtttgctgacgatatgatcatttaccttgaaaaccctgaagactcctccagaaagcttctataactgataaaagaattcagcaaaatttccagatacaagatgaatgtacagaagtcagtagctcttctatacaccaacagtgaccaagccaagaatcaaatcaagaactcaaccccttttacaatagctgcaaaaaaataaaatacttagaaatatacctaaccaaggagtcaaaagacatctacaagaaaaactacaaaacactgctgaaagtaatcataaacaacacaaataaattgaaacacatcccaggctcgtgaatgggtagaatcaatactgtgaaaatgaccataccagcaaaagcaatctacaaattcattgcaatccccatcaaaataccaccatcattcttcacagaattagaaaaaacaattctaaaattcatatggaaccaaaaaagagcccacatagccaaagcaagacgaagcaaaaagaaaaaatctggaggcatcgcactacctgatttcaaactatactataaggccaaagttgcaaaacagcatggtactagtataaaaataagcacatggaccaatggaacagaatacagaacccagaaataaaccaagtacttaaagccaaccgatctttgacaaagcaaacattaacataaagtggggaaaggacactcttttcaacaaatggtgttgggataatcggctagccacatgtaggagaatgaaactggatcctcatctgtcaccttatacaaaaatcaactcaagatggattaaagacttaaatctaagacctgaaactataaaaattctagaagataacatcggaaaaacccttctaggcattggcttaggcaaggatttcatgaccgagaacccaaaagcaaatacaataaaaacaaagatcaatagctgggatcaaattaaactaaagaggttttgcatggcaaaagaaacagtcagtagagtaaacagacaatccacagagtgggagaaaatcttcacaatctatacatctgacaaaggactaatatccagaatctacaacaaactgaaacaaatcaataagaaaaaaacaaagaatcccatcaaagagtgggctgacatgaacagacaattctcaaaagaagatatacaaatggccaacaaacatatgaaaaaatgctcaacatcactaatgatcagggaaatgcaaatcaaaaccacagtgtgataccacgttactcctgcaagaatggccataatcaaaaaatcaacaaacagtagatgttgacatggatgtggtgaacagggagcacttctacactgctggtgggaatgtaaactcgtgcagccactatggaaaacagtgtggagactccttaaagaactaaaagtagagctaccatttgatccagtaatcccactactgggtatctacccagaggaaaagaattcattatatgaggaagatacttgcacacgcatgtttatagcaacacaattcaattcacacttgcaaaattgtggaaccaacccaaatgcccatcaatcaatgagtggataaaggaacggtggtatatatatatgatggaatactacttagccataaaaaggaatgaagtaacagcatttgcagtgacctggataagattggagactcttattctaagtgaagtaactcaggaatggaaaaccaaacatcgtacgttctcattgatatgtgggagctaagctatgaggatgcaagggcataagaatgatacaaaagcataagaatgatacaatggggagaatagtgggaggcgggaaagggataaaagactacaaatagggtgcagtgtatactgctcgggtgttgagtgcaccaaaatctcacaaatcaccactaaagaacttactcatgtaaccaaataccacctgtaccccaataacttatggaaaaaaagaatttaaaaaaacctactacacatagttacaaacccaataaagaaagaaagtaatgcagagaaagactctgtacaaagactcttgttggtagcacaatcagcgtgtgtgtgtaaaatctgtaatttaaattttccacgaaatttctagagtgatgagacacatcctggggcagatctaggactgtttaatttgtctctgtagaaagcagttatagtctacagaggtctttgtggcgggcttaaatactgatcctacaaaaggagctaaaattaggctgtcatatggagaaggtaagtgattcatagagaaatctgtgaagctataatttcaagaggcaaacatccatttacaatccctaaaaatgtcgatggattttggccttgctttggccactcaggcaccaccagtaacacatgtgctgctctaagaaggcaggattgctccccacatggtgcctgctgtttgctcaatggcacttttaactctgggcaaggacccaggagggagttcacacactctccgcaagggttcagaactgcaccctatttgataattgaaaacctggcttttgtcatctgaaacaatagcttttactctttagtggatggctgtaaattgcctacatgatcatctgtgtaaataatcgtagactaattattttcttacagttctacgaagttttaagaagaaaactatttgccatttttctgatattcaaggcaaagtaatgaggcaaaaaaagtttctgtgtgtatacacacttttgtatctttgtgtgtgtatatatgagatagattatacacatacatgcatatatacatacagaaatctttcctataaattctggatttctgaagactcactgtgatcctaatgagcctctagctttaaaacaatgttgaacaaaacaccatttttaaatatttggctttaacctaaatttatgggaatgaagaaaataaacaagcattgtcaagaacattttgggaaaaaaaaggctttgcacacatcaaaatgtaccctaaatctacaataatagtatagggtggcatcaataagggacagaatagagatcctattataataaaagaagtacaccacattacttgtgttgggataattggctgtctttaaaaaacaagtaagacagatctagatgtgaaaagaagagaggaaaattcttcctcgtgaacctagatgcaaaagtcctaaataaaatattgaaaaattaaatacagtagcattttaaaaaacatattatgaccaaatgtggtttattcctatattacaaggatgttttaacataatgtaatttattaatggaattcactacattaaatgagaaaaactatatgacaatctcaatagatgcaaaatagcagttggtatttcaacactagtgtaaaagcctctaataaacttgaaatagacaggagctccctaaactcaagaaaccctacagcaaacatctggaaggagatggggattgctgccaatatcacttctgttctacacaggtcccagtcattggaagaagacaggcaaaagaagtaaagtgtgttcaaactgggaaggaagaaaaactgtccaagatgatacaattattcatacagaaaactcaataacatttccaaatatttagaactaaatataatagttgtgcaatgttgctgcatataaaatcaatatgcaggccgggtgcggtggctcatgcctgtaatcccagcactttggagggccgaggcagggggatcatgaggtcagaagattgagaccatcctggctaacatggtgaaacccccatctctactaaaaataaaaaaaattagccaggcgtggtggcgggtgcttgtagtcccagctactcaggaggctgaggcagaagaatggcgtgaacccgggaggtggagcttgcagtgagctgagatcgtgccactgcactccagcctgggtgacagagcgagactccatctcaaaaaaaaaaaaaaaaaaaaaaaaatcaatatgcaaaattcattcactagcaacaaacagcaagtataagttttttaaagatacgatttacaatagcaaaaaatgtaaagtagccaagaataaatatagaaaaaggtggaaaaatgtgttgagaacaaataaataatgagatcttgtagtcatgaataggaagattcaatactataaatacattaattctttccaaatcaacttataaatccaatggaattccaacaaagaccacaacaagactgtgtgtgtgtgtgtgtgagtgtgtgtgtgtgcatagtctgtgacaggatcattttaaattcctcatctcccttctctctcccacccctgctgccccacaccatgtgaggacacagtgacaaggcttgcctttgtaaaacaggaagagggcgcttgccagaactcgaccatgctggcactttgatctcagacttctagcctcctgactgtgagaaataaatgtctgctgtttataccaccccatctaaagcattctgttacagcaacctgtcttagtctattttctgctgctgtaacggaataacagactgggtaatttacaaagaatgtaagtctatttggcccacagttctggaggctgggaagtcctagagcatggggccagcatctggtgggggtcctcctgtggtggaaggtgaaaggcagaaagctgaagtgagtgtgtgagacagagagagaagccagatttcctttataacaacccactctcaccataactaacctctcccatgctaatgacaatccatacatgagtgctccactctcacgacccaatcacctattattaaattcgacctccaacactgactgtggcattgaggattatgtttccaacatatgaacttttgggggactattcaaaccacagcacagcctgaactgattaagacagtgggcttttctatcttctatcattaaaccatccgaaacaccattagtcctctgactgcaggtccagctgtcctgagcagttcaacatttcatatttcgaggaatgcaggttcactcataaacaacacctgtgacagagccaccctcactcacatcctggacactctactgtctgttcacccctgtgcattccaggatgtaacaggcaagatgatcccaactcaggcacagctgcagtgtctacagctgcaggaggtcctgtctccctcctgcccccagcaagaaaacccaagtaaggtatttttttttaaggtatagtttttttccttcaagtttctaattttgacacaatgaaaatattgtatttatattagcaatacccgattagcaatttcatgtaaaggcgattaggtactcataaaaggtctcaagtactccaactaaatcagtcactggttaataacaatgatccacgagctgttttcctggttttcatgtggaataattggcaaggaaaaccatacatgaaaaaagaaaaaagaaaaagatcagcaactttgcagctttagccactatgtgatgtgctatcaaaaagccacctagaatcttttttcatgagttaaaacactactgtcatctataatcctgaacggtaaggtctagaaaccaatactgacagaggtgtccaaacagctcctcttgcagtgctgtggggcacatttcttttaaccttaattgacttcaattactgtgcttcatctcccatggcaaaataattccccaaagaaacaaagagtattagagtgttttcactcatgaaacagcccgtaatgcacctcttttgcttaggaattggaagccaactagatttgagcctgcttgaaagaaaatctcatcactgaagaatccattagtgggccctccaaaatccacacagtcttaaggccagggaccaactggacttcaggaataggatcaaaaaagccaattccagttccatcgtgatgtactgatttaactttgattgtgaaggacagtaatttattgagtaatttatcttgctaaccaccatattaatccagtatccaatcagcacttctctcattcaattccaaggagcaggagtcctagatggttggaagtgtcagacaggaagggaagagtgtcttctagtgtcttgcccagtaattgtacggggctccaaactcctggggagggggaatgatgtctgacttggagcaggccagtggggatggacagagaaaaatttcagcaggtgcccattgctggagtgcaataagtagagcccggggtgatgagaggcctgggggagaagggagagggagggatgacagagaggacaataggaacacagggtcccttgcccttcataatgcccttgattcttgttaaagggaaatgccacggatgtggttggtggagccaacatctctgcctcatccttgatcatcccacacaccccacatccaaattctccctggcgtgttgacccggctaccaacctcacctgcaatcctccctgggctccagctccacctgccctggctgaacctccccctctcacctggactctgaggtggcctcccagtacctcaggtctactcttccctgtcaggacacctgttttagcctaagtcggctcctgtccctcccaggttacagtctgtggcgggaggcccaccagtgataaaatctccgcgccttcccccgtccctggctggcaccctctgcagcctatttctgcctcatttccacggaggctgtctcccattttctctgcagaccagcccccaagtacacatcgtgctaccatagttccacactggtctagctctctccgcttcccagtcccccgcccagggaaggggctcactgaaccagcctgggcacgtgtccactcccaggacagtccactgcaggaatgggcggggcagggtgcacaggagggtgctgtaagctgggcctgctttctaagccaacctgggtgattggggagccaactcaccatggggccgctgcctagcccctctgcttctacgtgactatgatagaagacggcactgaagccttccctctgagaaagttctcagatcttcttttggtcacttctggctcacaccccacaaaagatcccctggacggaagcctcagctctcttatttctggggatgtggctttgagggtttcctcatcgctctgagccttgatctcatctgtgaggggatgactggcttagactttaaactcaagtaggtgaaccccggggcacttggtaaagggaagccctcctgggaggattccgccagggtgtgcagagccacccgtgatagcaagtgatctcattactggaaggttctgaatcggggggagatggtcaccagcacctcggagggttggggcaccattcatcttctgattggttatcatatttggtttgatttcagtcaccccagaggaccaaaatgactaaaataagtaagttattcatctataaacattatgaagcattttcaggcatttaacagatgtaataattacctatatctaagtcatatttgaagggtaactaaattttaattgctttataatatgtcttataatctttttattagcaattatataagcaattgattgtaactatctgtaagtgaaaactaatatctggatagccaaaaaaaaaaaaaaagccaaaaaatcccactctttcatttagatgactggggaatattgaagagtcggggaaatagcaggctctattttaagcatcattttaaaggaaatataacacaatcttaatcgtaggtggaaaaaactccaaagagtacttgttatgattgcaaattcctaagtaaaagccatctacagatgtgacttgtttccaggtattactcttgattttggggacatgtctcttcccttgatgggagaccccctgggtcactgcatcccttgtacatcaaggtttctttcatggcagatgtcatgtcatttttttctccatgtatcagaacgacaactcattccttgcatgacaatggagtggaaatgcagggagacctcaatgacattttattcagctgacaaggaagagacaaactgccttgtcccaggagtctgtgaaaactagaaacacggccaggcacggtggctcacgcctgtaatcccagcactttgggaggccgaggcgggcagatcatgagatcaggagattgagaccatcctggctaacacggtgaaacctcgtctctactaaaaatacaaaaaaattagccgggcatggtggcgggcgcctgtattcccagctacttgggaggctgaggcaggagaatggcctgaacctgggaggcggggtcttgcagtgagctgagatcgcgccactgcgctctagcctgggcgacagagtgagactccaactaaacaaaacaaaacaaaacaacaaaaaaaaaaaagaaaactagaaacacctcatactgggaactataaagctttgccactgccactgctttgtaaaacaagaacttttccctgcctaaggtatctatttcataggtagaattcataacacactaaaacctttgacttggcctgcttggtatagaaaacttatgcatcacaaaatattctgctcagagtataagcacataggtaatgcatgaatttgtggtttatcaattttcaaagaaccttttacaaagacactgaatatatatgagagtaaacatgttgtgatttttggtagttcagacagtaatcagtttctcgctgggcctcagcttgttctgagcattcaggtccacagtcctgaagctaagctagtgtcccgggtagcagcctggtgtatgtatcactgcatatggcggtgagagccagggctccaaagccagactgccggcctgggattctggctccacctttacaatctgcatgaccttggggagttactaaatttcactgtgcctcagtatcctcacctgtaaaatgagaataaatgatacgtgtacctcaccgggttcttgtaagggtaagattagtttcacaaatgtgctgccggtaacgcttagcacacagcaaggctcaatcaacattagctatgactatcatacacgattaatcatctgagtgtctgatcggattgaaaacacaggctcctgcagacaaattcagcagaggactttcaggcctcatgcatgaatgcttaaggaaaagagccctaaagattatgagacgcccatccaagaacatccaagaatgcgttttgcagtctgaactgattctccagggtgctccttgtgttcaactgatgggacaggaacgctgatgtttgtccatctctctttttcttcctttttgagacggagtctcactctgtcacccaggctggagtgcagtggcacgatctcggctcacagcaacctccacctcccaggttcaagtgattctcctgcctcagcctgctgagtagctgagattacaggtgcccgccaccatgcccggctaatttcttttgtatttttagtagagacggggtttcaccatgttggtcaggctggtctcgaacccctgacctcgtgatccacccgccttggcctcccaaagtgctgggataacaggcgtgagccactgtacccagactgtccatctttcattgctctactttctgggtcttgatcgtcctctctcatgactacttcttttactcccatcaaggtaaagtgtgagtgaaagtagtttgattaaagcccaggcagattaaggacgaagctaaaaagaatgaagagacactggtaggaaatactggctgacatgcagaagtaatttcaacgatcttattagcctttcgcctcttgagtacttggttaatgttcataaccagaagtaatgtctctaatctgcatttaactgatattctaactcttccttaaagatacagacctcttttcctcaggcttcataggctagacaattctccttaaatgtcctgagagccgtggcacataggggatgagtggtgggggggcacattcatttgcctggagtgtgggaggagcccccacctttcctgattaatgcagctggtagttctcagtgtgtgcagctgggtgggcctccagaacagtcagtttgggggccatgaggggcaggctctcctggatggtgacaataattttaagagaggggaggtcagtagttggaagtgggaagaggccagaggagagaagagggtggaagagcagagaagcatccctcctcagctcaccagacaaaggataaaatggaggaagtcacaggaccctttgccagagaagcccccaggaagtgtggcacatgcagggcaggagccacgggccccacttcatgctgaggtccttgccaagcccatggcccgcagaccctgttggacggggcagcaccgtgcacctgaaggctgaggccgggccccaggaggggttagatctctttccctccttccctccaggtcgccaggctttgctaatttcatcttccaaatatttaccaagttaatgcccttctcctcctactctgatgtgcctctgcagttttggtcccattatctctgcccaggttggtgtctgtgccctctctgggcctggctctcagtcctgtcccctgctgctgctggatgatctatttctgtaatgcatctggccactgccctctcttccctgctaccccaaacaccccaattcagtgtctccacgttgcctgcagctctgatactgcagggcccaggactttcaagaggtagagccaagggtgggagaaggaagagttggagggacgcccagctctccacctgggagctgagcagctaggggtggtggtgataacatcgacaaggttggaaagagaagcagaagctgagccaatggattccctctgggagcggctgggggaggatggcagggagtgatccgaggggtcccgctctcgtgtatgggactctgtcatgtgagtacacatgtgatggctggcaaaaaagcaactgtatggcaggatcctcatccacgggaaggacagggcttctattttaaaatacactgaacagcaagactgcacatgctttctggaatagaacataaatgcatctatgaatcaaagtcagaaaatatattggtggttgttttcttgctttattttgcgctctcacaggtgtgactatcagttttcaggaatatattctttgctcaatatgtatcttcttcctgccctccttgcttcctttccttcctccagtgcacacagatcgagcccacaacgcagcaagcacagagatgaaaagaggaagatagacgcggggtctgcacccacgaaactcagtctagagggacacaggggtgccctggccagcatctggactcgtgaggctgatgcatcaagccacggcagagctgcctgggaaaggtgcatagggagcactctcaggggccagaggaagggacatccaggcggcaccgggcagtgaggcaagtcaagggtggcggaggttggtggggacagtgttactgggagagggaaggctgagtgcagaggtggagggtagggatgggcaggggcagaaagcactgtgaagggagcttagtggaagagggtgggcgaggggaggcagggcgggagggatacagggagaagggtggatgtgctgcagggacacccgggtggtgacaaaattaaagtgcctaaaaatactcaaggagaaatgaactttgttaacacagtttctttaagaatgtaacgtgcctgtaatcccaacacttagggaggttgaggcaggaggatcacttgagtccaggagttggggaccagcctgggcaacatagtcatgcctgtttctacaaatataaaaataaaattagctgcatatggtggtacgtgtctatggtcccagctactccagagactgaggcaggaggatggctggagcctgggaggtcaaggctgccgtgagctgtgattgtaccaccgcactccagcctgggcaacagagcaagaacctgtcttaaaaaaaaaaaaaaaaagaaagaaagaaagaaaaggaaaaagaaccggttaccatctcaatgaattagagaagacagaactaaagaatatttatatcctgcccaagtgttcacaatgcatctctccgttttcacaatgcacctttcttaccttctctctgttttttgttttttgtctggactaattgctagtcagactgttctcctctctgcagtcccctgaattctgcttgtccctggggcctgggcgagcgctagaaaggagaatgggccagtaatcagctcgtcccacagtgagacacatatcctggtcatcttcctttgctcacccaacttccccttaagtttctgctaagatttgctgacctccctgccctataaaagaaaagcccttttctgattgattttgagatgtttacagttcttgagttccaaggattctcccctgttagttgcaagagtctttttgaataaatcttctccttatctaagacaagattagttttgcttgacaatgcaaatgaccagagggacacagagaactaagaacattttttaaaagggaaaggtcttgttgaaattaaatctatacttaatcagtatcagatcatcttgtatttgagacttcctatcttgtgtcttgagaagggcaagaagcagtctggtgatactgagctataaactagaaaggttttgctatcatctttgcagaactgaactatttatgtggcctacaggcaggttttctgcaggatgttgtatttgttatatgtttatgggaaccattcttctctcgaaataacaggctaaatttgccattaggacattgaatttacccacaaactttgtaataaatactcttcaggctaggatggtaatggctttactttggtctaaccagtctctaagtaaatagtatgaatattcttgctggtttggaactgctctccgctcaatttcattttcctcctggacagtgcaagaacactaaatgtggtgagtataggagccatgtgcaaatgcacaatgcaaattcctttttttctgcaagagaagaggatgaatatgatagatatttaggaagacttagtgaataatggcacttgggagcaaaggagaggaaagagccattccatggtctgagcaatgggaagccattctctgagtgggatggctgaaggggcatggaattgccaggagctaaagggatactgaggatgagcttagtttgagtcatcggagtctgcgtggtgttccacagtaactgcgtggatcagggccggagtcgtcttttttttttttttttgagacggagtctcgctctgttgcccaggctggagtgcagtggtgcgatctcagctcactgcaagctccgcctcccgggttcacgccattctcctgcctcagcctcccgagtagctgggactacaggcgcccgccatcacgcccggctaatttttttttttgtatttttagtacagacggggtttcaccgtgttagccaggatggtctcgatctcctgatctcgtgagctgcccacctcggcctcccaaagcgctgcgattacaggcgtgagccaccgcgcccagccagggctggagtcttaaacttgggagtggccagtgcagagatgggactgatgctatggaagcagatgaatttgcccaaggatggtgtgctcaatacagagagaagggagtttggataaggacccagaatcaggagcaggaagaagagtctacagagacgatcatgatgagaatgaccagagagaaagacggaaaccaagaacaggaggacacatggacaaacccaccataggagtggaggaacacatttgtctcaatgtgtccagcagacaactagttagtaaggacatagaagagctgaacgtgccagatctaatggacatgtaccatatatacatttacctgtcctcaaaaagatatgtatgacttactacaaaaattcaccacaaagtcgtgcacaaagcaaaatctcaactaacaccaaagacttgttattagacacattgtaatcaggttacctgactacagtacaattaaatttgctataaataataaaaagtaggccaggcgcactggctcacgcctgtaatcccagcactttgggagtcgaggcaggcggatcacctgaggtcaggagttcaagaccagcctgaccaacatggtgaaaccctgtctctactaaaatacaaaaattagctgggtgtggtggcacacggctgtgatcccagctactcgggaggctgaggtaggagaatcgcttgaacccaggagacggaggttgcagtgagccgagatcacgccactgcattccagcctgggtgacagagcaagactccgtctcaaaaataaataaataaacaaaataaaataaaataaaaataaaaaagtaacggaaaaaccctccatatatctgcaaaatttaaaaaatactgctaaataacccagggactgaaaaataaatcataaggaaaattaaagaagtctcagaactgaataaaaaagttactagacatcaaaacttagcgtatgcagtttgcctgcttatatgaggaagaaagactgaatttagtaacagcatacatcgagagaagtgagaaaaagaaaaaggaatttggaaggaaggaaaaaatggagaagagagcagaaactaatgaaataagaaacaaagcaatgacaagatcaataaatattaagctggttctttgaaaaaaaactgacaaaaataggcaagtctctggcagaggctgattaacaaagaaagaaaaggaataaattaaaatattaaaaattaaaaaagacataactaggcatagcatatacatgaatttgaaaacctaaacaaaatggacaatttattccagaaaagcaaaacattctaacatagtctcaagaagaaggaggaaatccaagtaacctataatccactgaatcagtacttaactatctactgactgcaaaagaaattaccaagccctggtgattttgtaacttttaccaaacattcaattcaagaaataggtaagtttaatcttctgcaaactttgttttcagagggaaaaagaggggaacacctcccagctcatctttctaggctagtgtaaactaaaaaataaaataaaattaggcaattgcagtatgaacaagggaaagcttgattcatataatttatgaataatgatgaaaaatctttaataaaagaaaagcaaagtagattttcataattatatgaaaatattgtgcctaagttttatcccagaaatgcaagaacggttccacattagaaatccattctacatgaatatatattcatgtagtttcatgtatattcactatattaacagaatacagttatatgtgtatgaatgtgtatatacatatatacacacacatatacacatacaaatacacacatgcatatatacttatctcaatagatgcagcatttgctaaaatttaaaactcatggcaaactcttagcagactggtaacaaaatgggattcccttcatctggcaaataatatttagtattagaaattttcagcaaacattattcttaattattaaactctttcctttaaaatcgggaacaagacaaggatggctactggctcaacttccattccattgtgttgaaagtcctaaccagtgcaggaagatgggaaaaattaagaatcaatgtgaagactggaaaagaagaaacaaaactgtcgttattcccagatgatggaaccctctaaataaaaagtcctaaacaatctacaggcaaactgttagagaataaaaaatttaaagtaaaaaaaagaatttttttttttttttgagatggagtctcactttttcacccaggccagactgcagtggcgctatctcagctcactgcaagctccgcctcctgggttcatgccattctcctgcctcagcctcccaagtatctgggactacaggcgcccgccaccgcacccggctaattttttgtatttttagtagagacgggggtttcaccgtgttagccaggatggtctcgatctcctgacctcgtgatccgcctgcctcggcctccgaaagtgctgggattacaggcatggccactgcgcccggccaaactaaaaaaattttaaactccctacttttccaataaggacaaaatgatatgacacctaggaatatatatttaacgtaagttgatcgagactgtatattaaaaatggtaacatttttattgaaaaacagaaggctaaatgaaaagctgtaccaaaaatgataattctccccagattaacctaaaaatacaatacagttacaatgatggtgtgtgtgtatatatgagaaagaaagagagagagagagagaagggagagagaagagagctctctctccatctctcttggaggaatgagaatggccaagacagttctaaagaggggaagagtggggatttaccctattaactacaagacaaatacagaaccagtatttcccgtaatgtggtaacaagagagacaagccatagaccaataaaaaaaaagagccctcagaaatagacatcttcaaatatagaaacagattggtgctgtaataattgatgactatccatacacaaaaataaatacaactagatccgtatctcacaacacacaaaattaaaccccagggggattactgagctcagtgtgagaggcaaagttttaaaacttccatgaaaatacagaaaatttttatcacttggggatggaaaaatagttcttaaaatgcaacactaaaaggacacatcatccaggaaatgaatttgcctgcattaaaactgaaaacttctctatcacaaatgatgcccaaaacaactttgagtgatgagtcactgatcgtgagaagacttttatgacaaagggaaatcgtttagagtaaagagcaaataactcagcaggaaaagagaaaaaaccagggagttagcagatcaaaacaaatagccatcagtcacacagaaagcctgaggacatcgagaagcaaggctgccttttccactggccaggagagcggggatccctgccatcgctgtggagtgcggtgactaaagtcctgcagatgcacttcccctgtgagccagcaagtctgcaggctggagaaaatgcagcaggtgcacacacgctgccgagtgcacatcactccgcattctagcactgttagaataatgagaaactgggaacaacccagtgtccatgaacaggagatggagaagcaacctgtggaatactcgctcaatgcaagaccatgcagaagccccacgaagatgactaaggcaacccttatctacatggatcagtatcacaaacctgatgggggtgagaatagaaactggcttacggtaccaaatgcgtcaactttgatgtaaagtttcagtgaagcagacaactctgcaggggaatgaaaaattccctgatgcctcaggatagtggctgcttctggacaatctctaatttcagacagagggagggacagagagccgtggcagtggaggggactcagatgggtctgcaacaatgtatgataatatatttcttatttaaagaaaaagaatagaagcaaatattgtaaacatagtaagattgaataaatctggaaggtattatattattctcatacttttctgcacgttgaactagctagtaacttttttttttgagacagagtcttgttctgttgcccaggctggagtgcagtggcatcatcttggcttactgcatgcagcctcaacctctcaggctcaagtgattctcctgcctcagcctcctgagtagctggaactacagccacgcaccaccacatccagctaatttttgtatttttagtagacacggggttttgccatattggccaggctcgtctgaaactcctgagctcaagcgatccgccggcctcggcctcccaaagtgctgggattacaggtgtgggccactgcacccagccactgacaacttttttaagggtgcagtgctcaactttcagatgtgccaggagatgcacagaacaaggacctgctgagggcaccgctggtcatttgcacggaaatgacccattggctgtcccctgctctgctgcgattcttcaggcaccacctagtctccgtctcctactaagcggatcaggttggaagtggaggaagcaatggatctggcattaaagatggaaatctggatctaccaccagttgagtctgcagctcagcccctgcacatcctggggcctccattttcccatctcctcatggaaatcatgaagtccgcctcatggacttcactgcggttggggtggtggtggagaagacagctcatgggatttgaaagggctgcataaaccagttcccaaaggatgcctatgcagcgaaaccagcccgggaccagcgcaaaataatactagtaggttttatgtctcccatggatgctctgctcctttgtccagtgccctgtcctgtggcccctctcactttggggaccatgggacatggagcctacctggagatcagaggttatttttaaagcatttggttatttcagggctctaaatgagtatcagaatgagagagaggagaaggcagtattgaacggtatgagaccatgggtgtggtggtgtgtggccgtagttccagctactcaggaggctgaggcaggagaatcacttgagcctgagaggttgaggctgcatgcagtaagccaagatgatgccactgcactccagcctgggcaacagaacaagactctgtctcaaaaaaaaaaaaaaagttattagctagttcaacatacagaaaatatgagaataatataataccttccaggatattgtcccagcatgttggccaggctggtcttgaactcccgacctcagaatatcaaattgctcagaacaattgtgctccactcccctgtgattataggattccctgctcagcttcctggaaccagtgcctatcggtttcggaatcacacccaatgccctccatgcatctctgaattcatgcattattccagtcctatctttcctgcctttgcttttgtcctttgttcttcccctgctcacttacctgtcatgaaaacttccaacagcttcactgaggtaaaactggcacacaacgaagggcacccatttgaagcatgagtctgatgagttttcacacagtacacattctgtgctttcatttgccctgctgccatttttaggtattcttttccacggccccttcttcccatggtccctttttatttatttagagacagagtttcgctctgttccccaggctggagtgcagtggtgtgatttcagctcactgcaacctctgcctcccaggttcaagcgattctcctgcctcagcctcctgagtagctgggattacaggcgcccgccaccacacctggctaatttttgtatttttagtagagacagggttttgccgtgttggccaggctggtctcgaactcctgacctcaggtgatctgcccacctcggcctcccaaaatgcagggattacaggtgtgagccaccacggtctctttattctagaacatctcatatggttcaatattgccttctcctctctctcattctgatactcatttagagccctgaagttaccaaatgctttaaaaataacctctgatctccaggtaggctccatgctgtcctctcccgtttgtttactcatccatctgcagcactttctccagtctggtgtttggcccccgaatggggcggtggagctcctcccgtactttctgtttggacactagagtgactggggtactttagagtgtgaaaatgggtctactaatatctatgctggaccatcttcgaccatgtggtgtgtgctaaccctaaacagaaccctctcctgagatcctgacacccagcctgtgctggcatggcagagaccacacagctggaaggaaggagggactgtctctctgtagttccttttatctgaatgtgctccgaactgtgggtccctgcattgggggaaggagggagtctgtatggcatagccatctgggtcccagagtctcccaagaagctgccctaaatcctgccacatcacagctgccaaaaaactccaaaggcagcacctcccttagtggtggctccagaatttcaactctgggactgcaatctggaaggaggctgtgtgtgcaggggaaggagtggtatcttaaagctgtgtttgcacagcacattgcattagaccttaaaaatgtccaccatccatttcaaacagtgggagcactacttataaaaattataaaggcctttagaacccaccctccccataaattaccaccggcaccataggtgattccacatctgacccatcaaacacctatcagtccttgttcttcaaaatgagggcatatttgagacctagtatggcttccagtaacctcccagaaggcctcataaagctgagttgaaagttgttctttctctttctttgttctggtcttatatgcaatatgtctggcagaaaattctagaacattctagaaaaatgcaagtgatgcattggccattaaggaagggtacaggtcttcagccatttttgtgtaggttttctgtcatttcagctaggattagaggtgaggtatgtgtatacatggccaaccatctgtgttcccattaccacatacctagagctgtgtttggtatcattcagcaatagaatcccagatttttttcatatattcccacttcctcagcttcttagatgctaccgttcttttcctatagctaacctacccgtatatcacccatacacactgaaaactgcatccgtcatcctactcaacaaaataatggctctctttcaggacagagggaaggattgaaaaaatttctaagttaatattttaatttcctgtcatagtgaaaacacaacatattacactgtcactgtctgtttttctttctttcttttcttctttttttttctttttgggacagagtctcactctgtcatccaggctggagtgcagtggtgcgatctctgctcacttcagcctcctcctccagagttcaagcaattctcctgcctcagcctcccgagtagctgggattacaggcgtgtgccaccacgccaggctaatttttgtatttttagtagagatgaagtttcatcattttggccaggctggtctcgaactcttgacctcaggtgatccacccgcttcagcctcccaaagtgctgggattacagatggaaaccactgctcctggccaactgtctgtttttcttgtctgtttcccccagtagacttggagggcagagtcagtgtctcttatctctgtacatccagtggccaacccagacacagaagaggtgctcaaaaattttctctgaatgaataaattaaaaactcttattgatttcaaaaacagttactgggtataatttgtgccacgcccctcgctgtaagccagaaaaagacaggagaaatgccgggcagtgaggaggccaggtcaggctggtgaccacagacatataagctgctcacccacaggctgtgcggtatgctccactggtcttgttgctcaggatgcaaacaaagagatagcagatatttgggctcatccagggatgcctgctagccagggaggcaccacagaaaagcagtatgagaaggagctctcacatactggtccagggatggctgaacaggtggacatggctcatgcatagagagaggggcggtatcgcacagtggagtctggctgaagctggacagcactcaccatggggctgtgtgaaatattaataataagatatgtattatgtgtctttggtctctgctcctcagtccctgctaaagagctgctaaaatccttgtcacttcctgagtgacaggggcactaggtaatctttttgttgttgtttatagttagtttttctttctttttttaattatactttaagttttgggatacatgtgcagaacatgcaggtttgttacatgtgtatacatgtgccatggtggtttgctgcacccatcaacacatcatctaggttttaagccctgcatgcattaggtatttgtcctaatgctctccctccccttgcccccaccccctgacaggtcctggtgtgtgatgttcccctctgtgtccatgtgttctcactgttcaactcccacttatgagtaagaacatatggtgttgggttttctgttcctgtgttagttttctgagaatgatggtttccagcttcatccatgtccctgcaaaggacatgaactcattctttttttatggctgcatagtagagaatcttctgttttagtatttggtgtttgaccccagctcctaaatcctttggaatttcctgggtgataggagtgtcttttgttctaatgaagcgactcttgatggaattctagatgggtgctgggtcaccagaatgaccaagccatgatgacgagcttggggctttcagccccactccccattctccagagaagggacagaggctggaaacggagttaaaaatcgatcctgcctacatgatgcagcttaaataaaagtccctgaacggaggggttcagagagcttctgcgtcagcgaacacatccccatgccaggagggtggcgtaccctcgctcctcggggacaggggctcttgtgctcaggactcccccaacctcgccacatgcatctctccacctggctgtgcacctgcatcctgcctcatatcctttataatcaacaagggcatggaagtaaagcctttccgtgggttctgtgagccactctagcaattcaatcaaacccaagtagggggttgtggaagccccagtttataccccattggccagaagtacaggtcacaacctggggcttgtgactggcatgagaagtgagtgtggtcttgtggggctgagcccttaacatgtgggatccaacgctgtctccaggtaaagagtgtcagaattgagttgaactgagcacacccagctggtgtctgctggagaatggtttggtgtatgggggaaatgaatacatctggtgtcagaagtctcgtgctgagtggtgtgtgagagtagagcactggaggctggaaattgtcttgctttttttttttttttaactttcttagagacaaagataagaaagcacataaactcaataactgattgatttcttgggaaacttttatctccttgtccattgataaggtttctctgggtaatttggtttattgtggctcagtaaattaaaccaggtacatgaaagaagaataagatctttaactttgatttgaattaggtcactataataaaagcataaggacattgttgaatacagcaaagcactaaaggtggctagatgcagtgtcaacatgttacgaagcatatttcaccagttaacagttctgatttttgtaacttaaaaaaaaatactgtgaatactggtccaaaaatatgtcacagtcttgcgctgggtttgacttggcaaaaatggccatcaatctacctaaacatctttttattgtttaagcatttattatgtcattttttgttacaaaagccgagacactgtttcatcaggaacgggggtctgtagccttgctttttcagtagcacttgtccatcactgtcaaaggctttgagaaggcagatactgaaatcctaatttttagaccctatttcctgactattcataatgagatgcccagaggcaggccctgtcatcgggaagcagggacatgggtcctggagggctgagacactcagatggtccctgccctccaccaggacctgctcaggaacccaggaggagccacctgccctctctctgggctgcagccttcacacctgcaccatcggtcaatggaccccaggatgcaccctccctctggctctacaattctgtgaatccctgtgtggtgtggtggagttccaggtcccctctgtgccctctgccctgctcctcgctcagccccataaggaggtaagaaaccatcaatatcctcaagagagaggcttgttggcccccaggggttctctgctaaaaaaaaaaaacagagaatctaggagcagggccagtcaggaagggcagaacagagatccaggggtttcggggcctccaaaccaacaaaagacaatccgagggatgagtgaagcaacatctgcatgctcttctggattccaaatttattcctcctcggccatgaagaaagttggtttctgcttttttccctgaggatgggctgtgcctgtacagccttccaggtatgggaggggaggaaggaggggagggtgcctgacaggaagcaagtagttggacaaatctcattaagtcagtatcagttaattcaaacacaactaaaatcaaagtgctttgattcccaagccaattatataggatttcccccacataaattgagttcattacatagtaagtatagataatccataatttaatatggaaaattcagacatggagtgttactaatcagataaacagagcctcaaattagactatggaaaagatcaatggacctgctctaattgccaaccaaaaagaagcaagcaaaagggaaattaatcaaaggaacattctcctttgctccttctttagctaagcgtcaagaacattttgcaggtgataggaaggggctgtcctggatatccgtgcaaaagagtagagcagcctcttcccagagtggctccatttccaatggcccatatttgttctgctgcccaagagttttaataaagcaacaccggatccctgcagaagatcctttcactgcagtcaaagtcatcaggcacagcttggcttggatgacttttcaagagtaaggattatattaaaaatgactgcaccactaattatgagaaaactagataatgtggcacatgactctcagaggaagaagtatctataattatgggaaggaagtacaaaatcttaattatgctaactatttaaatagagcataaggcttgagatagaatttaagggttaggaatctgccttagtgctttgaagtatccatatacttcagaaaagggatctgaaaaagatataaaatacactgaaaactccactgtaattaactagctagagacatccatgggtgcaaaccgtaaccaaggagagaaggctgctgcaatctcagggataaaaacgaagacacaagggctcatggaaaaaaaagacaaagacagaaggagccgaggagggagttgccaagactcaagatcacatcgcaagcagaggaaaaaggtaatgcctgctgcagaaaacagccaggaagagaagctttacaaaaaccgaacagggataggggcagtggctcatgcccataatcccagcactttgggaggtcaaggcagcaggatcacttgagcccaggagttcgagaccagcctgggccagtgagatcctatctctacaaacaataaaaaattagctgggcatggtggcatatgcctacagtcccagctacttgggaggctaaggtgggaggatctcttgggcccgggagtttgaggctgcagtgagccgtgatcacgccactgcactcaacctgggcaacagagtgagaccctgtctcaaaagagtttgttaagtcattcatgctacatttccaatgtgggtagggtgcaggacgctctgttcattgtagtgacccaggctgatggcactgccatcacctctactctgccaattactgtgccagtgggaaagagagctctggaagacctcaaaccacatttaaacattctgacttgaaagtggtacatataagctttgcttacatggcccccagcaatcatgaggggacagggaagtacaatcttaccatgtaaaaggaagttggagagctagacatgttttaaaacagcattaatgaccatcacatacctaaaggggagaaagcatttggctgactttcagatttttccctatacagatattcaatgcaaaagagaataacatatcatctataaacccctaagagaaagtttcctcaagaattctgcacccagggggaaaaatgatgtagaacattattccagaacattattccagattctgctgaggatggagaaagctggaaagaacattgccccaccattacaacaacaagaagaagacattgggttctgcaaattcccaacttaaggtgaacccatcagacagctgaggtcacaggacagcaaattctaaggaaaagacagagtctccaaggagagacatgagcacttacctggggcgtatgcagtcagataccagctctagtggaaaaggtggacaagatggaagatcactgaggtaaggtagcagagaggtggaagcaatgaggaagagtcaaatgcaaatactaggaattaaaaacaggcacagagatgaagaatgcctttgatagacagggtcggcagtggactggacacagttgaggaaaaaatgaccaagtggggtttatcttgggaatgcaaggctggcttaccactcaaaagtcagtgttattcaccatttgagtggactgaagaagataatgtatagcaacatctaagcagacgtagtaaaagactgataaaattcaacagccattcgtggtattaaaaacaaaacaaaaaccactctcagcaaactaggaataggagggtacttctacaacctgataataaacatctatgaaaaacttagcgctaacattatacttaatccctaaaagcaggaacaagagaaggacatctgttctcaccatatctattcaacactctacggggcggtctagtcagtgtaataaaacagggaaaagaagtaaggggcatccagattgcaatgtgtgctgatttattttaggtgtcaacttgactggatgaaggatactcgagaactggcaaagcattgtttctgggtgtgtctgtgagggtgtttccagaggagattggtgtgtgagtctgtgaactgagtggggaagatccaccctcaatgttggggggcaacatctgatcgtctggggacctggatagaacaaaaaggcagaggaaaagcgaattattttcttttgctcttctggagctgagacaccctttcctgcccttggacatcagaacttcaggctctctggcctttggaccctgggactcacactggtgcaaccactccccgcaggttcttggccttggactgagagttccaccattggtttccctggttctgaggccttttgacttcgactgagccaaactcccagctttccagggtctccagcttgcagatgggactgtcataggacttcttagtctccatggtaatgtgagcaattctttcaataaattccctctcacctatctgtatctgtcctattggctctgtctggagaatggaagacgtaaaattgcctctctttgcatagcacatgactgtctacataagaaaacccaaagaatctgcaaaagagctaccagaactgagtttagtcaagaccacaggatacaagattggtaacaaaaatcaaatttctatgtgctagcagtgaataagagaccattaaaaaataccattaggatagcaccaataaatgtggaatactttaagcataactattacaaaatatgttaagatctatatactgaaatttacacaagactgatgaaaaaaagaaacactgaagaaatgaagtatgacttaaataaatgaagaactagatcatgaatatgtcaagtctcttcaaagtgacatgtggactccatgcaatctcaattaaaatcccagcaggattctagtagaaaatgcacaagtggattctaaaatttatatggaattacaaaggaaatgatagctaagacaattctgaaaagcaacaaaattggacgacagcaataaacagatactcgcttccaatagtccctggtcctcttgatctcagatgaaagtcagtccctgccaaggctgttgctccttgcataggccctcaggtgggggacaggggcaggctgcctcttctcctagcacctaagccactgctgccacttccagaccattggcctcacaccttaatcacaactcctgcctcctttgagcctcctgccaccagttttgatagttcctatctctaagtaggctttgtacacaaattcatgagggagtttaaaatagtgtagtctttcctttgctttcaactcttaccagtgtcctgggcaatctgaatacccatggggatgtgccatgcattcagctaggctcccagccttccctggaacttcttgacttcagtggcctttactctatgccgtttttgccacctcataccaagggcttttctcaccaatgtaccagaacagtgaataagagtgagactgcaaggtcaccagctccccctagacctgagactgcattcttagagacagtgttgttttttcaccagcattacctttcaagccacagtcactgctgcaggggctggagagtcatgaaaaccgggtcctgcatcccatgagtgaaggcgttcaagggggacgccaggaccttagaggagcctgttgaacaccccaaccagccaactgaggaacgggaggtaacgtgaggcccaaatgcatccccatactcaagaaaacattcccaggttgaagaagtgacttagcagttgtcagaatgagatcgcagagtgagcaacggctgcccgtgtcccctcccaggagggctgtgaaaggccacagcagacctcaggcactgacccaggcaggctccaggatgcagtgaggtagaatgtgggcgtaggtaatgtgggcagcatgaaatacctggtcccatgatgggatgggccctggagtgctgcagttcttgattcctccaaccccgctgcatctgtcactctggtgagctgctgggaccatccaacttggaccattcctccgtgcaaaacatgacaggcgctgtgagccaggcgtagtcctaccatggagatgagccgcatcctctctctctgtacatctttgcttgtctaccagccggagaccacccatggaggactaatcacaagcactcaaggtcaacgctttcctcctctccccagatccgaggtggctctctgcagtttcccatcccctgcatactgcattccctacacacatgctagaaccccctccatactgcaaacacaattttaccaccaactaagagttccttggactgtgccacatctttttatatttatttatccatttttttcttttgagatgaagccttgctctgtcaccaggctggagtgcagtggcacaatctcggctcactgcaacctctgtctcccaggttccaatgattctcctgcctcagcctcccaagtagctgggactacaggcgcccaccaccacacctggctaatttttgtatttttagtagagagggggtttcaccatgttggccagactggtctcgaactcctgacctcaagtggtccggctgcctcagcctcccaaagtgctgggattacaggcgtgagccactgcgcccggcttgtgccacatctttttaaaaagttttggcacagttttattcaggggaaacagaagaattgggttcactcttcttatgtatttttaagtagccaattttgcttttcagaataaaacactcggaagaaaaaataaaataatataaacaatttttccaaatcactttttttttaaacatcaaatgctacacataagaatagactcccaggggagactgtctgatttttttcctccaaatatcttttaaaaagcaaaataaatccccatttgttccctgatggtataacagccaaaaatgtcagaaaagccgtagaatgatcccatcatcatttgtaaagacctctttcaaccatttgcatccgaatttgcagatgtcagaggtaggacaatgaaatggcaaaaatgcaaagtgagatccagaaagcaacactttcaaaatcaaaatatataatcctttcaaatgttctctggaaagatattccctcttgcactgaacctaccccgggaagttaagagctgaaaggaatctatatgttaataaggcttcctaaactgtctgtaaggcatggaatgaaatgcatgcacaagcagcgcccagcggggtcaccttcaaggtcagcctcacagcgttgcagttctcctgcagcgggttcagcttcagcgtctccccgaggttgctgcagccggacgactggtgctgcagctcacagcagacacacacctccacactgtcaaacttaatctagacagaggaacacagacagacctcaccgttaacaggcattcgacccccgagggtacgcgtgagtgacacagttcagaacacaggaaaatggctcagttcaaaggagcctgtttcagtgtgtttaagtagtacagcaaaaacaatttctattgacccaggccatcaggaggacttcaaattcctatcttaacagcaatgtatagaaaaagcaaaagtacatttgaagaaacttaagctatacattagagaaaatggcaggtggattacaaaatgagataaaggtaaatagattgaaagtcactcatgctgatgtatgcacggagatgtgctatcctagctctgtgccttggctcattctccttccacagtcagaaatttcctgcctcacttcatggcctatcaaactcctgctcatccatcaagacccaactccagcgccaccctcgaggccttgtctggttttcctgcctcactgctactgaagactgactttatccagctacaggtgcatcttatcaccacagtattgacaatggcaacaagttgtaggtgttcaataaatgctgaatgaataaaaacggcttggaaaatggaaaaccatggaagaaaaaaatgcatttcaagtattttaaaaagcagtgttagacgaagagagagtatgagagtctcagtgagagggaagagaacagagttaccagtgcctaggagaaaagcagctttaaaaaagtaaagtcctagccaggtgtggtggtacaccacctgcatttgcagctactcggcaggccagggcaggaggattgcttgagcctaggagtttgagaccagcctggctgggtaacatactgagactctgtctcaaaaatacgtaaataaaaaataataaagtcctagatgtaaaactactaaaaaagaaaatcaggccaggcgcggtggctcacacctgtaatcccagcactttgggaggctgaggcgggcagatcacaaggttaggagttcaagaccagtctgaccaacacagtgaaaccccgtctctactaaaaatacaaaaattagctcggcgtggtgctatgcacctgtaatcccagctactcaagaggctgaggcaggagaatcgcttgaacccaggatgcggaggttgcagtgagctgagatcatgccattgcactccagcctggatgacagagcaagactccatctcaaaaaaaaaaaaaaatcagtaaaatctatgcaattttattcaaaataacactgaacatgaaacaagttattttccttagactaagaagtgccctgctttccaatagataatatgtttacagcagccaactcgaagtacaaatacttttcagacaaatattggccatttataaccataacaaataatttttcattgcatgaatattgctgagactgaggccatacttataaaacctccaggtatcaacatgtccgcctctcctaaatactgggggaggggtaatggagcatcctcagagccaagaaatgtgctgatattcaccagaggaactcagcttagcttaagacttagcccctgccaccccctgctccatgtcaggtgggctttgcgagtggctttcagcaggagaatatgggtagaggtgtcagcttgcagcttctgaacttaagacctccacaggcttcatgtttctgcaccctctccctggaacttccaatatacagcaggaaaagaacagattccagggagctgccagctctccagtcccagcaggaaacccgtggagcacccctgcagaactgttctgccctatggtacatgcacacacaacattactaggtaagatcaaaccatttttcaaataattcaaacaaattatactcccaccaatagggtgtgaattcaggctaatccacatcctcaccaatgcttgctaatgttggacttagacatttttgtccatgcagtaactaatataatagtatctaatttgggggtgggtgggtttgttttcatctttcctcattttcttaaccgttcatattgtgaaacctaacacacatacacaaaaagtgcacaaagcaaacatattcagttcaatgatttatcattaagcaagcacccaccggcccatggccatgttcctaaaaggccttccatgcctcattccctgtcattcctcccacttgctgcaccaaaagctcaccacattccttactttttaaataatcacttctaggcttccacctttatacatttaccactatagtttagtttcacctggttttctaacttgatacaaatagaatcatacaatatttttagtatttggcatctttcattcaaaattacaagattcatctaccttactgcatataaatatagttgatcatgttcactgttgtatattacattgtgtgaatatgctgccatttatatatctattctcttgtcacgggacgtttggattgttgctaatttttttgcaataagattaatgctgtttgatattctgtactagtctgctggtacatacatgtgcatatttcttttgggtacaaaatacctattgatcagagctgctgggtccctggggattttcagctttagcagagaatacaaagccactttccaaagtggctgtaccaatttacacactcaccagcactgttcgagggtccccattactccacatcctggcttgtgcttgttttagtctttttaattttagataagaaagtactggaagaggtacttcttccttgaaatgagggactaagccaagaaaaaaagggaagatgggatctaacacagaaaagagatagaggaagttctaagagaatgggaaaaggatgtcctagcatggtaaatatatagactgcctataggctgacttgttcagactgaagcaggaaacaggctcaatggaaacgtctctaagaaaatgaagctgacagaacgcttgatgggtaggactgtattcagaggagattttcagttctcctgggaagtttgagagtaaattaggaacagagacactaaacaaataataaaacaattttaactcagcataaaagacaaatcatatatagtacatggttttgttatatatgcggcttgtaaatattttctcagtctatagtttatctttttatcctctcaaaaggatcattcattgagtaaacgttttaaattttgatgaaggccaacttacatatttttgctcctacacttttggtgttgatctaagaactctgcctagccctagatctttctcctatgttttttctaaatgttttataattttatttttacatttgattgcatgacccattttcagtcacttttagtgaaagatatgagacttgggatgaggttgactatttttgcctatagatgtccaattgttccaacatttgttgaaaaatctatcttttctttgcttaattccttttgacttttgtcaaaaattagtcgggcatatttgtgtgtctctatctggattctctctttgttccattgatctatctttccaccaaccaccaagtcttgattactgtggctataagtctggaaatcaaaaaattaattcctcccatttaattcttatttttcaaaattatttgtctctccatatacattttttttttgagacaggtcttgctctgtcacccaggctggagtgcagtggcaccatctcagctcactgcaacctccgcctcccgggttcaagcgattctcatggctcagcctcccagatagttggaattacaggagcacgccaccatgcctagctaatttttgtatttttagtagagacaaggttttgccatgttggccaggctggtctcgaattcctggcctcaagtgatcctctcacctcagacttccaaagtgctgggtgtacaggcgtgagccaccacacctcgtctccatatacattttagaataagactgtcattgtctccaaaaaaagtgttgctgggattttgatagggattgaatcaaacccagtttcttttttttttttgagatggaatttttgctcttgttgcccaggctggtgtgcaattgcgtgatctcacctcactgaaacttctgccttctggattcaagcaattctcctgcctcagcctcctgagtagctgggattacaggtgcccgccaccaggcccagctaattttttttgtatttttagtagagatggggtttcgccatattggccaggctggtcttggactcctgacctcaggtgatctgcctgccttggcctcctgaagtgctgggattgattacaggtgtgagccactgtgcccagcccaaacccacatattaactggggggaaatggacatatttactacattgaattttccaatttatttatttcctcattgttaacgcagttttcagtgtatgttttgttagatttacacttatgtatctttttaagcgatttttaatttcagtgtccatatgctattaatatgcagtattactgttactatacagttcactattaatacacaagaaatacaattgaattttgtatgtttatcttgtatcctacaactttgctgaactcacttattaattctaagaggcttgtttgttctgtttgttttttaaagattctttgggattttctacatagatactcatgtcatccacaaacagagttagttatatttgttcttttctaatctttatgccttttattttattttcttgccatactacattggcttgaaattacagcattatgttctatattgaaaaaaatggtacgaatgagcatgcttgccttgttcctgatcttaggggaaaagcattcagtctccattaagtgtgttagctgtaggtcttttgtagatgctctttttcaagttgaggacgttctctatgcctatttttctaagtttcctttttagttatgaaaaggtgcttgagtttgtcaaatgctttttctccaacaattgatacagccatgcagtttctcttctttagcctgttgatatgatagaataaattgactgatttttgaatatcaaaccagttttgaatccctggaataatccctcttggcaatgatgtatataactcctttcagatatgttgaattttattcgttattattttgttaaggatttttgtatctatattacattaataagggatattggcctgtaattttatttttctatactgtctttgtctggattttggtagcatggcaatattactttcacaaaaatcaatttggaaatgttccttctattttttcagagaaattgtgtagaaatggtattaattctataaatgcttaatagaattctccagtgaaaccatctggacctggagattttgtttttggaagttttagaattataaattcaatttccttaataattatagggctattcaaattctctacttcatagtgtacgagttgtgttagttcgtgttttccaagaaattgatctatttcatctaagttgtgaagttcatttgtgtaaagccattcctattattcccttattatccttttgatgtctgctgggtctgtagttatatcccggtttcttcccagacattgggaatttgtgtcttctaactttttttcttgctagagttttgtcaatgttgttgatgttgtcaaagtatcagctcctttttcattggtttttctccattggttttctgttgtccatttcattgatttctgctctttcatttatgatttcctgacacctatttgctttgggttgattatgctgctctttatctagtttctttttttaattttatttttagttgagaaataattctatattacatatttatggggtacagtgtgatgtcttagtaatgtttacattgcagaatgattgaatcaagctaattcacaaatcacctcccattttaaaaattttttttattttactttaagttctgggatacaggtgcagaatgtacaggtttgttacataggtatatatgtgccatagtggtctgctgcacccgtcaacccatcatctaggttttaagccctgcatgcattaggtatttgtcctaatgttctccctccccttgcccccaacccctgacaggccctggtatgtgatattcccctccctgtgtccatgtgttctcactgttctactcctacttatgagtgagaacatgcagtgtttggttttctgttcctgtgttagttttctgagaaagatggcttccagcttcatctacatccctgcaaaaggcatgaacttattctcttttatggctgcatagtattccatggtgtatatgtgctacattttctttatccagtctatcattgatgggcatttgggttggttccaagtctttgctattgtaaatagtgctgcaataaacatacatgtgcatgtgtctttgtggcagaatgatttataatcctttgggtatacacccagtaatgggattgctgggtcaaatggtatttctggttctagatccttgaggaattgccacactgtcttccacaatggttgaactaatttacactcccacaacagtataaaaccgttcctaggccgggcacggtggctcacgcctataatcccggtactttgggaggccgaggcaggcggatcacgaggacaggagatcgagaccatcctggctaacatggcgaaaccccgtctctactaaaaatacaaaaaattagccaggcgttttggcaggtgcctgcagttccagctactggggaggctgaggcaggagaatggcgtgaacccgggaggcagagcttgcagtgagctgagatcgcgccactgcactccagcctgtgtgacagagcgagactctgtcttgaaaacaacaacaacaacaaaattgttcctgtttctccacagcctcaccagcatctgttgtttcctgcctttttaataattgccattctaactggcatgagatggtatctcattgtggtttttgatttgcatttctctaatgatcagtgatgatgagctttttttcatgtttgttggctgatatatttatctttttgtggtgaaaacatttaaaatctactcttaagcaattttgaaatatacgaggcattatttattttagtcatcattttgtgaaatagatcactaaaacttactccaatctaactgaaattttgtaccctttgatctatatcctctttggcttcaactgtttccctttgctgtgatcaactggacaggagtccagctctcctgaaacagttcactctcccacgtctcaaaaacattcaaggaattatctcatatgatcacatctctaggctaggcattaagattgaagtagctatcataaatggcaagacattttcctcagtctgaaggatcatccggggaaagggaggggagatcagcttgtctggaaagcatgatttatcaaataaaataacccttcaatgaccccagggaatagacatccaaataaatcttttccatcagttatttcactgagtttgtgattaattcttaggaaaattctgaaaacctcctggttagttccctgacctcgacatctgggtgtgcaggcggctgacagatttattttaagagtacccctcagtgttcgggtcattgggaacgacaccgcagagctttgcaaatgaggccacagtaatttttcacaaatctctttggggcacttaacagctagcctgccccccttatttatggtctatcagcctgtctgggagtagaaagggcttatacaacaaaaagagggggatgcccccacgattctcttacagaagtacaaatgggatgggtatgtgaccttcagatattctcaaagggaaggcagtgtgggaaggctgagcatgtaggcagagcagggcagagggctgggaagaggctggcatgtgtcaagcccgagaacttacagtgggcacaccaaggccagtatccttggatgtgaggagcctgtttcgaggaggaaggaggcgcagcacgggtgacagagtcagactactcacagtcctaactgccatggagtgacccaggacaagccatgtgacctctctgggcttcaggttcccggaccccagtgaggatcaaatgagattagacaggtaaaaatgcagagtgccaacgctatttgccggtgttattgatgttgctattatttacattaaagaaaaaatttgtagaaactagaccctaagttttcttcccaaaggttcaaacaaagctacaaaaactagaccctaatttttaaattgtggtaaaatacacacaacataaaatttaccatcttcaccatttgtcggcatacagttcagtggcattaaacatattcacctcgttgtgctaccatcaccaccatccacctccacaactttttcatctttccaaactgaaactctgtcaccactaaacaaatccccattccctctcccacaggcccccaacaactcccattctactttctctctctgtggattcactactccaggtacctcctgcaagtggaatcaggcagtatttgtccttttgtggctggcctatttcactcagcatgtcttcaaggttcatccatgtggtagcacgtgtcgagatttccttcctttttaaggctgaagaatgttctatcagatgcatctaccatattttcttgataattcatctgtagatggacacctgggatgttttcagctcttggctgctgtgaataatgctgctatgaacatgggtgtgcacatatctatttgagtccctgctttcaattatttgggtaaattcccagaaggggaattgctggatcatgtggcaattctctgtttaatgatttaagaaaatgtcataatgttttccacagcagctgtgccattttacgttccaccaagagtgtacaaggcttccaacttctctacatcctcaccaacacttattttctgggttttcaaaaaatcatagtcattgcagtgggtgtcaggtggtatctcactctggtttcgagttgcatttccctaaccattagtgatgttgtgcaccttttcatgtgcttactggccatttgtatatattatttggagaaatatctattcaaatcctttgcctgttttcaaattgggttgtttgtgttcttgttgagctgtaggagttctttatacattccggatagtaacctcttatcaactatacaattggtaaatattttcacccacggagcctcttctgttgattgtgttctgtgatgaacagaagtcaattcaactttttgaatacttgtaggtttccatcactttcacaaaaactgtcagtaacctgttgatttctccctaacccagtaatttttgcttcctttgtctcaagaatgagccaccttaagtcttgctgcagaggtaagcatctcacttgcctcactcagtccttgtcctgctttctgagcaatgccactgtcctgcagcatccctgctggtggtgggagagggtccccacaacaccagccccaatgacacaggacgacataactgcctttctctggactactattaacaaataccacagacggggtggcttataaacagtagaaatttatttctcagagttctggaggctgggaagcccaggattaaaacaccagcagatttggtgtatggtgacatcctggttcacagatggatcactgtgtcctcacctggcagaagagacaaggcagttttctgggacttctattataaaggcactaacccactcatgcgggctccacccacatgacctaatcacctcccaaggaccccacctcctaataccatcaccatggaggttagaatttcaacatagaaattcgggggtgggggacacaaacattcagaccacagcaaaaacccttatgctggtgatgctcaaggcacttaaaggcactggtaagaccccaaaaactccagtaatcacagtgcaacatgggtggaccctgatgacattatgctaagtcaaagaggccagataccacagatcacaccccgcatgattccattcaacatccagaacagaaaaacccacagggacagaaaccagcttagcagttgtctgggactcagtcggggacaggggccaatccggggtgcgacataaagggtatggtatgtttttttgaggtgatgaaaatgctctaaaattgactggggtggtgacgcacatacggtaaatatactaagaaaacactgaattttacactttaagtgggtgaattgtatgatacgtgaattatatcacaataaaggtgtttcagaaaaaaattaccaccacacgtaattactaactcatttagtttggttttaatcccttccgtgttctgcctaaacgttttatattcacacacgtgtcaccaacatcgacagtttgggaccaatcaaaactaccttcaccactgtctccccggcataaactcagggccaacatagacatgctccgtaggttggatgacacggagccactttcccgcgagtggctcaaagctactcgccaagcagctcctgcagcagtgccctcagccagcccctccagctcttccttactccagagcatcaaggactgggcacctttttgttcctggagagatgctgaatgcagtccctgccagacctgaggacaaagccggcccattattggggtgtttcccctgtgctacacactaggcgtggaagcatttggactggcattgtgtccagaattggttcccgcccgtggcttcctggtctcaccgacttcaagaatgaggccgcagacgttcccagcgagtgttacagctcttaaagattgcacgaacccaaagagtgagtgataacaaagtttattacgaagagcaagagaacagatcttccacctcctacgagcggtgtgccgctgccggttggggggcggggggggtggccagcttttattcccttatttgtccccgcccatgttctgtttctgtcctatcagaatgcccttttctcaatcctcccccacgattggctacttttagaatcctgctgattggtgcattttacagagcgctgattagtgcattttacagagcgctgattggtgcattttacaaacctagctatagggtgctgattggtgcgttttacaatcccctggtaagtcagaaaagttctccaagtccccactccacccaggaagtccagctggcttcacctctctcttccttactccagagcacgagggactgggcacctgtttgttcctggagaggtgctaaatccagtccctgccaggcctggggacaaagccagctcatcactggagggtttccctgttctgcacaatgggcgtggaatcatgtggatgggcgtgtcactgagggatccccccagcctccccactaggttgggaatgcagccatcagtgggggtcaccccaccttccctgccaagctagggacacaaacccccacgctggcccctcctagcctgtagcccccctgtcccctggggggcttacaaatgccgggacttctgagaactgagactgccttttgtgtcccctacagcagggatggcaaacacagaccacacatcccaccatttccctcttttgctttcaccctcccctccccccaccctgagtccagataacagccttagaatcctactcaacacactgttctgggcacttaatgccaggcagaggaagctggcacacaacgtgaaacctacttgccatccctgtcctacctataagtagatagggccaaaaataggagaaaataaaatgtttatgaccaaatacataaagacattgtaaaatgttgatgcttgctaggagggaattagctgactccttaaaaacatgtgtcatctactttgaaatgatcgagaaatgctggcaaatagggcagcctcagagtgctctcaagcctctgcccagtggcaggggaagcaattctctctgtgcttctgcaggaagcgacagctgaggtttgagggaggcgccagcacaccacagatatcagattcctcagtaaacagaactcacatacacccctggtgggagtgaaaattaatacgaacaacttcggaaaacacacagtttggcagtatctaccaaagctaaacatacctatacctatatacctataggtataccctacatcctataacctacagacttcccctctggtgtaaccaacagatggatgttcatccaaagcaatacacgagaatagccatgcctgtgtatccacaatagcctcacactgggaggagagtggggaaaacaaaactgcgaggtactcacacaatggaaaattggaaaccagagctacttgcaacaagatgagtgaatctaaccgacatgttgaatgaaaaaagcaagaaataaaagggtcaattacatatgattctatttataaagctgaaagccaggaagaattcttttgtgacattagaagttaggatagcaggtgcccatgaggagtgtggtatgagtgactgggagaaggaggggcggggctcccggggatgctggagatgttttacttctgatctaagtgttggttccatgggtttgttcacctgtcaagagttactaggttcagtacttacaatgtgtgctttcttctctggctatgtctgagctaacacagaggattaatttttaaaaaatacacaaatctgtctggtcgtggtggctcatgcctgtaatcccagcactttgggaggccaaggtgggcagactgcctgaggtcaggagttggagaccagcctggctaacatcgtgaaaccccgtctctactaaaaatacaaagattagctgggcgtggtggtgggcacctgtaatcccagctacttgggaggctaaggcagggatatcacttcaacccaggagtgagaggttgctgtgggccggtatcaccccactgcactccagcctgggcaacagggagagactccgtctcaaaacaaaaacaaaaacaaataaaaaatacacagtagtccaggggagagtctgttgcttatgactgagtggacctcaaggcctgcctcagtttcccacagagagagaaggaccatggtcatgaggagaccttccagggatggtggaagcaaaagagaaagttgcattttgattttggttcctccgcctggaaagtgcgggtctcacacagggaaaaggtgggcttcttccaagactcagcctgagcatctccctctgctctcggggactgagtttccctcttcctgtgagtctctctgtgccctggtacccctgcagggtcactctacccagctgtcaccccctcagagcacaaactgctccctggcatcgggtggctgctcacaactgactctgaaattagtggaaggatgtaaaagtaaaaagttggatgcaaaagtgtcacctgggttaattcaactggattgtaaaggtttcaagaaggttttgtataatgctttttactttctgcattttaagatgctttgacatcttggggtctactaatccaggagagactgccctcccagggctagctaattccttcagataataagaaactcacctgcaagcccacttttcctatgcagaccaaccaatccacagcccacacctcgaactacacccttcatttaactctcacaactaagccactatttcccctgccctaaatcatcccagggccaggtaaggtactagacaactgggggctactcctacagccaacaggtcaaaccagccaattctcacctgggtcaaacgtgcctgcacattcttccccacaaaaaccacaataaaggatctggcccatgctgtcccctagatcaggggtccccaagccctgggccacagaccagtactggtccttgacctgttaggaactgggtctcacagcaggaggcaagcagtgggtgagcattattgcctgagctccgcctcctgtcagatcatcagcagcattatattctcataggagcgcgattcctattgtgaactgtgcatgcaagggatctaggttgcacgctccttataagaatctaatgcctgatgatctgaggtggaacagtttcatctgaaaccatccctgacctggaccctcccccagttcatggaaaaattgtcttccacaaaactggtccatggtgccaatatggttggggactgctgccctagatccctctgagcttctctgtgtggtcttgcctgggtagcatggcccttcctcttggaaactgcgagtaataaactcttctttcaaagcagtggtctctgtgtctggcatcccaccgtaatggactacaacaaatcccaggtaccttttaagataggcttgcaacttaaagatgatacagccttctctaactatctcttatcccaattcatctctttcctatgtatattttcaatagacacctgtgcttcaaatgcattaagatacgtcccagaatgcaatccatgggtatgaactgtgcaggtaccacatgttactcctaacacttaggatcagatgattaatagaaggggattgtctgtaaaatatgcagttattcaggttactacataataatggaaagagtaaaaaatcaaattatttcttcagtcttttactacgaagatttctgcattttgtttttgctactgctataaatgagggaggcctcatttgtcctatagtaaaatgatgaaaatctgcccatcatcccctctacgatgaagccagtggagagtcatggtgttctgtgaccgtggtgctgtgtggcagagtgcactcaaccacctctcagacacactcgatgtgtgccctgcagccctgaggctgctccacaagcccctcccagcatgacccagcccctgttccagtgacttcagatctatgtctcacttcacttcagaattctttaggacaaatcgttttcagaatatgggaaattactttcccttgtctgattgccctggctaggacttcagtagtgtgttgaagaggagtggtcagagtgggcatccttgtcttgttccagttctcagaggggatgctttcaacttttccccattcggtattatattggctgcgggtttgtcatagatggcttttattacagtgagatatgtcctttgtatcccgattttgccgagagttttaatcataaagggatgctggattttgttgaatgctttttctgcatctgttgagatgatcatgtgatttttgtatttaattctgtttatgtggtgtatcacatttattgacttgcatatgttaaaccatttctgcatccctggtatgaaacccacttggtcatggtggattatcttttgatatgttgttggatttggttagctaatattttgttaaggatttagcatctatgttcatcaagaatataggtctgtagttttcttttttggttatgtcctttcctggttttggtattagggtgatgctggcttcacagaatgaattagggagggtctcttctttctctatcttgtggaacagtttcaaaaggattggtaccaattcctttttgaatatctggtagaattctgctgtgaatccgtctggtcctggacttttttttgttggtaatttttaaattgtcatttcaatcttactgctggttactgttctgttcagggtatctaattcttcctgccttacgctaggagggttgtatttttccaggaatttatccgtctcttctaggttttctagtttatgtgtgtaaagttattcacagtagccttgaatgatcttttgtgtttcagtggtgtcagttgtaatacctcccccgtttcatttcttattgagcttatttgggttttctctcttgttttcttggttaatcttgctaatggtctatcaattttacttatcttttcaaagaaccggctttttgtttcatttatcttttgtatttttttgtttcaatttcatttagttctgctctcatcttggttatttcctttctttttctgggtttgttatttcctttcttttgctggttcttgtttctctagttccttgagatgtgaccctagagtgtcagtttgtgctctttcagtctttttgatgcaggcgtttagggctatgaacttgcctcttagcaccgcctttgctgtatcccagaggttttgacagtttgtgtcattattgtctttcagttcgaagaattttttaatttccatcttgatttcatttttgacccaatgctcattcaggagcaagttattctgtgcagaagctctttagtttaattagatcccatttgtcagttttggcttctgttgccattacttttggtgttttagatgtgaagtcctggcccatgcctatgtcctgaatagtattgtctaggttttcttctagggtttttatggttttaggtctaacatttaagtctttaatccatcttgaattagattttgtataaggtgtaaggaagggatccagtttcagctttctacatatggctagccagtttaccctgcaccatttattaaatagggaatcctttccccatttcttgtttttgtcaggtttgtcaaagatcagatggttgtagacgtgtggtattatttctgagggctctgttctgttccgttggtctacatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatattgattcttcttatccatgagcatggaatgttcttccatttgtttgtatctcttttatttctttgagcagtggtttgtagttgtccttgaagaggtccttcacatcccttgtaagttggattcctaggtattttattctctttgaagcaattgtgaatgggagttcactcatgatttggctctctgcttgtctgttattggtgtataagaatgcttgtatttttgcacattgattttgtatcctgagactttgctgaatttgcttatcagcttaaggagattttgggctgagatgatggggttttctagatatactatcacagcaaaagaaactaccatcagagtgaacaggcaacctacagaatgggagaaaatttttgcaatctactcatctgacaaagggctaatatccagaatctacaaagaactccaacaaatttacaagaaaaaaacaaccctatctaaaagtgggtgaggatatgaacagacacttctcaaaagaagacatttatgcagccaacagacacatgaaaaaatgctcaacatcactggccatcagagaaatgcaaatcaaaaccacaatgagataccatctcatgccagttagaatggcgatcattaaaaattcaggaaacaataggtgctggagaggatgtggagaaataggaacacttttacactgttggtgggactgtaaaccagttcaaccattgtggaagacagtgtggcaattcctcaaggatctagaactagaaataccatttgacccagccatcccattactgggtatatacccaaaggattataaatcatgctgctataaagacacatgcacacatatgtttactgcggcactattcacaatagcaaaggcttggaaccaaccccaatgtccaacaatgacagactggattaagaaaatgtggcacatatacaccatgcaatactatgcagccataaaaaaggatgaattcatgtcctttgtagggacatggatgaagctggaaaccatcatctcagcaaactatcgcaaggacaaaaaaacaaacaccgcatgttctcacatataggtaggaactgaacaatgagaacacttggacacaggaaggggaatatcacacaccagggcctgttgtggggtgggaggaggtgggagggatagcattaggagatatacctaatgtaaatgacgagttaatgggtgcagcacaccaacatggcacatgtatacatatgtaacaaaccagcacgttgtgcacatgtaccctagaacttaaagtataataataaaaaaaaaaaatgtaaaaaaaaaaggagcaagttatttaatttccatgtatttgcatggttttgaaggttccttttggagttgatttccagttttattgtactgtggtctaagtgcttgatacaattttaattttcttaaatttattgaggctcgttttatggcctatcgggctatcttggagaaagttccacttgctgttgaatagaatgtgtattctgtggttcttggatgaaatgttctgcatatatttgttaagtccatttgttccaaggtatagttcaaatccattgtttctttgctgactttttgtcttgatgaccttgtcttgtgctgtcagtagagtactgaagtccctcacgattactgtgttgctgtctatctcatttctttggtctgttagtaattgttttatgaattttggagctccagtgttaggtgcatatatgtttaggactgtgatattttccggttggacaaggccttttatcatttgtgatgattaataccaagtgtcaacttgattgaattgaaggatacaaagtattgatcctgagtgtgtctgtgagggtgttgccaaaggagattagcatttgagtcagtgggctgggaaaggcagacccaccctcaacctgggtgggaacactctaatcagctgctagtgcagataagactataagcaggcagaaaaatgtgaaaaggagagactggcctagcctcccagcctacatctttctcccatgctggatgcttcctgccctcaaacattggactccaagttcttcagttttggaacttggactggctctccttgctcctcagcctgcagacagcctattgtgagaccttgtaataatgtgaattaataataaactcaaatatatataatatatatatatatatatattccattagttctgtccctctagagaacctagactaacacaccattatacaaatgtcccactttgtctcttttaactgctgctgctttaaagtttgttttgtctgatataagaatagctacccctgctcccttttggtgtcaatttgcgtgaaatgcctttttccacctctttaagtttatgtgagtccttatgtgttgggtgagtctcctgaaggcagcagatggttgttgagttctgatgctcctgaagcatggagttctgagtttcctgagggcagcagtgggttggtgagttcttatctattctgtggttctgtatcttttaaggggagcatttaggctatttacattcaatgttagtattgagatgtgaggtaccattgcattcattgtgctatttgttgcctgagtactttggtttttttgtttttgctttttaacttgtatttttgttttataggtcctgtgtgatttatgctttaaagaggttctgttttgatgtgtttccaagatttgtttcaagatttagagctccttttagcagttcttgtaatggtggcttggcagtggcgaattctctcagcatttgtttgtctgaaaaagatggtatctttccttcatatatgctgcttagtttcactggatacaaaattcttggctgataattgttttgtttcaagaggctgaagatagggccctgatccgttttagcttgtagggtttctgctgagaaatctgctgttaatctgataggttttcatttataggttacctagtgcttctgtgtcacagctcttaagattctttcctttgtctaactttggataacctgatgacaatgtacctaggtgatgatctttttgtgatggatttcccaggtgttctttgtgtttcttgtacttggatatctaggtctctagcaaggctggggaaaattttctctattactcccccaaatatgttttccaagcttttagaattctcttctttctcagggacactgatcattcttagggttggtcattttgttacacccgagcgagttccatggtttgcaaacatttaaaaatgaacttatgtttctaaacattctgtagctttcttcttcctattgactcattagcaatatttgttttttcctgattataaaagtaacaaatactcaatgtagacattttataaaacatacaaaagtaaaaagatgtaaattaaaatcatccataataaaaatggcttaatactgtgaaccattgtttaaaaaaaagaaaagaaaagaaaagaaaaacaccacactttgagacaaattaagagtcctttatttaagccggcggccaagagagggattgacgctccaaaattctctcagccccaaagaaggggctcgatttaacttttatatcttggtttaggaagggggggtctagttaaaacaattttacagaagtaaagtaggcaaaagttaaaaggataaatggttacaggcaagtaaacagttctaggtgcaggggctttaagacaattacaaggtgataggcccggggcttggggcgttatcaatcagaggaattcctaggaattgtggatacagcttgccacagtatcttatcagttaattgcattcttggatgtgctgggagtcagcttgcagaagttaagtccttgaggaaggggctgccagtgaaagagccaagatagaatctgtctggttctcttagctaaggaagagtccattcagatggaaacaaggctaggtgattaaaggaaaaagggagagtctaaaaacatggttagtaaaaacgaggttgggcattacaatttaacatagtcccagacttcttggaggcttcgttcatattttttcttttttctttatctttgttggattgggttaatttgaagaccttgtcttcaagctctgaatttctttcttctacttgttgaattctattcctgagactttccagagcactttgcatttctataagtgtgtccagtgtttcctgaattttttattgttttttccttatgctgtctatttccatgaatatttctcccttcacttcttgtatcatttttggatttccttgcattgggctttgcctttctctggtgcctccctgatttgtttaataactaacctcctgaattctttttcaggtagatcagggacttcttggtttggatccattgttggtaaactagtgtgattttttgggggtgttaaagttttgtcatattaccagggttggttttctgattccttctcatttgggtaggctctgtcagagggaaggtctagggctgaaggctgttgttcagattctttttttcccatggggtgttcccttggtgtggtaatctccctctttgcctatggatgtggcttcctatgagcggaactgcagtgattgttgtctgtcttctgggtctggccacccagcaagttctatcaggctccaggctggtactcagggtggtctgcacagagtcctgtgatgtgaaccgtcaatgggtctctcagcgtggatatcagtgcctgttccggtagaggtggcagcggggtgcaatggactatgtgagggttcttagctttggtggtttaatgctctatttttgtgctggttggcctcctgacgggaggtggcactttccagaaagcattggctgtggtgggtgtggagaggaacctacggtgggcagggccctagaactcctaagagtatatgccctttgtcttcataccccacgctcatggatgggtagaatcaatattgtgaaaacgatcatacggccaaaagcaatctacaaattcaatgcaatccccatcaaaataccaccaccattcttcataggattagaaaaaacaattctaaaattcatacaaaaccaaaaaagagcccaggtagccaaagcaagactaagcaaaaagaacaaatctggagtcatcacattacctgttttcaaactatactataaagccacagtcaccaaaacagcataatactggtataaaaataggcacacagaccaatggaatagaatagagaacccagaaataagcccaaatatttacagccaactgatcttcgacaaagcaaacaaaaacataaagtggggaaaggacaccctcttcaataaatggtgttgggataactggctagccacatgtaggagaatgaaactggatcctcatctctcaacttacacaaaagtcaactcaagatggattaaagacttaaatctaagacctgaaactataaaaattatagaagataactttggagaaacccttctagatgttggcttaggcaaggatttcatgaccaggaacccaaaaacaaatgcaataaaaacaaagatagtcgggacttcaactaaagagcttttgcatggccaaaggaacagttatcagagtaaacagacaacccacagggtggcagaacatcttcacaatctatacatctgacaaagaactaatttccagaatctacaatgaactcaaacaaatcagtaagaaaaaaaaaacaaacaatcccatcaaaaagtgggctaaggacatgaatagagaattctcaaaagaagatatacaaatggccaagaaacatatgaaaaaatgctcaacatcattagtcatcaggaaaaggcaaatcaaaaccataatgcaataccatcttactcctgcaagaatggccataatcaaaaaatcaaaaaatcaaaaaatagtagatgttgccgtggatgcagtaaacagggaacacttctatgctgctggtgggaatgtaaactaatgcaatcactatggaaaacagtgtggagcttccttaaagaagtaaaatagaactaccatttgatccagcaatcccactactggttatctatgcagaggaaaagaagtgattatatgaaaaggatacttcacacgcatgtttatagcagcacagttcgcaattgcaaaactgtggaaacaatccaaatgcccatcagtcaatgagtgtacaaaggaactgtggtgcataaatatatatatatatatatatatatatatatatatatatatatatatatatgatggaatactactcagccataaaaaggaatgaattaatggcatttgcagtgacctggatgagattggagactactattctaagtgaagtaaatcaagaatggaaaaccaaacatcgtatgttctcactaatatgtgggagctaagctatgaggatgcaaaggtgtaagagtaatacaatggactgtgggtacttgaggggaaaagtaggaagggggtgagggataaaggactacaaataggatgcagttatgctgctctggtgatgggtgcaccaaaatctcacaagtcaccactaaagatcctacgcatgcaaccaaataccacctgttcgccaataacttatggaaaaataaaaaataaaaataaaaaagaaaattggaaattaaagctttaagtagagaggcgagacagtaggccagaagtcgctgtgcttaatggcagcagccctggccacctgcctgatttctagggcttatttgaggctgtgggctggggagacccgctgggctggctcaggggtctgcgtgggctggctccagtgcccagcctagaaccttcagggacttggcctacgcaaagcctggcctactagttttcatttagcgcatgtgaattcagagaaaccaggatcagaaaggttcctattaggtctgttatgattctgtccaagctcattagaatttaaatttttacctttaaacgcacgttatttttggctctgcattgcatttattattatattttatgcaaagaagcctggcctttatgaccgatcagtatttgtgatttttcacttttcatgcaattaaagcccattagaacacagccacgtggcacaggaaatgcactcatgtggctgaggaaggagaggagctgccgcattctttgtttctaattgtgctttatctgctaattgcgtttctacctgctccacaggaacggtgggaaacttacatcgaaaaatatatatctaaaggaatttagaactcctttaaaatctcaaatctgatgagaatctagggttttctttggtgcatgaacgtgtatacacaaaacatttaggaaaaagttatttaattccagaaaatagaacctttattatataaattatacaattaagtcttataacattcgttgaccttttagggaaaaaaaaaaactacctgcttttcatttctagcatcagatatttcacctttattttggtcttcatttcgtcatattccgtttgctaattcatctcttgctctgcaacagatgttcaaattatttgtgaaatagtagatctgagtcacaggcttttaatttttcatttcatgtgtgccatcgtgaagagggagagagagacaggatgagaataaatctgaggactgtgggaatctgcgatgccagttggaactcctgccaagaaggaaattgtcaagtgagagcaccaagccagaatctggagttctctttgaaagcatgtcttcctaggacacagcaaccgttcctacagccctgggaatttttacaccaccttttaatgcaaatgacactttttttttttttttgagacggagtctagctctgtcgcccaggctgcagtgcagtggcacaatcttggctcactgcaacctctgcctcctgggttcaagtgattctcctgcctcagcctcccaagtagctgggattataggtgcccaccaccacgcccagctaatttttgtatttttagtagagacagggtttcactgtgttggccaggctggtctcgaactcctgacctcatgatctgcccacctcggcctctcaaagtgctgggattacaagtgtgagccaccacgaccgacactttcaaggacagcttagcttgctgagttagtaacgttcacacaagcctcctcttgaacaggaaaataagactggcactcctgaggcactcttatcacacgagagacatggaataagttagagattcctcctccctgtcttgccttcgtctccttctgaggctcttctgttaataatgtagacttgcacttttaggcccgactcagaaatttcattaattagcacggtcatcaaagtagagctccactttgctgacagaaagggagaaagggctaaagagaatcgtgctgggtaacaggaaaataaggaacactgcacgattttccaccacagagacccaagcaagaatgttcgcagcagcagtgcttggaataacaaaagattggaaagaatcgacatgaggttctgtcaagttaacttgggaaaacagtgtttcaaaaacattaaattaggagctctcctgcatgacttctccaacttgtaacatttcagtgtgtgttgttgtcagaggtgtttgaaccagagtaactccatcttggataggggctgggtaaaataaggctgagacctactgggctgcattcccagatggttaggcattctaatgaggtaggaggtcagcacaagatacaggtcataaagaccttgctgataaaacagtttgcagtaaagaagctggccaaatcccatcaaaaccaagatggtgacaagagtgatctctgggtcatcctcactgctacactcccatcagcgccatgagtttacaaatcccatgacaatgtcaggaagttaccctatatggtcaaaaagaaaaggcatgaataatcctccccttgtttagcatatcatcacgaaattaccatgaaaatgggcaaccagcatcccttagggctgctctgcctatggagagccattctttattcctttacttaataaactttcactttactctatgggctcgcctctaattctttcttgcgcaagatccaatagccctctcttggggtctggattgggaccccttttcggtaacactgtcaccctccaagaagagaggctgagcatgctgagtggaccacgttttcctcctcctcttccttcttacatttaaaataacacccatttgcatctcccgtcactcatgctcaggagaatgtgctgtgagaagtgcagaatgagatgttcaggagaggttcaggggcctgcttcagtctccagacattccagcttccgagggggccctgcagggccaccagctccctcacgctcaccccactaggaattactctatttacagacaaaaatgcctgccagttggtatttgtcctttcctagaacataccataaatacaaagcaataaagaataacgtttttatgagtttaagtttttgtctggtctctaatccagcagaatagcatgtgatacaatctcatgactttcagagctatacaggagaaaactgctcatagcagtgtcgtgtgtttccaggcaaaactgaaaacatgaatacagcactggacacctggtcagtccttaacaaattactctccgttgctcaacttcaatgacaagaacaaatcaaacaaagaagctgggcagggctgctgctgactggtcacctgacggccaatggacagtgacttttaaagtttactttcttttattcttgggggagatcatatagtatttgagggtatagttggggaacaccacattaaaaaatcgcaattcttagcttctcttgaaaagtttcgagttccaggttcactaggccgtgggtggcagccgctccctccagacaagtcctcctggttctgggctggagagagtttgtctggcttggctcccggcagcctctgggattctgtttcttcctctctgcaaagaaaggtgcccagctccaatggctctctatcttccatgtggggacacctcttctgctgtcatatctgcacctgtgagcctgttccttcgtagacatgctagcggggagtccagtggacacagacacacatacatgggttgactcagctacgtgtaactggatatcagtttagccactaataccccctaaaaatgagctataaatccgagaaacagttcggatggtcttttttcccactggagaccacacttcttgcagacactaaagccctgctaaacacaatgcgggcccagtagaactcctgtagtggcgctcctggccagggtgggggtggagggaatggaaaggtagccagagaggctggttctggagcccctgcgcctgcagccctttccccagtccctgcaacaggaaggcctcatccttctacactgcaggtatcccagcagacgaaaagcaggcactctctggagagggctcagctgacagaggactgacagacgtcccagtgcacatgaagtaaagtctgaagcttgcccgcccccagctcgcgcccagctctgcctgtgaacacagatagctccacctctgtactcagaagtgtgtccagaattgatgggttcttggtcgcactgacttccagaacgaagccgtggaccctcacactgagtgttacagttcttaaagacaccgtgtccagactttgttccttctggtgttcggatgcgttcacagtttcttccttctggtgggttcgtggtctcgctggctcagcagtgaagctacagaccttcgtggtgagtgttacagctctcaaatcggcgcgtctggagttgttcgttcctcccggtgggttcgtggtctcactggcttcaggagtgaagctgcagaccttcgcagtgagtgttacaggtgataaaggcagtttggacccaaagagtgagcagcagcaacttattgcaaacattgaaagaacaaagcttccacacttgtggaagggaactgcgccgggttgccactgctggctcgggcagcccgcttttagtcttatttggccccacccacatcctgctgattggtccattttacagagagccgattggtctgttttacagagagctgattggtccgctttgacaggatgctgattggtgcatttacaatccctgagctagacacaaaagttctccacctcctcactagattagctagatacagagtgtccactggtgtatttacaaaccctgagctagacacagggtgttgattggtgtatttacaatcccttagctagacataaaggttctccaagtccccaccagactcaggagcccagctggcttcacccagtggatccggcaccgggccgcaggtggagctgcctgccagtcccctgctgggcacccacactccttagcccttgggtggtccatgggactgggcaccgtggagcagggggcggtgcacactggggaggctcccgcagcacaggagcccacggaagttggggaggctcaggcatggcgggctgcaggtccggagccctgccccgcgggaaggcagctaaggcctggtgagaaactgagcacagcagctactggcccacatgctaagcccctcactgcccgggccggcgggctggccggccgctctgagtgcggggccgctgagcccatgcccacccagaactcacgctggcccgcaagcaccaggcacagccccggttcctgctcacgcctctccctccacacctccctgcaagctaagggaacaggctccagccttggccagcccagaaaggggctcccacagtgcagcagcgggctgaagggctcctcaagcacagccagagtgggcaccaaggccgaggaggcgcccagagccagagagggctgtgagggctgccagcatgctgtcacctctcagaagcaggagaagtcccgcccaagagaaaacaaaaactatacacactgactttcggggatctcccaagaaatgctagatgattagatgatccacccgagtccatatagctgtgacagatgatgaaccttgaagatcttgttgcattttggtggggaactgtgggaatcgggcagggaatcactttcacccgcagcttaccaggacctatctacagggatgacaaaagcatcccctaacaggtggctggagacctgaggctcaccaagtgccccagtcatgaaatcacagaaaaaaactaccagaggccagtgcattgctctccctgcctggcaggtgcaaagtcagtggagagaagtagtatcacggtcgagcatgcggtgagaacaacgcccacggaaccgggggacacatggcaagggctgaagctgcaagttctgagcacgtcagcccctgcgcctcacccccaccttcctgttctccaaactgaaatgagcctccgggccttgtccccaaccacttccctgcatcctttaggcctcggcttgcaggccaggtgctcagagaggtattggccacgtccaccacacctccccacgtctttcctcggaggacttcctgttgtctgaaactgtccaccgcagctccccgtgtctttccttggagcacttcctgttgtctgacactgtccaccacagccccccacgtctttctttggagcccgagctgctcaccagaagggagcggagccaggatttggcttgtctccaggacttgtcttgacactgccgtgttcctagcactcagaacatgccggacacggggcgctccctctgtaaaatgtattaatccactgaatcaaagaatgactgaatgtacaccatggacagatagatatttctatggaaccactgttaccttaaaacataccaatttttattttgctgggaatgtttactttgctaggaaagtttactttgctaggaaactttgggggtttggaatcaactttcaaattgcagcttttgcatggaatctctttatctataataatagcaaattcacatgaagaagaatgaaaacagaatgatgttcctacaaacggaaaaattctgggccatcatgacaacgcacaaatagctgtcaaatgctaaatttctcatgaagccaagagaggccaaaactatccctgacctgtgattagtacaataaaggctgtgcctttgggcaacaatgggaacagagatgaagacttcaagccagacagtccagcagccccagcctaaggctatgttctcctgtaatttattactcaggatgaggaagctaaatcagggttgccctggttactatggggctcttccgaggaccctggcgacataattggtgttggcttggagactgaggctttcaattctgagattagagtgctggtaatagaggtggctaccccctcaagaagaaattcaaacaggctttggaaaaaatgagatagtctcaaaattaaggtcctcctccaaaatgtgccactgactgtcttaacctgtggtcctgacagattcagcaacaatacataattggctcattcaaataataattgccttttaaaaatagtaacaaacagaatcatgaaacgcttaaccagatgatgtcagctaactgaactaggttgtcacacacagagagagcagcgtctgctgtgaatatcctgctcagatcacccttcggcagacatttcccgagttactgccacagccccgtgctggacactcagaggaggaagaactctggggatagcggcttggaggactggctggagggggaatgacatgggatgtggcccaagaaacagattttccaaagagaaagggacagtaatacagagaacaggcaggaagagggagataggactggaatatagttcattaaaatggaattcagccaggggcccttctcaggcacccagaaccctcatggctctgccaccaggctgagaatagcaaacaaaggtgatcgggtcccagaaatctgaaacacgtttttgagcatctggggatctgtgccctgtgtttgcaggctggtcttaaaggcgcctggagtttacagggggcggtgagcaaggcaggaaaagcggaggagcggcctgcatatttagggtgcaagggtctgcgatgtcaccctcacacctacacccacagtccataagggtcatcaggctcatcagctgggtggtcgctgcaggccagaaagggctgggaggacaaagcacagaacagggatgcccacccctcctgctgtcatgaggctaaatctgcttcccccacacccagccgccaccagggagagaaggagaagacggaaggaaagaggataggaggggctgaataccttctggaaagagacaaagttaatcctggggagactgttttaaactggtaaagggggaaccactctgcagtggtaagagttgaattcaatttttctaaatcagtggccacagaagtaactcacttctacatgccaagtagaaatcagttacagaaaatgaagaacacatttctgcagttctgagccaagatatgagaattttaatcacaccacatataacagaagtcaacaggattgagactaaacatctctcataaacataagtagacaaaacttgccgatgagaaaaaaaaaagaaacttgaaaacatgatgctaagtgaaagatgccagacacaaaaggacaaacactgtgccgggcatggtggctcacacctgtaatcccaacactttgggaggctgaggcgggtggatcagtttgagaccagcctggccaacattgtgaaaccccgtctctactaaaaatacaaaaattagctgggcatggtggcgggcgcctgtaatcccagctactcaggaggctgaggcaggagaatcgcttgaactagagaggtggaggttgcagtgagccaagatcacgccactgcactctagcctgggcaacacagcaagactccgtctcaaacaaaaacaaaaacaaaaacaaaacaaaacaaaatactgtatgcttccacttacatgagtgacctagaatgggataaattcatagagacagaaagtagaatattggttatcaggggctggggaagcagagaaatgaaaagttattgtttgatgggtataaagtttctattagggatgatgaaaaagttctggaaatggatgttggtcatggtttcacacaatgtgaatgtacttaatgccactgaattgcacacttaacatggttaatttagtaaactttatactgtgtatattttaccataaccaaaaagaaaaaggactctcactttcataagtagaataatatactgtttaattattaatttagaagcccaatcaaaaaaggaaaaaaagtcaaaaggtacaaattatcagtgagataacagaccttgcacacagaggaacttaacatattagaaatgtacaaaaatattgtaaaatatttactaaataatactatgaactattttatgctcatgacttaaatgatgattcaaagcccaaatagatcacaaatgtaaaaaaatgcaaaaattgccaaataactatatccttagctatcatcagtctgacagtttaattggtgaatcttttcttttcttttttaaattaaaaaatttttattaggaacatttttgtccttggtaatacttccgaataaagaaatctatgaaaatgctatggaaaattaaattaaacaacatataaaatcacctgggcacctggaagatggtgaagaaatattttgtgacataaatataaaactgaactatcaatttttaaaaagctttagtgtttcgttaaaagtatgaaaaagaaatttaaaatatgcttaaataatcattagagatatattcagaaaggaaacttattaaatgtactacttttttcattctccatggtaaaactgagaatgagaatcttggtaaaggttaaaattttgaaataatagcgtatctggggacatcaactattccttacatcttgaacacacaatctttctatttacactgtaaacatgctcagttttgaacctaccaccccctatacctgacattatctttgctctatctttcaattcttaattgagcttatggaaagagacataccaatgtctctacctttttttccccaaacctttctcctcaaaccactactatctggtttctgcttccactacatcatatctgaaactaaaatgtcaaagcaatcacgttgccaaatgtgaaaaaggatttcccagaccttttgggagttggtatcattgcttcacatggcattactaacctgtcccttcttgtacttgttttctcctggctttggatatggcattctttctgccctgcatacttctctatcattcctgtttggtctcattagctagatccttttctctacttgctcctgtagtgcagactctgctcttctcattttatcctctttttctagacaatctcatccactcccatggtttcagttgctatctataaactatctttatctctatctcagaccactttggtgacttccagcatcatacagccatccaaccatctgtgagatttctccatgtggatatccaaagacacttcaaacttaacattaaaaaaaaaatctcacataccttcttctcccctcaaatcagctgttcctcctaaaatctctaccttggctgatggttcattatcaccctgtcaagacacctggatatcatactctcattcatttctaacttagtctcaaagtcccatgaattcaacctttcaactatttttaaaatctgtccattcccacttctcaccactattgccttaggttggatccttcataatctcttaggtggactatagcaatggcctcttagatgttcttggcgtttccaatcttatttcttccaatcaatcatttataatgttgccaaaatgatctttccaatacgtaaatctgatcacatttctcccaagctgaagtaatccctacagctcttaaataattagttgcttaaagaattcatttactcactcatttaacaaatattatttaccacataacgtatgattttaggcagagaggaaattatagtaaatgaaaatatttagagaatatgcagaaaggtagatattaaacaatcccctaaataaatgtatgattacaaatttgacaaatgcaatgaagaaaaataataagtcacaaaggaagaaaaagaggagacctactagagattgtgaagttatattatttttgagagaataatatctcggtaagtttaaaaaatgagtagaagtcgctcaacaaagaagtagttttggtagagggaacagcacgtacaagggatctgaaagggaaaggagattagagtgttaaaagaaatgaaggtaagcctatttggcaagagcttagtgaaggatgggatagtggcctgagacaagattattgacatagaaaccaagtcatgtagggtttgtaagccaaggtatggatttgggttcttttgaaaggctatgggaagcaattaaaaagttttaggcagatgaatcacatggttatatttacatcttaaagtttcactctggctgctggtagagaatagattatagcctgagtggatgtgagaagactagtaaagggattattccattagtctaggagagaaaaatggtggtgggcagtctctattaacttttagaagttatctttaggtaatgtgagcctgcaacgtgaagttcctagtactttaaaagttataatgctgatgaacaaaaaggtatgtaaaaactcaggatttaatctaattagatacattttccaccattagaacatttctgctcagagatcttattacaaagctacatttctgatagtctactacgatgcagcttctgccaaagccactcagtactaacctcttacacagcatctctacttacatgattaaaatgcatatcatacttgacatagtcaaaagataaagaaccacttgatttctacttccaagctactcaactccctagtaaatggccttaccatttaccctacccaggcactgatgtaaaaaatctgagagttaatcataatttttctcttcctctcatatcccatatcatatgtaaattaagtatcaacttaaattgaatataatattcaatgtaatgctatgaaaattattgtatgtgattaatgagaatataaatctggctataaaatctctgatagtgatatagtatttatatccatatatccttaggaaaaaattccctttaattatagagtagttataaacagtagtctaatatagtatgctatagttgtgttttgccttaattattcttcattgttaatacctctataataaacatataaaataaaacgcttaatttcttagtttgcaaattaatttaccaattcgttcattctttctttgtcaagaatggaaaaccttatagcaatacaggtcatctcaggtccataaagagtaatttaagatcagaaattcatgtcaggtccatgaggaataagttttcttttcttttctttcttttttttttttttgagacggagtctcactctgctgcccaggccggagtgagtggcgcaatcttggctcacagtaacctccgcctcccaggttcaagcgattctcccgcttcagcctcctgagtagctgggattacaggcgtgggccaccacgtctggctaatttttgtgtttactagtagagatggggtttcgccatgttgtccaggctggtctcgaacccctgacctcaggtgatctgcctgcctcagtctccaaaagtgctgggattacaggtgtgagccaccgctcctggccccataaggaataatttaagatcagaagtacaaagaaagttttctaattgattttaaaattagtttctgaatatttctctaagactatagtttaaattcgatctatttcacaccaaataagtactacagcaatatttaatttctgcgttactattgacatatgagtcatctaacatgtaaactttcagccaaccaaatattatggctttagtgctaatttaaaaaaaagtttttgaaaggaacatttgtaaaatatataaaggcattcatctgccttctttttttttttaaagagatggggggtctcattttttttaaagagatggggggtctcactctgtcacccacactggagtgcagtggtacaatcatagctcactggagccttgaactcctgggctcaagcaatcctcctgcctcagccttcttagtagctgggactacaggtatgcaccaccacacccgcctaattaaattgtttgtttgtttgtttgtttgtttaagagacagggtctcgctatattgaccaggctggtctcaaacttctgggctcaagcgatcctcctgccccagcttcccaagtagctgggattacaggcggtgtgccaccacgtccagctatctgcttttttaaatagaggaagtgaatatcatgttaagttattcttaaagacttaactaagattacttatcatactttgtcacaatatatttaaaatacttcattaaattctgaggtgagatagtaaaccatttgtgctaaccctaaatagcctttttagtttttgaatagtcttcctatctccaaccttttcagatgtcccttcatgtcagaatgtcttcctctgctaatccttctctgtgctgtatttgatctgctagtaataaagcttgataaacaagtaatctgtttatttcatcaggctctattcaaggcttggagattgactctataactttcccacattgaaaagtgcaagtggaagtgggagcttctgattgatagcttttgagcttacctccgggtttgtaactgtattctttagttaaagctatcaggaatttggctaccagataagtgagacataaaaccaagtatcattactaaagcaatctagtgatacagaatattactgtgtttaaataacttatcctacataaacaacaaggtagtgttaacctcacactcacaattctgcatgattttatgacagatatctaggatttaaaaaatggatatagcttatatccattataattttgttatactgagagagttcaaagttggcatcaagggtcaaaggtagaaattagcttacatagaaaataatttgtataggccaaacagaccttttgtatacaataccacctactgtaatttagtccacaaaatactgactataagaccataatcaaaatgaaatgctatgaaaggtgtgcgagagcttagtttatgcactgtaataaagctatggatggatgggcatagcgcatctcctgttgcacgcactctgttgctcatcaagttacatggatctgagctgtttgttaaccacagaagaaggtgaatcagtctgatgatgtgtgtggtgtccagatgcctcaacagactgcctttgttcactgtctggcgaagattaaaaaggagtagaatgagggctttctgtgggagatgatgtcaaatgagcctgagctgacattgtagaggatgtagatggctgaagaaactgttcagctggagtatctacttccattgcagtttcactcacttccaaatcaggacttgatgggaccataggaagagttgaaatatctgattgacttgttccacctctgggtcaagatcttcctcatcctctattgctttgtgcaacctcacttgcttcttcgaaccgtcttgataacatatcagacattctctgcatcaatgacacattgggactctgctctccatgtcattctcgttcactctcaggccttgatctgggtccagtatctgaccaatcaccacgaaggctcaaacgcttaactggtggttgtcgtaactcttctcttctctcttccgcagaaggagttttaagttctcgtgctgtatcatctttcgggtcaaaaagatatatgtaatctgaagagtaactaatgagaatctcttgaccatcttcactgtaacacagaaatgtcactctgcaggacttattattaagatgggaagcaataaaatgggcaaccattccagtagtccctcgacctgcataattccctgtagctcttgtgcccagcattcgcctatcatatatttgtactgagctataagaacaaccaacggcaaggtaatatggtattggtgggcaaatagcaacagatgtggcagcacgtcgacagctaattaaaatatcatcttcacaatcttcttttgtgcagctagttttgatgcgtgtatcaaaccacctaccagttctatcttcaccacaagagagaaaagtgtaagggtcattgggtacagtcataatctcataagtagttccattgtggcaagtaaattggcattgtctgttggtttctgcatcttgctcaacattggtataaaatattactccatctccagagcaggatacaatctgtttatcatttgtgcaaggtaagaactttgcattagatatgtttgcttggtgccccgaacgaattgttgtcaaaacctttctgctgtagggattactaattactaatttggtgtcatctgagccagataaaatatattctccagtgtcattccaacagattgtattaacacagccatcatgcacatttagggttgcttgaagtttcaatctttagataaattctcttcttcccaggtagtggccccacagccaggacaggtcctccagcccgagggaccttttcctcatgtcccacaacagatgtgggcaggagccaccccgagacatggctctgcctgagcgaggtgggaggggagaccctacctgaatcttttcaaagtgtcataaaacagatagttctatagtcttgatatcattatagaacatttaaaaaaataaggaaagcttctgttttccaaaagcacttaataatgattggtcctgtttacaggttgtgatattttgtatactccttcttttacctttttttgctgtaagatatctgcgtggttgccttctattgtcttttcatcttgcttgtccttaacatgaaagtcctggccacaccttagcttttctttgctaccttaaagagagtctctaaacatgtgaaaattaaacaccacagttctaaataattcatggatcaaagagaaagcctcaaagaaaaaatcaagagaactgaatggacacaaaacatatcaaaatatgtggagtgcagctaaagcaatactgagagggaaatttatagcactagatgcttacataagaaacaaggaaagctcttaaaacagtaagctaattcctacctcaggaaactagataaagaagagcggctgggcgtgttagctcacgcctgtaaacccagcactttgggaggccaaggtgggtggatcacgaggtcaggaattcaagaccagcatggccaagatggtgaaaccctgtctctaccaaaaatacaaacattagctgggcatggtggcgggtgcctgtaataccagctacttgggaggctgaggcaaaaaactgcttgaacccgtgaggcagaggttgcagtgagccgagattgagccactgcactccagcctgggcgacagagtgagactccatctcaaaaaaaacaaaacaaaacaaaaaaaaacccaaagcaaacagaagaaaagaaatcataaagacaaaagtacaaatcaatgaaataaaaaacagaaaaacaattgatatgaaaacttttaacaggagttggtactttaataagatcaacaacactgacagaagtttagcaagaaaaatgctagaaaacaaaaattatcaatatctggaatgaaacaaaaatataactacagaccctgcagacatccaaaggataataaaggagtaatatgaacaactcttcacaagtaaatttcacaacttagataaaatgcatcaattccttgaaaaacacaaactaccataattcacataatatgaaacagataatttgaatagccctgtaaccattaaggaaattgggaagccaggcacaatggctcattcctgtaatcctagcacttttggaggctgagatgggaggatcgctggattccaggagttcaagaccagcctgggcaacatagtgagacttctctctataaaacataaaaaaaaaaagtagccaggcattatggcatgcacctgtagtcctacctactcaggaggctgaggcaggaggattgcttgagctcaggagttcaaggttgcattgagctatgattgtgccactgcactctactctgggtgacagagcaagatcctgtctcaaaaatttaaaataaaaaaagagaaattgaattcatagcattaaaattctccaaaataaaacctccaggcctagatagtttcactggagaattctaccaaatgcctaaagaataattaacatcaattctacataatcccttccagaaactagaagtgaagacttcacaacacattttctgaagctagtattactctgatactgaaaccagacaaagatagttgaaataaaaaaaagaaggaaggaaggaaggaaagaagggaggaaaaaagaaaagaaaaacaaccataaaccaatacctctcgtgaacttagagcaaaaaatccacaataaaatatgtacaaaccaaatccaacaatgtgtaaagattactacatgccatggccaagtgatatttgttttaggtatataaaactgattaacatttgaaaatcaatgaaatccaccagatcaacaagccaaagaagaaaaattacatgattatattaattgacaaggaagaagcttttgacaaaatgaaatgtgttttgcccattttctaattggcttgtttttcactgttgaattttgaaagttcttcatatattttagatactagtcctttggcatacatgtggctcactaatattttctccctgtctgtagcttgtcttttcaacctcttcaggtggattttcggagacctggtttttaatttttcttaacattttccttttataggtgatgattttggagtcaagtctcagaattctttgcctagcactagataccaacattttttctcctatgttttttctaaaagttttgtagttttgcattttatatttaatcccattaggttggtttttataaaagggatgaggtttaggttgaggttcactgttttgcctatgattgatgagcacatgaaaagatgcttggaatcattagtaatcagggaaatgcaattcaaaaccatcatgagatactactttgtacccactaggatggcttaaaacaaagtcagaaaagaaacgttggcaaggatgtagagaaactggaaccctcacgcgttgctgctggaaatgtacaatggtgcagctgctccgtaaaatggtctggcactttcttaaatgattcaactagagttaccaagtaacctggcaattctattccgaggtattaggttgacgcaaaagcaattgtggtttttgccattaaaagtgatatacccaagagaaatgaaaatatatgcacataaaaacttgtatataaatgtttatagcagcactgttcataatagccaaaaggtggaaacaacccaaatgtccactgatggatgagcggataaacaaaatgtgcttaatccacactatggaatattattcagacataaaaaagaatgaagtactgatacatgctgcaatatgtatgaaccttgaaaacattatgctaagaaagaagccagtcataaaagactacatattatgtgattccattcatatgaaagtccagaacagggaaatttataaagacagaaagtagactagtggtagcccagggatgggggcaaggaaggagagtgagagctaaaggtacagggttgctttttaaggtgaaattgacttcaatgatgtttacatacatctgtggatatattagaaaccactgaatattataccttaaatgggtgaattatatgatacatgagtgtattagtctggagctaggcgcggtagctcacgcctgtaatcccagcactttgggaggccgaggtgggcagatcacaaggtcagaagattgagaccatcctggctaacacagtgaaatcccatctctactaaaaaaaaatacaaaaaattattcagcttggtgggacgtgcctgtagtcccagctactcgggaggctgaggcaggagaatcgcttgaacctggaaggcggaggttgcaatgagccaagatcatgccactgcagtccagcctgggtgacagagtgagactccatctcagaaaaaaaaaaagaggtttaattggctcacagttccacaggctatacaagaagcatggcagcatctgctgccggggaggcctcagggagcttccaatcatggcagaaggtgaagggaagcaggcacgtcttacatggccagagcaggagccagacagagaggagcgaggtgctacacacttttaaacaactagatctcatgagaattcactatcatgatgacagctccaagaagcatggtgttaaaccatgagaaaccaccccatgatccaatcacctcccaccaggccccatctccaacactggggattacaattgaatatgagattcgggtggggacatatatccaaaccacatcaatgacttacatgtcaataaagagatataaaattgttttgttttttgaaaaaaatctaatattttaataagccactctctcaagccaatacaaggcagctccagcacacccctgcttcaggagatgtttatgccacatgaagggaggaaaccataatcctttccacatccctcaggtagacgtggaaataaggataaggtgaaaattacaaaaaccaagctcatcatgcctccttcccttgccaccaaatgcttgtatttctttttaacacctgttccccgggttgtataaaaagtcctttgctaattacttttaggaaaagggcgacattctggccttcacctcccagaaaccacgcatcatacttgaggcacacaccagggaagaggctgaggtcaagttcaccaatcagaaacacaaacagacaaggaaaaagaaggcagcaatcagtttccatcaaagccctcagccaggtgtcagatctcccagggacacccctctttaatttgggggggacataggtaaatatgtgtatccagaaagcctggagcaagtcgagagaggcatttgattagtatgcagatcacaggcacagctgggatcagggctaaccagactttcaaggataaacagctgacaaggatatgtcatgttgtccctgcagtgtgttgaatctaattaaaaaggacttagggtcagaaaaacactggtgtaataatgggtaagcacaacagaaatcattttattgtttacttacaggaaacaatacttttcccgtttacatgcttgacgtggccagcaaggaagagctcacacttcgtacaaaactacacactagttttgcatctctttgttgtgacacacaacctctggtttagattctttaaaattatctgtatgggacagtttctctcattattcaaagaatgacttttccccaaaataaataagatatattccttccctccgctgtcgggtgtttctcatgctctcctcttttaattgtcagtataattctagagtaaaagtcctatgtgctatggtttgaataagctccccaaaaagcatgtgttgaaaacttaatgtttggctggacatggtggctcacgcctgtaatcccaacactttgggaggccgaggcgggcggatcacctgaggtcgggagttcgagaccagcctgaccaacatgtagaaaccctgtctctactaaaaatacaaaaaattagctgggcgtggaggcacatgcctgtaatcccagatactcaggaggccgaggcaggagaatcgcttgaacccgggaggcggaggttgcagtgagcagagattgcaccattcactccagcctgagcgacagagcgagactccgtctcagaaaaaaaaaaaaaaagaaagaaagaaaaggaaaacttaatcctcaatgcaacagcgttgggaggcgggggcctatgggaggtgctttggtcagcagggctccaccatcaggaatggattaatgctgattataaaagggcttgaggctgtgagttcaatatcttgctctttctttggccctctcttgccctttcaccttctgccatgggatattgcagcaaaaaggcccaggctagatgctggcccctcaatcttggacttcccagcctcccaaaatgtgagaaataaattacccagtctgtggtattctgctatagcagcacacaacagactaagatgcactgtcaagccaaaatataatgatttgtgaacggctaacagcacaggttggaatctgatgccagctaactcccaaggtctcagattccctacctgtctcccatgcatagttgtcagaagtaaatgaatgaacgtacagaatgtgctcaagcagtgccctgcacacagcaagggctcaggaaagttagcgaccatcatatcatcatcatcatcatgatcatcatgcagtcagtattaggtttgtataaaaatatcaaagagcacattttaagcttatgtccaaacatatactaaaatgtgttaaatacgtatcttttatgtaattttccacctaaatttctagtttctgtgacaatgctaagtaggaaaaatattttaattcattcaatgctatcataatgaagattttgtttgttttctttataatgaaattagtgcctgactatatctaaatttacagaagaaaaagaacgtatattcactgaggtcaggcctgcgatagcaaaacagaggggatgggctaaccgcttctcagcaggggtaaagtactctctgctgcctttcaaagatgaagcagccccctagatatacagcaatgtatgaaatggaactttgagtagggaaaacattgcagacaaatgcatacagtataagcatatttgcttaaaaataaaactatacagttggatgactgtgtacatatacatgtacataaatatatatgtgcatacacaaaaatggatacatcataaagcaattgcctgtgtggtagggagtaggaggcagagagaggagggagactttgttttgctccagtttgtgtacttcttgcatcttttacaatgagaatctattactatttcatttcatatttaaaaagaaagggaaaatagttctattcatttaaaaccaaatattcatcaagccatataatgcattatattacattaaattgcatttcaaaagcatcctctgttatgctttcatttaaaaatacagtaagaaaagtatgatgggaaatcccaaacttctgcagaatgaattgaaataactgagtcattaaaaatcagtttatttcccagtgctttgggaggctaaggccggaggatcagttgaggccaggagttcaagactagcctatgcaatacagtgagacccccccccaccaccacccttacaaaaaattaaaaaattagctgggtgtggtggtgcatacctgtagtgccagctgcctggaagagtgaggtgggaggatcacttgagcccaggagtatgaagctacagtgagctatgattgcaccactgcactccagcctgggcaataggtgagaccctggaccctgtctctaaaaaattgttttatttgtatttttatgatttatttatttgaagacatgttctcactttgacacccaggctggagtgcagtggcacgatcttggctcactgcaacctccactgcaccccctgcgtccccctgcccccggttcaagtagctgggattacaggtgcatgccaccattcacacttaatttttgtattttttggtagagatgggatttcaccaggttgtccaggctggtctcgaactcttgacctcaagtaatctgtctgccttggcctcccaaagtgctgggattacaggcgtgagccactgcacctggccaaaagaattttttaaattaaaaaacgtgtatattttttaaaaatccattttttaaataaagttttgttgctgtcatattttaatgtgcatggagcctcaaattaaaacataatgaggcattttaaggggcatttgaaaatcaataatgctcttttctaattaatttaagtgaaacagcatgtttgcttgaaatcccaaaatgcctttttaatttcctaaggggctcttcagacaggaacagttgggaggcactcagtggttcactcacatgctcccctccaggaatggtgccaggccctggatgtgggacaaggcgcagcacagacatggccttctcccttgtgctgctttgccatgtagcgaatgatggggaaatgtcagggcttggagaaaaagagacagaatgctcagagaaccgcagagctggggagccccttggacgagggctgagggaaggcccttgcatcgatgtcccaccgactctggaatctagaggtccagaaggagccacctagagaccagctgggaggaagaacagctgtggtgcagcgtgcaggggcagcctgaagtagaaagaccctgagattctagcacagctggcaaggcagggacgtggtgcccaggagtaccactgcaggctagcgaagctggaggagccagatgaaagcaggcactcacacgccacggcgaggatgctggacagcgctccgagtccagtgggaagcacgtggctgagtttatgttgtaagaagctctctcgccatgaacacacacacacagacacacaaatatgtgaatacattttgatcacaacaagctgggaatccatgttttgttgtatttaacaaaaacccacaaaatacatccaaaaactattcctatacaaagttacagaaaattttagtggattgtaaaaagtagaaattaggggccacatgttctcatgcaatgacgttagaaattaacagtaaaaggaaagcaaaaaaccaaaaagtctaactacctaaaaagttaaggacatcaatctgagcgatgattaggttaaagagaaaagcaaaaatgaaaattacaaaccaagtggaactaagtccacaagagcactgtgtatcaacaatgccaatctatacagtattattactgttactcaactataaaagggggaaaattaacaatatgtgaattaagaaagtagaaggggttaataaaataaaaacatacatagtcaacccttccctcaaattccccatttcctcccgagacccccggctctagggaactattaatctactttgaatctctaaagatttgctaaaatgtttatttttgaactgtaaaagaatattatctgtagctttataacaataaattggaaaaaacagatgaaatatacaatgttcgaaagacattaacaaaaatgatccccaaaaagaaagaaaacacgaataacataatgaacatgggaaaatacgttaaaagtagtcaaattacctcccccaaattaaaataaacctagataattcccaggttatataaactgtttcagagcataagtcaaatcaaattcttccactttcattttaaagtatgcataattctaagatgaaactggacaaggagggcacctcaaggtaaactgtaggttatctcatttctgaatgttgatgcaaaactcttaaataatatattaacaaagtgaatgcagcctaatgtataccttctcagcaccaggaccattgcctatttctgcaatgcaaaagtgattctgcattaggaaatccattaatgcaaatcactacattaataaactaaaggaggaaagccatatgatcatcttcagagatgttaaaaggatggtgataaaatttacatgcatcttgattaaaaaaaatcttagaaagccaggatggaagcgaatacctcccattaataaaggcatctctcagaagctgatggcagacattactctacatggtaacccattaggagcaatcctgtgaaagccaggaataaaacaagggtgttaaaaaattccagtgttagtcaacctttttccctgtaaatcctcactgtgagtgaagggtcacatcgggtctgggctgacgcatgtgcgccaggaaaaatgacccaaaagttctgtcctctcaggtcactgcttccttttctcggacactgcagcgttgagatggatatggaaggctgtggtcatctcatgtgctgggaaggacgcctggatcagggaagcagcgtggtggcctgcaggccttgggcctccgtgaagacaaaagtgttataaaaacaactgatggaaaagtgaactgtggcttctcagtgagagtctcccccacgcaggcagtgaacaccgcatgtgggtgagagggaaatggagctgcgggacctcccagtgatgtgaagatgctgtccctgctgtgtctcctgtcctgtgtcctatgaagctcagcaaatggggagatttgctaatagaaaccatctctcagcagcatgcttggtggtgggtcactaagagcttctcattaaattcaggagcaagaggtggatgatgaaataccatcatctaatgttattttaacaaaacatcattatccaatgttatttgaacagttttagccacagcaactacacagaaaagcaaaacaagatgtacagatactggaaagcagaagaaaatgtaatcatttcctctgacaaactatgggatcaaagattcaggtgtacattcaactgcttgtacagttcaatgcaagtaataaaaaactgcaaaaagtcttacatgcggcgagtagcctcttcagtataaaataataactaaaacaggcatccaccagagcaagaaaatatttacaatacctaggactaaatttgaaacatggaaagttcatatgtatattttagaaaactataaaagtgtagtaacatttataacaaaataaatcctagatcgataaaacacataaatatttaaaaaataaaacccgaaaatactgaggggatagtagaaaattatttataatcttggagtgggaaaggcttttctaggaaaaacacataacccagcaatcaaaagggttaaaatacgtaaatgaataaaaccaatgtgagtacagaaaatacccacacaaagaatgccattcaaaaagtcaaaagatgcataacaaactattaaaaatatatgtttgcaaccaatataacaatagccagtttccttaacataaggaagtatatatatgtatataatatatataatatgtaaattataaaaacaacaatataacagtaaaataggtaacaaacgtgaagtggcagttaacagataaagaaatataagcaacttataaacaaatataaagatgctcaacttcacttttaattaaagaaatgaaaattacataataaaattgtacaattttgtcagattggtgaagacaaaaacaattctgacaacacacaagtttggatctgggtaaccaggcacaggctcagactgctggcaaaggtgtgaaggggtgccttgtgtttggagagcaatttaggaataagattctaaatttaaagtgcactcatgctctgactgcagggacggtcttagtgatttttttctctagatctgtttgcattccttccttgttcactgctacacccccagcacctaggccagttccccaagcagcagcaatagccactcagtatctgttgagtaatgaatatgtacaaagaatactattcaatcgggcacagtggcttacgcctgtaaacccagcactttgggaggccaaggcaggtagatagtttgagttcaggagtttgagaccagcctggccaacacggtgaaactctctacaaaaaatacaaaaaaagttagctggttgtggtggcacatgcctgtagtcccagctaattgggaggctgtgacgggaggatcacctgagcccagggaggttgaggctgcagtgagccgtgatggcaccactgcactccagcctaagcaacagagtgaaaccctgtttccaaaaaaaaaaaaaaaaaaaaggctgggcgcagtggctcatgcctgtaataccagcactctgggaggctgaggcaggtggatcgcctgaggtcaggagtttgagaccagcctggccaacatagtgaaactccatctctacaaaaaaataccaaaaaaatgtatctgggcatggtggcgggcgcctgtaatcccagctactcaggaggctgaggcaggagaatcgcttgaacccaggaggtggaggttgcagtgagctgagattgcgccattgcactcctccagcctgggcaacaagagcaaaactccatctcaaaaaaaaaaaattatttgcatgttcattttagcaaaagactagaaacatcttttaacttatccttcattaaggggtggttatatgaattatcacacatccatccagtggaattatccgctactccctgtttaacagcagagaagacctccaagtgctgatgtgaaaatgtcccaggctacatggttgactacaaaatccatgttgagtagcccacgtgtgtaaaaaaaaatccataaacaaaaatatgtgcagatgatgactggaaaggcacacacacacacacacacacacacacacacacacacacacgcaaaaccctgtagcaggaaggggaggtgctaggagcccagaataaaagattgactttagtttagatatcctttttatgcagagaacactagctagtcttaaattatgcagagaaaaaaacacaatcaccacacaaacatatggaaatgtagtaggtatcctaaagaaaaacaaaaactggagtgaagaagttgaaaagaatttggataaatcaaagcatacactgtatgttctggaatggaaagacatggtattgtttagatgttttaattttccctcaaagtaatctacaaatttaatatgatgccaattcaaatctcaaatccattctttccaagtcttggcaaaagaaaatcaaagtgcatctagaagactaaacatttaaaaccaggcaagaacattttaaagaaatagattaaaagtccgggatggggtaagcggtagaacttgtcctaccatgtataaaaatagattataaagtcaaggtaatttaagtggtattgctctggaatatgaataaacagacatatgaatgttgaatgaatatgaataaaaagtccagaaatagacaaatgggcactactatctgtgtgcgcatgtgtgcatgcaatgataacactggcagagttgatattggttgtttcttcaccacccagcatacatgtccagcttccctcccccaaccctgcttaatagcagccaactttgtttccggtatgtctgtaaaaaaaaagtagcccatgtgtgactgaattcagtctggtaggacaggtaagcaaattatcatcctcctgtatccaattaaacactccctcccagctctttgactctaatgcaaacagacccagaggtaaagaaccataggaattgtccactcctgcagaactgcaccctggcaagttcagggttcccactgtaggccccagtctcagtcagatttctgagccaacagaagaagcttccttagaaccagccagttttcaagcctgatctctagcctccttgatgattcaataggccccactatcctcacaataaatggcccgtggctttcttagtaattgtaacttgctgcaaatgatttttaatgatctgggtgacatttcaaatcagcagggaaatactagagtattcagaaaatggtttcaggtaaactactaaactgtttagagagaaaaagttcaattcatcgagtagactgtaaaatactaaagagttaactatattaaaaaaaagcacaccataaccaggaagttattggggtagcataatcttggaaaggagacaatctttttaagcatgattctaaggtaagattacaaagagaaacattggtaaatttgaatatataaaaattaaaaagttttctacttttctgacaaaaattaaaaggcaaataacaatccagggaatatatttgcccaatataagtcaaaggattcaaaactataatatataaagagctcttataaatcattgataaatatttaaatctataactgagtacagaacacatacagacaaaacagagaagaaaataaaatataaatggtgcataaacatgaatatatgacataattacacatatatgtataaatacatataagcttatgtatatgcaattataaatgactaaaaagtttaatcttactagtactcaaagaaattcaaattaaacaatgaaatcatcttatatctttcaaattagcatggattaaaaagaataacaactttcagtgctggcaaaggtgtaggggaagagcattatcatatattgggaatataaatgggtaaacttccctaaaaggcactatgtcaatatgcaccaaatactctaaagatacattcatttttatcatgtatatctaattttaggagctgtaaaaaggattcaatttgtataagaataatggccatctctctaattgcaaaaagcagagatatggttaaataaacaatgttacattcatacatatagagtagtcactaccaataaagttgtagaatattttaaaacatggaacaggccgggcgtggtggctcatgcctgtaatcccaccaaggcaggcggatcacctgaggtcaggagttcgagaccagtctggccaacatagtgaaaccttgtctctactacagtataaaagttagctgggcgtggtggcccatgcctatagtcccagctacttgggaggctgaggcagaagaatcgcttgaacccaggaggtagaggttgcagtgagctgagattgtgccactgcacaccagcctgggtgactgagcaagacttcatctcaaaaaataaataaataaaacatggaacaatgtgatcagttaaaaaagaaatcacaaggcagcatgaagtggatagcacatttaaatacattaaatatatatgtatacatacatgcatgcatacccatacatccatatacacacacattatgcacagaaaagactggaaggacataatcaactgggtggtaggactgtgaagtgttttgttttttgaatttctatagtaaatgtataatttttatatatgaaattttgttttttgaatttctatagtaaatgtataatttttatatatgaaattttatatatgaaaggagcataccttttatgtgttgtataggttttgcaatattctatgaagaactcagggtaggtcatgtccacactgaacaggtgtattagtccattcttgcattgctagaatgaaatatctgagactgggtaatttataaagaggtttaactggctcatgcaggctgtacaggaagcatgatgccagcatctgcttgacttctggggaggcttcaggaaacttacaatcatggtggaaagtgaagggggagccagaaagtcacgtggccagagcaggagccagagagaaagcaaggaagggaggtgccacacactttaaacaaccagctctcgtgagaactcactccctcactatcatgagggcagcaccgagggaatggtgctaaccactcatgagaatctgcccccatgatccaatcacctcccagcagtctccacctccaacgctcgggattgcaactgaacatgagatttgggcagggacacaaatccaaaccatatcaataggaaagggaagcaaggccgagaaacagtgagtgacttgtcctaagtcacataaccaggaggtggtgaagcatggctttgatcctggattgctgactccaaatccagtactgtttgtgctgcacacattgcccccaagcaaatgaacacactggtttgtagctctgagatttctggccttgtatgagccaaggcagagggacacctaggatcaagttctaaagtgagggaaatattgatgattctgtggtaccatcaaccaaacagatgtatgtgagagtacatatctgtggtacatgatgttctttttatgtatccgtggaggtatagaaagcggtaagaaatagaggagaccaaatctccctttcctatacttccatgcagtctgcgatgtgggaaaacggtctgagattaagaccaggaggggtcagcccttcaagcttgggcaatgtgtgtgggctttctttttggtgtgaacctccagacactgagtttcccttcacccaatcactctgtctcccccacacagagccctgcactggaaaatgagagtctaagaaaaaaatggccagttccttgtaggtcaccagattttgctatactcatagcacctagtatttaggaataaaaaggctggccaagttatgaatacaagatggcaagttatcctttcagatggagatggggatccaggttgtgtcaattgtcaatcttaagggggtctacaccataccgagaatacttctgtgcacatcatatagggatgaaatctgatcaatgttctctaggccacattcaacagacaataacaagatgaagccccaacaattcatttttgtaactcagtgggcagcttcagcatcgaaactgtgccagcgacactggtcctgctggccttcgtagataagaatgcagagagcagcaggctttccagtggctgcccctgtgaatccaaacaacatggtcccaagccaagcaggcatggtcccacagcagaaaagcttctggtaattcagcaatcacttctcagaatcatagccacaggtagagcaggcagagggcaactgtggagggacatggctctgaaaggtagcctgctattgcttccaagacaaagaaacgaaggcccatgtccccatacccagggaaccacagtcctatcaggagtttaagtatattcataccagaatgcaaccaaacacactgcaatttctgtcacagccagatgtacctattacagtaccatgagctaagttattttgaaatgatcgttctatccaacaaacaagttgttgatcttctacaacaagctcgtccaacccaccacgctgcatgcagcccaggacggcttcgaatgaggcccaacacaaattcgtaaacttccttaaaacattatgagatattttttgtgacttatttttttttagctcatcagctgtcgctaatattagtgtattttatatgtggcccaagacaattcttctaacgtggcccgaggaagccaaaagactgaatacctctgttctacaatgtacacagcacactgtctacaattttctgaatgtggcccaacacaaattcgtaaactttcttaaaacattatgagttttttttgtgactttttttttttttttttttagctcatcagctatcgctagttttagtgtattttatgtgtggcccaagacaatgcttcttctaacgtggcccaaggaagccaaaagattgaatacctctgttctacaatgtacatagcacactgtctacaattttcctggatctgaaagaaaattctttttaattgagaaatgctaactatattgttttgatatattcgtcatccagcataatatgtacatcagcacttaaaactgacttgcaaactgatttttaaaaattcaatacaaataagaatcaatgcaacaaatgctaaaatataatagttactaaggatatttattccaaaatagcactacgttgtgatccttaaaaatatactactagtagctgatttacaagaagaaaaagttttaattgttctacttataaatcagtaagtgaattgttatctaacttatagaaataaatcagcttaacctaaataccctaaactagaaaacatcagaatgaattgaaagtgtacatgagaacctaagaatacagtaaaattatttttaaaattgctcttgtacaaaatcaaatcctatgacctttatgaaagggtttgcatttcattacttaccaactggcagccttctagggagttgactagctgagcattctgacaagagagaattgaaccagccaaattcagcattacacacactgcagaaagcagcatgaaaaaggttatctggaaacaaaccaaacataaaattgattattcacttggagaggctcaaaggaaaaatgacatggctttacaacagctttcatttattatacaacagttgatcacataattacatgaataacatgtatgtgttttaaaggaaagtggtaggttatttctcaaacttccaaattcatatgatctgaaatagaaaaagtaagatctgtaggaagccatagcaagctaccatgattttgtttaaaacctatgatgataaaatatttaaggagttaaacttgaaagactgtgcattatatactcttaacagtgacaagttacacattattaaaggaaatcaagtgaaagaagtatatttattagaaggcctttaggtttaatttttattacagaaaatttcatacacatgcaaaaccaaagaaaacagcataatgaaggcacatgtgtccatcacccaacatcaataattaatccacttacggccaactgtgtttcatttacagcccctaccatctgaattattgtgcaaccaataccaggcatcatataattttacccttaaatctttctaaaggaattgagaagctttctgaaaacatagccaaaatagtcatcatatctataataaataaaaattcattaatatcatcagatactgagttcacatttccctaattgtctaaattttttcacactttgaatcaggccacacaggatacaaagcaggtccatgtggtacaactggctgttaggaatcttagacagtctatgggtttcccatccactttttcctctgtgaaatttactgaagaaaccagttcatttgtcctaaagagtttcttacagtctaaactttctgattgtagtcctctatcattaaacatttctctagcctctgtatttcttgtaatttggtgattaaatacagaggtttggccaaattcagatcaataaaaggcaaatattgtctctctctcttttttttttttttgtgatggagtctcactctgtcgctggagtgcagtggcacaatctcggctcattgcaacctctgcctcccgggttcaagcgattatcttgcctcagcctcctgagtagctgggactacaggtgcgcacaaccacacccagctaatttttgtatttttagtagagacggggtttcaccatgttggccaggacggtctcgatctcttgacctcatgatctgccctccttggcctcccaaagtgctgggattacaggcatgagccaccacgcccggccaatattgtctctctttttgtgatgttagcggccatttttaatgatgacagactcattaatttattagggtttccaaaatagtgctagtctcactctgtcattttttctttatgaataagaatacatatagagacacagacttttcctcatcaactgttttgttaccctgaggtatagttcatatatgaaaagcaggatatatacttgactctttctgttcattttccaggctttaaaataattttaaattttgcaaaatgaactcaaggaagtctgtatgcttaattagcactctttctgcacctatgtaaataattaggccaaatctaatgaagaaagaccctttttgtgatggagaataacctttaagattaatctgatcaagaggcggggagactggcattaaaacttgttaaagagcaaaaaaaaaaaaaaaaaaaaaaaaaaaaattcactggatattctgtctaatgcacacttcagggttatttctgcctttcaatgtctttatgctatttcaaaactctgcataaaactgataaaactgatagtttatcaactgatagttgtataaaactgatagtagtgcaaatgattcttgacgatacaaatgtaaaggaattttgtccagtagaacgtaactgattattgccccactgatattggccacttttacatttatttgtaaatttatttcagcattcctgattgcttatatgtgtgcagtgtttgaattaacctttgaactgcttgtaacatcttactgatttcctcattaaataatgagttagacatagtctttgacacatgtctatttttttaaaaagctgattcccggccaggcgcagtggctcatgcctgtaatcccagcactttgggaggccaaggtgggtggatcatgagatcaggagttcgagaccagcctgaccaacatggtgaaagcccatctctactaaaaatataaaaattagccgggcatggtgctgcgcgcctgtaatcccagctactcaggagcctgaggcaggagaattgcttgaacccaggaggtggaggttgcagtgagccgagatctccagcctgggtaacaaagcgagactccgtcaaaacaaacaaacaaacaaaccaacaaacaaaaacctggttccctagcatcctccaaaattaacaatatcatgaaatagtattttgtctgtttggtggagaggggagtgagtttgagtcattatgagccaagaacttaaacacatttgatagttttaatcatctgcatcattagacagagtccactcaagttgacacctgggtcctttcaacacaactccagtagaccttgacagctatctggctttctgtatgagaagatagtacaggatcatcttacagttttctacccaagagacctataatcagccatttctccagtaagtccaggttccattcaatgagaatggtattcagataccataatttttgtgctacaggtgctgtttgctacttggagcttcattgttttcagttgtcagacatatcatgagttcacaattatgtttctgatttaaattcaacactactaagttttcacaatgagataccatctcacaccaggctattactaaaaagtaaaaaataacatgttagcaaggatgtggagaaaagggaacacttatacactgttggtggaaatgtaaattagttcagccactgtggaaagcaatgtggagatttctcaaataactaaaagcagaacgaccattcgacccagcaatcccattactaggtatatacccaaaggaaaatacattgttttgccaaaaaataaaaaaccccaccttcacccatatgttcaccacagcattattcacaatagcaaagtcatagaaccaacccaggtgcccatcaatagtggcttggataaggaaaattccatggtacatatacaccatggaatactacgcaaccataaaaaagaacacaatcatggccaggcgcggtggctcatgcctgtaatcccagcactttggggggtcgaggcgggcggatcaaaaggtcaggagattgagaccatcctggctaacacggtgaaaccctgtctctactaaaaatacaaaaagttagccaggcatggtggtgggcgcctgtagtaccagctactcgggatgctgaggcaggagaatagcatgaacccgggaggcggagcttgcagtgagccaagatcacgctactgcactccagcctgagcgacagagcgagagtccgtctcaaaaaaaaaaaaaaaaaaggaacacaatcatgttctttgtagtaacatggatgtagctggagtccatattatatgaattaacacaaacaaaaccaaatactatatattctcacttatagggtaggagctaaactttgggtacacacagacacaaagatggggacaacaggcactgaggactccaaccggaggttggggggaagagctgaaaaaccacctattggggtactgtgctcactaactgggtgatgggattatgagaagcctaaacttcagcaccatgcaacacacccaggtaacaaacctgcacatgtacctcctgaatctaaaatttaaaataaatatagtcatacataacaaaaaaaccgcaaacaaaactataaggtttttatgtaaccatattaattttacatctgtatctcctttcaaccatgccaaaaactatttctcaacataattaatctgttggatttaatttcacaatatccacacaacagtctcaaaataacaccaatacaactgccgaaaaaaatgactgaaaatagtttaacatttatatttctttttattcttacattacattctaccagaaatagtcaaattatggtgttttaaactcacatggttcctttatatgtggttacgctactgatcaggaacccaggttcattccttttatttcattttttcttgtttaagaattgtttctaaaactgagtttcatttctaattacataaaatgattccaaagtcaggtccataaatgaagtttcacataagtctggcatttattctgttcctccactctatttcctcccatttattaataggcaagcatttattttttaattttatattttatcctcccatcattttttagtaaaagtatataatagtagcataatacacacattttctttacttactttttttgcacttaatatggtgaagatcactcgaaataagaacacacaaataaccctattcccttctacaactgcctaatacttcatggcacagatgaatcacagtttatttttttattatttatttatttatttatttatttatttatttatttatttatcttgagatggagtttcactcttgttgtgcaggctggagtgcaatgcagcgatctcgactcaccgcagtctccacctcccaggttcaagcgattctcctgcctcagcctctcaagtagctgggattacaggcatgcgccaccacaccggggtaattttgtatttttagtagagacggggtttctccatgttggtcaggctggtctggaacacctgacctcaggtggtccacccgcctcggcctcccaaagtgctgggattacaggcgtgagccaccgcgccaggccaaatcacaatttattaagccagatccctactgatgaacatttgggttatttttagtcctttgctatttattataagtagtgttgcaacgaactgccttgttcatatatctttttataggtttcccagcatggctttgggatatattcttagaagtggcattgctggatcaacggataaatgtttgtttaatgtgctagacattaccacattcctcatcatacgactggtactatttttcattcccactaacaatgtatgagaaggataagatcttactttttctgttaataccttaaaaatgtaagctaaattaaatttaggaaaataactggtattaccattctctaccgtaactataatgtatacccctcagctgtagttaaatttattttccttaaaaatgtacatgggagacagaattcataagaggatattttgttcatttaggaactatttcaagttcataatgttagcagtatctcagcaatggttttaataactgcagagtctgacagcatcccttgggaaagttaggtcacatagaaagggccaactttgctgggcgcggtggctcacacctgtaatcccagcactttgggaggctgaggcgggtgaatcatgaggtcaggagatcgagaccatcctggctaacacggtgaaacccctgtctctactaaaaatacaaaaaaattagccgggcgtgctggcacgcgcctgtaatcccagctactcaggaggctgaggcagaagaatcgcttgaactcgggagatggaggttgcagggagccgagattgcaccactgcactctagcctgggtgacagagcaaggctcagtctcaaaaaaaaaaaaaaaaaaaaagaaagaaagaaaaaagaaagggccaacttaaatttttcatattagaagttacggcagtcccatatcattcaaatgatatgtaaataaactggcctgcacagctttgaaattgaggtcaaaaaatagttgctgaaaacatcacgaaagcaaacctacacagaagccaacaagagactaccctgagacttagtaagtgctgaacaacacagatgctacgaaagtcaaggaggtaagagacaataagatctttttgcctgtttattgtttttttttaattgtggtaaaatatccataataaaaacgtacttgcattttctaatttgttttttaaactgtggtaaaatattcataacatgaagtttacctttattcccatttttatgtgtgcagtttaatgacattaagtatgttcacactgttgtggaatgatcatcactatccatttccagagaatgttttgtcttctcaaactgaaactccatacccattaaacaatcattccttatcctccctcctcctagcccctagcaatcaccaccattctactttctgtcccttgaaatttgattactctagatatgttacatacgggaaatcatacagtactcttcctttggtgactggctgatttcacttatagcataatgtcttcaaggttcatccatattgtagcatgtgtcagaatttccttccttttcaaggctattcgaataatattccattgttccagaaattggtcctgccaatgaaacaacttttctgagtgggcaagaactttgaatcaactatttcataactctggaagctggctgaacacttgtagcatccagagggataatctgataaagaaagaggttggcattcaaggaaatctccatcaggtctttggctgaccatggatataatggaatagagactttagtgatcacacacaatgaggaataaaatctgctcaaaattagtttggaaaagtcactaaagaaatggatggctacagctctcaaaaagcagttatcaggcatcattaaggagggaagataatctgatttcagagtcaccacattacaatattcaaaatgtccaattctcaaatatttccttcttgaccaatctctagcacttgaacaaaatattaacatagattctaacagctcaaggccacatccctaggatggctctagctccccctaaagtacctgcctgagaaaattcaaggctgccaaaagagtttactgttagttccagccgacacttgaagacaccctgtgtcccagcatctgtgggagggtaggagcctaactttgataagcactagctaacaatcccagatgggtttcacacaggccaatccctactttccacttttggtaatttttcacttccttgactttactaaccaccccctacaccctgctcaccctccctcctgattcttcattcttcctttaaaacacctagtgaagcctggcacagtggctcacacctacaatcccagcacttcaggaggccaaggcaggcagatcacttgagcccaggagttagataccagcctgagcaacatggtgaaatcccatttacatatatatatatatgaagaaaaaaatgcaattattaaaaaatcaaaacaaaacaaaagcccagaaacctctgtacaaattgaagttgagttcagttaacaccgggctcttttccatagtgtaacagtttattactcattaaaatctgccctttccgttttaactggtgtccagctttgtgtatctctggcagaaacacatgaattaacaaaagtgattcaagacaaaatagaaattctcaatatctgtataacaaggaaggagactgaatcaggaatcaaaaatcctcccaacaaagaaacgtctgggcctatttggggtctctggtgaatactctcaaacatctaaggaattaacaccagtcttatgcaaactctctcaaaaactgaaggagagggagcacttcctaactcatttcatgaggcaggattaccctggtaccgaagtcagacaaagacactacaagaaaagtaaaccatagactaacatcacttatgaatatacacagaaaatcctcaatacatttcagaagattaaatcatacaaagtacctactctgaccaaaataaagtgaagttaaaaatcagtaacagaaagaaaactggaaggaaacaaaaggaaattggattctactccgtgaccaagtgggatttacttcaggaatgcaagaaagtcgatcaatgtaatacacaacatcaatacattgaagaagaaaaaaaagcacatcatcatctcaacacagaaaaaccatttgacccaatttgagaattcttatctttcagagacacgtgccaaaatatttacaggtaaaatcatatatggcatttgtttctaagtaatctggactagggaggaatacaaagtagttgaactgggtggggatacagacgaaataagattatccacatattgaatcttgtacctcatctttctactttcacgtttgaaattttctaaaataaaaaatttaaaaacagatgaaaagacattttaagagaatacttttaaaataaggcaggaaggaaactggaaatatgttaatataatactaaaaagcattattaggaataaagagagtctaaaagcaacaattctccaggaggagataatgatgctaaacctgtttcgcctttacaaatacagcctgaaaatatataaaataaaaaacaagacttaacaaaatcataatgagagatctttcccattgcttagaaatagattacgcaataaaaatagactatataatatttgaacaacacaattaacaagctttaggtaataaacatactgtgaacatatcaaaaacacgtacacagctgcttgggaggctagcgggggaggactgcttgtggtaaggagctcaagaccagcctgagatacatggcaagatcccatctctaaaaaaatagttttaaaaattagctaggcatggtggtgctcgcctgtaatcccagctgatcaggaggctgaggaaggaggatcgcttgagcccaagagttggaggctgccgtgagctatgattgtgccactgcattctagcctgggcaacaagcaagatcctatctctaaaaagttttttaaaaattagccaggcatggtggcgcttgactgtagtctgagctaattaggaggctgtagcaggaggctcacttgagcctgcttctactgcactctagcctgggcaacaagcaaacttctatctctaaaaaggaaaagacaaaaagaaaacatactgaattcacttcttttttaaaggacacttggaacataccaaaagctaaccacatattaggccaaagaccatgttaaaatattttaaaaactgattttatacgcaacattttatctcactcaaagcaattttttaaaaaatcaaagaccaacaacaaaaagcatagttcaaatccaaatattggaaaatttaaaaagatcactcacttgcaattagaatcaaagacaaatcaaaacagatattaggaaatatttagcattgaatataacaaaaatacatctgagaatttatcaaatatgagcaatattgtaaagataaatatattgccttaaatgaattagaaatgaaaatcaattgactaagtatctactccagaaataaaaaaaaaaagaaccactaagtaaacccaaggaaagtaaaaagaaaggaaacataaagtaattaaatcaaaaagggaaacaataaaaaagatcaatacaacaaaagtttcttgaaaatactgataaaataaataaactcccagcacaaatggctccagaaaaaaaaaaaaaaagggcgaaggcaaaaaataattctgggagtacaaaaagaaagagaatctataagtaaagatgcatggtgttatgatatatacatattggtttccttccatggttcctgtttcctaactcccataatcttcgttatactgttggggttctttaggcctcaggcaacagaatctctctctctgaccttctcctgtctttctttcatctgccccagtcaggcctctgattgtgggtcaaaagaccctcatttcagaaaagagtcctgccccaaaccctagaggaaggaatgctacacagagaggccaagaaaactctgagcagacaggccttgctggctttagctcgtgtgcgtttttgtccaatcacatttctgcacagttgtcaatcatgcctatgtaatgaagcttccataaaaacccaaaaggacagggttcagagagcttccagactgctcaacatgcggtggttccggtagggtggcgtgcccagggaaggcatggaagctccacacaccttccccataccttgccctatgcatctcttcatctgtgtcttttgcaataccctttataataaaccagtaaacgtaagtgtttccctgagttgtgtggactgctcttgcaaattatttgaacccaaagaggacatcatcagaaccccaacttgaagaccattggtcaaaagttccagaggcctggacttgtgactagtgtcctgagagtgggcagtcttggggactaagccctcatcctgtgggatctgacactatctccaggtagatagtgttggaactgaattggaggacacccagctggtatctgctgcttcctccgtaggggaaaccccctacacatttgatcacagaagtcttcttctgtgttgatgattgttgtggtgtgagagcagaggaaaaacgaagtttgagagttttttctctaaaaaagatgtaaaagaattatttttaaatcaaaggacaatactaagaaatgctttctactaattatatcagaaaatatatgaaaacatcttctagaaaatacaagtgaccaaaaccaatttcaaaagaagagaaaacctgaacataatcttgagaaaaatatcagtaaaaatctacccacaaaaaacaccaggcccacagcctttcacatgtagatttgttccaaactttcgaaaacatctaatcttctgataacagggcaaaaggcaagcttcccaatgcatttataagaccaaaaggttttctatttcctgaacaattcagtgcaatagctgttaagtgggacagaacaagttccatgtcctgggagaggccaaggtcacctgagtggggttagagctctagcaatgggtggagggtgactgcacagaaaagccagttatgtgggacattggagcccacgtgggaagctaagcgcacccatgtggatggtgtggcagagaggatagtggattggttatttataagaggaattaatcaaataagtaaatatggtaaagataataggtgctaagtttctcaaaccagaatacacacagcggtgctgtattgcaaatggcagtatcagtgtaatctcatagtcttcagtgctgtgtagatgactgatagataaatatcctataacttcatcacctagagggctggaagcaatgatatttcccataggcatgagcaaacctagcaaccttgtttctgaattccattctccaccaaaagaaaccggagctctttaggaaaaggattaattccaggcctagggcagggagagttaaagtctgaactcctgggtgggcgcggtggctcacgcctacaatcccagcactttgggaggccgaagtggatcacgaggtcaggagattgagaccatcctggctaacacggtgaaatccccgtctctactaaaaacacaaaaaattagctgggcatggtggcgggtgcctgtagtcccagctactcgggaggctgaggcaggagaatcgcttgaacccaggaggcggagattgcagtgagctgagattgcaccaatccactacagcctgggcgacagagcgagactccgtctcaaaaaaaaaaagaactccctctctttttgtgccaacaagcaaggaaatgctcaataaatgatgttggggcatgttaaagatgcaaaagccagctttaaggggctcccactggccaaatcagggacaatttgagtattgaaatatgtaatgataataaaagattagataataagttaatgataataagagacccatgggtctatacaaagtctcaaagtgtctccacacaagttatttgtttaccttaaaggagaaaactctgcagtggaggcacatgacagaaatccaccttaaccaaagtgatcaaggtttcaaaataacaggacaaattgaaattttgtgccacctgataggatccaaaaataacacagcattgcttctgtgatattcttcccaaagatgcataattcaaatccaatcatgaagaaacagcagacaaaccccagctgaaggatgttctacagaaaacaggcccgtattcttcaagtgaaggtcataatagtcaaggaaagacttaggaactactggcaataggaaggagactaaagaaacataactaaatagttcagggaacaaattattttgcactgggcttgcaacttttctgtaaatttgaggttatctctaagtaaattagcataacctcaaaaataatgataatataggaaaattaaagactaacccccccttatgtcaaaagatgcaaaattatacattttgagctatatgtatttaaaaattttatcaacaactgtttgtctccaaaatgcaagaatgtttagatatcagaaaactgtatgttattacaccaaattatatgccccaaaaaacaaatttacagagtaaataagacattttaatcatattagcaggtaaataaagagcatatatacatccaaagtcattcatagttttttttctgaacatctctaagcaagctaggactgaaggggtaactaaatagcccaataaaaggtatttataggggaaaaaaactcttaacagcaaacatcacactctatggcaaaacttaaaattatttcctttaaaatcaagaataaggaatcagaaacatccttagagcctgctgtaactgcttcttttcaataatatattgcattttcagccaatgcaaaaaagactaaaataaaaggctttaagaattgaaaaagaagacaggcatatgatgctaaagaattataggctgggcgaggtggctcatgcctgtaatcctagcactttaggaggccgaggcgggcagattacctaaagtcaggagtttgagaccaccctggccaacatggcaaaaccccgtctctactaaaagtacaaaaattagccggacgtggtggcgggcacctgtaatcccagctactcaggaggctgaggcaggagaatcgcttgaatccaggaggcagagattgcactgagccaagattgtgccaatgcactccagcctgggcgacaagagcaagactccgtctcaaaaagaaaaaaagaattacagtatggtatttgcaaatggatagcaaataaaccaattcagtcctagccataaatttatctatacatgggacattgctacaaaatactgagtgtcataaatcagtgtggaaagtataaatgatgaaaaactggtgctaggctatccatataggaaaaatacaaaaactatttccatacctcacatcatacacaaaagcagattaaaagcataaaatgtgaagatcaaaactttgaacacttagggaaaaaaggcagaaaacatatttacaattttaggattaggggaattttttaaagcactatacacaaatgtagctcttataaacactaatgatcgtaacacatttaggtcaaatgatctgtatgaccaaaagaagtgaaaatgtgggagaaggtatttgcactagatagatagagcagaccatggattaacatgtagaacatataaagatgtcttacaaatcaatagaaataggtctaagacatgaaatctgacactcaaaaaggagtgagagcaaaagataggcagatacttaacattactagtaagcaacaggtataagttaataccgtaataaattatcatttcacactgtaccagaatggctgaaaagatactgaaaaggccaagtgttcacagggggtgaaggtggagggattggtaaacaaaaacaaaacaaaactgtataaaatgttgatgggagtgtaacttgacacaagctcaagagcagcttggcaatagtccttgattgctccatttgtttctggctggagaaactcacacatgtgcctaaagaagtactgtacaatgcctgcaaatctcaaagaactggaaagaccttaaatgtccagacattaaggaatggatagttatttttcccccataaaagaacaattaaaatgagtgaatcaggtctacatatatccacatggctgaatctcaaatacataatggtgagtgagtacagcaagttgcataaggacacacgtaacaccgcttatataaatcatgaaagcccacaaaataaaactctatattggttatgtatatatacatgtatagtaaaattataaagtcatacaacagcccgatagccacagacttttgttacctctggggagggtgagaaggaaaagatataaggccttgatgtggcctctgatgtttcatattttaaaatttgaaacaagattatcgatggtaaattgctaacacctctgagaaaagcggggggaattttgcctcagatataactggtggtgactgctgggtaataatttttattatacaggtgagaatgcgagtatcagagggcatgaggaggagaaagctgagtcagggaggtaaggggaccaggaggcaggaaggagtttatacactgaaataaaatgcagatcaagaagaaatgcctgtaagggccaaacatattccactgatgaaacaaatgcaaatcccaattcaacagaatgaaataaaacccagtaacctatcacattcctccatactcactatagactcttttaaatgacattccgtccagtgttgatgaagttcacttttttccccgagttaaaaatatttgccttatttcaaggttaatttgcagcacctccccctaaaacaattaacttatttgcccactgaataaaacgtgttgaatctctgcattaaaaacagcatctgctacacgtaatggaggaacacaatgggactatgaactcttctagttcatttagtgcataaaactattatatagctattatttttctcattttacagataaattgagattcagagagcttaaaacctacccccacaaccaccatgctgacaagttagcatgagccgtaattcaaattcagtttgccagacagccccaagacccatacccttttccctatacctaactccctaggaggtagatcttatgtcctgctcttatgttctatgtggggcacactcaccatacacgttatatttccccatacaatagagtgagactagaggactatcttttgaaccaggaattgctctcctaggaatgatttggaaaaaaagataaagaaaagttatatttaaaaagtggcagctccagaccaaggagaataaaaaataaaaacattaaagaataacaaataaaattctccacatcacggactaaaaccattttacaggtcaagaaacatctgcatacaaactaaggaacctatgtaaattcatatactagttatggtggggccaggatctcaacccagacagtccgattcccaaacaggcatggttaatggttacgctattgttttataagcctttttgagatccacagtgagaaatatatttcacctcatgatcctgattttgtttcacacaaaagtgaaacaacttctacaaaacagcattgaccttaatatgtagcaaaaactttaagatgttgatttccagtcatgaaattctctcatgacccacgatttaaaaaacacacaatgcttaagtgcttcaaaaatacagtatttattgtaataactacagtagcaagaagaaaaaaacgaagtggaactacgtgtttagcagcagagctgaataattatgaatataaacaattactattgggagaaaatacattacactcattgcttggaaccatgaataatacttatatatgtacgaaatatagaaaaataaaataggttaacataataaggatataggcaattattttttttaattttataaaaacttttatttttccttacaaactggggtagttaggagacctgataatagcttttttattttcttggcaccaaagcaacttacttatgtgttccttcttgcattatctgttccagatcatagtcaagttttccaattcgttttactaagctagcaaaattttttataccaaaaagagtaaaatcaaaacaaatgctcctttgtttatagatgaaaatctggagcaaaataacacaacattaaaaaaacaaaactttgcaaacacatcctaaagctacacacattgaagcgtttacagcaatatgctccctgggttcgttctcccttcccccaatcctctaaactgtgcctttgggtctcagacccttgtcccgggggtccctctgaatccacctttcaagaggatggagctgggccactaggctgaggtctggccctgttctcctcatctgccaaagcctcacagtactgcgctggccagtccttggggtcttgattatggaccttggccacaaacttaagaactttcatcttgctggtttccaggttggttcgcgggccccactggaattcgtagtcgacggggtcggtgtggggtatccgccggtattccaggtaacgctgtcgcacaaagtcctcagtaatgagtttctttggatctccgaaaattaaatgcttcttggtggggtagacccctaagcgccgcagaaagtcccaggcttcagtttccttgatggtgttgcccttcataaagatgagccctaagacgatcatcaggaggcccgtagtgggcgtgccttggtcacccctcatctcggcatcctcctccacaggctccagggtgttgatgaggatgtaagtgttgctcttgggttcaagttccaccagcttatacccgaagacgtactggaggcgctcggcggcccgtttgaagaggtcggggaagatgtccttgtagtccccgatgacgtgcttcagtatgtcggcccgcttgatcggaatcttcttctggtctttaatcagcaagaactgcaccagctcggacactttcagctccagctgcttctggctcctgggccccacggcgggggcggcctgggcccggcgggcgccctgaggcgaggggccctgcgacccctgcgagccgcccggcccgcgggacgtgctcggggcctcctcggcaaagccgtctctgagaacccgggcgtcttccccggcccgcgaagccccggggtttccgctatggctccagtctctgtccctctcggcctggccgccagagcggccccggttcctcggtttttgcaacatgtctccggcggcaggtgccggcgcacactccggtaggcaagcagccgcggcggggattgcgggtcggcgacccgctaacgccggtgcctggaggcgcgcgcagtgtcggctgagactgcgtgctgcgtcatgaagcctgcgccttgcgtcagggcggctgggcggtgcgcctgcgcggctgcggcgggtaccaaaaggaacagcgttttccgtgcagccctgcaggtccgggcgatgatttttagtatagtgaagtgttgttaccaaaccatgcaaacagagagcgagaaccgaaactcctaaacaagtgtgtcgctaaattcagaccacacaggctcaggcaagttttacagacagtattatgagtttctaaatcgggagcatttgtaaacggaaagaattcagaggatgaacgtgtgagaaaaaaaaaaggtgaagaggaagggccgaccgtggaagtaaagtaaaaacatttatttctacacaaaatgtagaaggacataaaagacccagagggctcttagttttcgtccctccacccaatttcataccctccatcccactgcccccagttactttctctaatgccccgtggagtctgttaaaaaccaaagtcggctgcaggctttctgcgcaagcaggacttcagtttcactatttccgtatttatattctctgcattaaactcctttagctagacaactatgagaagaccacaaaaaacgtgtcagtattaggtaaatgttttagcttggtcacatgggtttatcttttggaaaacaactgctttcgtcacaaccacaattttagcagaaatgggtaagaggaatgctgcaaacaaacgtgcactctcaagagattactacttaatttggggcatcactgatcaagaattgcaataatgtggagctcttaaatttcttaattcataatatattagctttgaggaaaaaaaagagaacactgggggatttatctctcatctatgatgtgatatacagtctctactgtatattttaattgtgcaactcaagtagccaaaatgagtcatttcattaactcaaaccatcagcagtctgctgccatgacttctacagatcttagcaaatttgtttcttctctatttacttgcaaagaagaaactgaatttccctgtgtctttttaaagctacccagaaagtggataaactcttcaaagaaccaaattgagttcctctttaatgcaaatatattcaaaggaaagcaatttagaacacattatctgagtaatagcatcaaacacaaccttattaaaattttgttaattgttagtagcataacacttttgtttgtaattcagtaggaaaatgcaatctgataatggcactggaactgcaatagtaaatgtaaaatcatattccatgaactaatgcaagtatgctaaaatctggtatgcaatgagtaataacttactgttccacacaagatgcaactatatcctcaggcatcaattttaatgacaaaggcctactatgaaaaacaaatatattatcaaggcattcatttttttacaatgagaaaattcatctgcttcagtttccttgcaaattaaaatctggacttaggttcatagaagcttcctgccatctagaattctgcaaaaggtccctactgcaggatgtggatgttgtattgagggaatagagagaccgtctcatattgttttatattgttttatactcagtacctgttttaagaaaaaacaacaaggaagtaaaaccaaatacaggcagcccagcgccaggcccaaaaccaggcctgggcctgcctggcctaaacccagtagttaaaaatcaactcataacttagaaaccgatgttattcatagattccagacattgtatagaagaacattgtataaagaacagaactgccctgttctgtttctctctgaccaccggtgcatgtagcccctgtcacataccgcctgcttgctctgatcaatcacgaccctttcatgtaaaatctttagtgttgtgagctctttaaagggacagaaattgtgcatttggggagctcggattttaaggcagtagcttgccgatgctcccagctgaataaagcccttccttgtgcaactcggtgtctgagagattttgtctgcggctcgtcctgctacagtgccttgagtcaaaaaagttcagtgaccgagatataaggggaaagtggaaaattagataaaagctattgtcaacagttgggctggtttttcagtgctctttcttgctaaggtattcatgtacgttaccaagcagcccaccagtcagactacccctgtcactgtgaaaatcagcagtgtcctccagcagcacgcttacctagatagcagactgtcattactcaagatagaggagaagagataccagtttttaagtctcaaaacatctctctacactctttccagaagaatgcaggtgagaaaatgcagacataaaataagagtattagaatgaagttttaggccctgcatggagaagtcatccagacccacattccaccttggattgatactggaagccatggatgtctggggagaaactgtggtgataacaatactaacattagtaacaataaatataaccgacaacagccaatgattatagtagttgctgctccatctccatgtctgcagttttactttctgtggtttcagttacctgcagtcaaccacagtccgaaaatattaggatattttcaaagagaaaccacaatataacttattacactatatttgttctactttattgttagtgtcaactgaaggatgacgaggttcataaatttggaaagagctttatttctcataaagggttgcagtctgcggggcggccattccaacaggctaggaagacaacctcatgctagaagccagaaacagacacttcaagggagggcaaagggagcaggaatctatgcagaatggggtggccaaatatacatatttaataagctataggaggagtcatgaacatttatgcaaggagaaatgtgcatatgcgcaattgcacttcatgtctctccctgggacccatattccaaaattggcagtgttagcatgatccagggtaggagttttcagccctctgacatcaaaaggtgaagtagaggacatgaaaaccctgactgcatgtcttccatagactggccagaactactccatggttggtggtcttttaccaggaagaactgctggtcaattgtgccaaaactgcaaaagggaggggcagcatcaggtggttggtttataccagcagtggagtcttttgaaagggctgatttctgtttagctcttagggaagaaagcctaatggcatttagagcgggtgagggtttccaaggttattcggggtccccttggccaagagggggtctgttcagtcagctggagggcttaagatttcatttttctcatcaattattgttaatctctattatgactaatttataaattaaactttttttttttttttttgagatggagttgcgctctgtcgcccaggctggagtgcagtgtcacgatcttggctcactgcaacctccgcctcctgggttcaagagatcctcacatctcagcctcccgagtagctaggattacaggtgtgtaccaccacgtctggctttttttgtatttttaatagagatggggtttcaccatgttagccaggctggtctcgaactcctgacctcaagtgatccatccacctcagcctcccaaagtgttaggattacaggtgtgagccaccgctcctggcgtaaattaaattttatcataggttcgtgtgatgattaatgtggagtgtcaacttgattgaaggaagcaaagtattgttcctgggtgtgtcagtgagggtgttgccaaaggagattaacatttcagtaagtggactaggagaggcagacccacgttcaatctgggtgggcaccatctaatcagctgccagtgcggctagaataaaagcaggcagaagaacgtggaaggacttgacttgctgagtcttctggtcttcatctttctctcatgctggatgcctccttcccttgaaagtcagactccaagttcttcagcttttggattcttggacttacactagtggtttgccaggggttcaagggtcttcagccacagactgaaggctgcactattggattccctacttttgaggttttggaactcagactggcttccttgctcctcagcttgcagatggcctattgtggggcttcaccttgtgatcatgtgagtcaatactctagtaaactccctttcatatatacatctattctattaattctgtccctctagagaaccctgactaatacagtatgtatctatgcatagggaaaaacattgtggatttagggtttggtgctgtccacgatttcaggtatccactgagggtcttggaacacatcctccacagacaaggggggactactatacaaagtgaatggtgggtcagaccttattccaggtggtttacaggtatgacttcatttaatccccacaacaaacctatcaggcatgtgcatttattatgtttctcttctcacaaataaactgtcacaggagaagattattaagttttgaggctctatagcgagtaagtggtaggtgtgagatctgaacacagccaatctgcctccagagagtgggcttttaactgtatactgattcagagcaaacatagacatggtgtccttgaaaaagtaagggctttgggatcagatgaactaacattagaaacctgtacgatactgacactcctcccggtttaagtctccaagtcaacaaaatgaggcctaaacctggcatcaggggattaagtgagataggtttacccagtacctagcacagtgcctggcagggtagtttgataacaatttgcttctttccagggatttctgttaaggaaaatatttgaggactacacaaagttgtatatactgcaggggaggcaaaaccttccctccaccctcgaagggccccagctggacctgagacttaaactaatataaaatagattaacaggagaaaagcattcaaacttcatttaagttttacaggacacaggagcgcttgttagggaaatgaagaccgaaagaggtggcaaaacctaaatgcttttatatttggttgaacaaagagaggtaattgtgggaaaagtaaattatgtggggaggataaagggagataattattttaacgaagttgtttgtacagaattcacttggctttgaatccccattgagtaatgtttctttcctcttggtacagtaaagctatttttcacatgggagtttttatctcctgttttcaggaagaaaagaggaaattcaaatgcccttcttgcatctgctatttttcaagtgcctttagctcaaagtaatccttatgccaaagtggcatattttgggcgggcagcatattctgccatccttcagtagaacgatgagaaagatgttcactgcagcaaaacacatgtacacaagaatcaaaagggctggaaagaaatatatatatcaaggtactattaaagttaatttgcttttaaaaataaaaatcaaccctgattttcttgcttgggagatgaataaaaaatatattttcaatgaagtttaacttcaaagtgacactatgccatagcagctatgcacattcacatgttcaatacattcagtgtgattcgaatatggcatttgtgactttctgttcaggcagtgaagtcacaaagacaagtggttaaaaaagaaaaacattttcaaacactttatgttaatgaccttcatgctttaattactagacccaaaagaaaaaatcaaaagtctttgaggcaaaagctaagctagctaagatttcaagtgcaaagaacaaggaaatgcctactacaaattgctctttagatgtttatagtaattaaatgttttattttgtcttttcgatagcaaatgcctgccaagaaactctaatcatctttattatctactagattctcctcttcattcatggtatttcttgtgaatcagaaaaaggctttaatttttctgacagcaacacagtgctaaaagcaggtgaggacttcttaggaagaaaggcaatgatcaaagcatgcagccaccacatatgagctgttctctgccttttccagtggaagaaagtgggccaatgtgcagcatgtgagcaagggagttgggaggcaaatactattttggtgggtagacagcaggaaaagcaatccagacatcttaatggttgcaataaagtcccttgtgtccacacatttacaacagttatatatattcattcatagcaaagatccctcctgcctaggtcacatggtagactacctaataacactttgtccctcataaatgaatattttgatgaagcagcaacagagttttccttggctggtggaagcgggtggagaggtgagccttgacaagatagtgctttccaagcattgcagccatttggcccagaagcctggtcttagactctcttttcaagaaatgcatcttccagttatccagggccctttacttatgaaaatcattagggcctattaagttataaaattacaaacatccaaggtcttgatagtggtcactaagattctcttcgtttgcttggtttctaatccctttgttctgtatcctttccctttagaaacagcctcttcccacctttaaaagaccttagtatagggctgccttcctttcctgagtgcacaggattcaggccagacacagtgactggttcagaagttcagtcagcatccttccaggacattcagacagattctcgcccctctgagctcacaagctgaggggtgatgtaagcctagccacttgtgcccttgcttctgaaaaacctgcctcagggcgaagccaactcaaaagagatctaagagatgggaaacaatcttaatgctgccatttgaatccctggatgctgagttcaagatcagactcctggagataatgaattactaaagcatctccttttgcttaatctgctttgagttggttcctgtcacttgaaagtgaacaaggtctggctaaatcagtagccaatcctattattcaggggaaaaaagggtagtaagaaatgagactttggagctagggaaggttaaaaccaatgaggagttttgaatataatgagaggtgaattgaaaacaatatgacatttttgttatgtttcttcccagtgttctgtggttggggaatgtgctcatcattttagttggtggcaacaggggtaagggagagacaaattatgaagaactgtacttttccatatggaaagtatatatgggccaggcacagtggctcaggcctgtaatcctagtactttgggaggccggggcaggcagatcacttgaggtcaggagttccagaccagcctggccaacatggcggaaccccatctctactaaaaatacaaaaattagccaggcctggtggcgggtgcctgtagtcccagctactcgggaggctgaggcaggaatcgcttgaacccaagaggcagagcttacagtgagccaagattgtgtcactgcactttagcctgggccacagagcaagactccgtctcaaagaaaaaaaaaaaaaagtacaaatgagctaatcaatctggtgatttacctttgcagaaaggagttttacacaatttggaatataaattaaagcagcggtccccaacctttttggtactagggaccagttttggggaagacaatgtttctatggaaggtgcgggagtgggagggtggtttgaggatccccgcctgcagttctcagtagggctcacatccctatgagaatctaatgctgccgcttatctgacaggaggtggagctcgggcagtaatgctcactcgcctgccactcacctcctgctgtgcggccaggttcctaacaggccacgaactggtactggtccacagcctggggtttgggaacccctgccttaaagcatctcctactctaaagtggctgtgttctccatatttaacccagagcacttccccacttgctataccacgcaagatgacagaaacctcattcttccagactacgctttagcctaaagtagagatatatgcacaggacagaggtatgtccacaaagagagctgacaaagctaatatccagacagggacaatgcgaataggttatgagaaaactgaacacgttgaaatggaaaaaaaataaattagagaaaaaataaaaatattcaaggcagacaagaaagaccccatgtatacataactggtggtcttgagggagataacaaccataaagagagaaacaggtgactgtaggagtcctggggagctgggtttacacaggccccgcctctctgatcccacccccaccccactgcagctccctcccttggactaataaccacagcaagcatgcttccaggactggagggtaatcagaggccatgggttccccaagatctgcagaagagatccagtacagggttcctccctccctgagacacaagtgagagcttagcaatgaagttgcatgcggagaagagggcttgccccttcccaaggaagtcctgggaaaagcaaggactgtgtggtacttgtggggtctgtgctggcagaagcccgtgtctcccttctgagagagtccacagctgtcccctttctgagaatagtcctccaagaccctgtcccaggctgttgttctttgggagaggcaggctaactgctgccaggcttcaaggttgggagagccagcagtttgccccctgtgaggcctgggctccaagaggcccttcatagtacttcaaaaggcatgtagacagtgtgccctctgatgcatcgtgaccataaaagcaaaacctgctgggcctcttgctacttgccacctcatactttttcagtgactcccaacaacatgactcacagaggaaagggagaagcacagaccccattccagttatcccactggatatccttggcctcttttctgcagatctgttgaccacagatgtaagaatttatttctggagcctcaattctaatccattgctctacatgtgcactggtttcctggggctgccacagcagaataccacagacttgggggcttaaacaacaaagtgattcctcacagttctggaggctccaagtctgagatcaaggagtcggcatgtttggttcctcctgaggcttctctccttggcctgcagatgaccacgttctcactgtgttctcagctggcccttctctgtgcatgtacatccctggtgtctcttcctccttttgttgactataaggataccagtcctgttggaccagagccccactgtaaaggcctcattttaacttaatccacttaaataacttatttccacacacagtaagtctgaggttgagtcttttgaattctgggggagacactgcagcccatcacgtatgttgacgtgtgccaccgccacactgcctggttactgcagagtgttagtaagttttgaaattagaaagtataagtgctccagttctgttatttttcaggattattagggctattctgggtcccttccatctccatatgaatttgagaatcagcttgtttattcctgctaaaatttagttgggatttttttttttttgagatggagcctggctgtgtcaccaggctggtgtgcagtggtgcaatctcgcctcactgcaacctccacctcccgggttcaagtgattctcctgcctcagcctcctgagtagctgggactacatgcgcacgccaccacactcagctaatttttgtatttttagtagagacggggtttcaccatgttggccaggatggtcttgatctcttgacctcgtgatccgcccaccttggcctcccaaagtgctgggattacaggcatgagccaccgcgcctggcctcagttgggattttcacagggctcgttttgagtctgcagatcaatttgggtagtactgacatcttaaaattaagtctaccgatccacataagtgggatgctagttaatatggacaagtgaatttattactcctccaaaaaactattttcacaaactttatatcaacatgagaaatcatgttgtatctttctacctggagggagcaagaaagtcaggtggtgtgccttttgtacatgggcaacccaatttcttatctagactttcttttgctcgcctggaaaaaaaaaaatgaggtattgcaaaaatgtgataattgctttccttagtatgaaaaactgttaaaatgagtaaagcctgtgctcaactagaattctcacatttccgttttgatgtatccgcatttcacagtaaaaaaaaccctcagttatgtacatatgtgatcctgaagtacccatgattaaaaacaaatatttcaatctacaatgttcagttctattagatcattaaaagacgtatctctactcgcattctctgaaaacgtgtaaatcatgctcagcatagtgacaactccactaggacaggccgaccaactcatttgttacaaagtctctggccccctgagtgaggagcccccagaaacctaatgtgaaaggaaacttcggttttctccccagctgctttccttgagtttgcatgatatgctttggctgctatgtggagctgtcaaaagccttgaacagacaaaataaagaagaatggcattccaggaaataaacaagcttaatctcagttggacagaaggaggtacaaagaaggcctggggaaggaagaggaagaggcaggatacagggaagacagaatggactctgtaacctcaggaaaaaatagcaaccttataaatacaaagatgttccctggcagacacatgtcagcacctgggttatgaaagaccagccaatgcccccccacacaggttagaatcacattcatcaggaaggaagagagcagaaggaccctgctgcctggtgatgtctcagctggcgtggctgcagctttgcttccagcagccggggaaccgccatgggaaggcgtttcctcaaaatgcatgaaaggcggaggagcttggttttctgatggtttgctgccccttgaagttggcaacaccatcccttcatctgcatggataaaccggggcatcctttttgagaagcagtacttttttttttaagactttattaatcccacacgtttgagagaggtggttgggaaagcaagtattaatgaattaactgcttcctaggattcaatcagtcattaaaaatgtacccgtgaaattttcttgagctgttcaattgtttatcattatccaagtggttcatactctcatgcatttattttccttccacatttacctctaagcaaattacctaattcaacatggttattattctggatatttaaaagctgtgtattgggaaatttcacatagtaatatgaatacacctgttacgcttaatcctttgtgcctaggtgtgattattagatataatttatagaaattctgccgaactcattgtaatttattatccatttatggttttacttgattagtcttacttaaggatgatattttctaaatgtataaataaatgatacagcctattaaagtggaggttatataataagtgacgggtttaggagtggacatgtgaccgagctctggccaatgagttgcaaggggtatttttggaggcatctgagaaatgtttacttgctcttaaaaaagaagattgtaggaaaaaaagaaggaaaactttcctgttctactggacccccataccagacatctgcatgtactgcctcaagcaggggcaactgtctcatgactgagtagagctaagccaccacatcaacacatcgaaactggcagaggggaaagctggaaagattctaggtccttgaatttgtgaggctgctgaaccagctaaccctgcggcaaccccgctctggacttgccatttgacgtaataacttccttcgttattgaaacttgtgtgaattggtttgtatcacttgcagccaaaagccaccccaaagcttcccagctgacatctgtagactagggagtcccaacaagaggaacagacttcacctggtgaagccgtgccaacccactccacctgtctctgagatctatagacatttgaatgtgagcgtgaaatgctgctcaagttcaggtagactacagctcaagaatgtgagactacaggttggtagtctgcctccctctctaaggcaaagagatatttcaatgttacctgggacctgagaaagggggagggtctatggtttgcccagataactaaagtctgtaggttagaaagtcaggatttgtttggaagctataaagatgtatcctcatatgtcatggacatcatgtgatatggtttggctgtgttcccacccaaatctcatcttagctcccataattcccacatgttgtgggagggaccccacgggagataactgaatcatggggaaggtttcccccatactgttctcatgctgatgagtaagtctcacgagatctgatggtttcataaggggaaactcctttcagctggttctcattctctcttgtctgctgccatgtaagacgtgccctttgccttctgccatgactgtggggcctccccagccacgtgaaactgtgagtccattaaacctctttttctttataaattacccagtcttgggtatgtctttatcagcagcacaaaaacagactaatacatcatcctaacttgaatgatgcctgtcctcagtgagtggtccattgtgagtatccatcaaggagttttctcccactgcacactggacctcaggagttaccacaagctccctagcactcttcaaattgttcctcgtttccagcaagtcatctcttctccacccacctcatgaattcaatattttagatgcctgtcacattgcctgtcgctgatccctgactcttgagaccccactatgtgctacagtcttggtcccctgtttgcttggaagaagacaggaagttttaacccgaggctgtagagggcttcaggcataccggtctgttcttgttgcctggactcctccagcacatccaagtctgccctttaaccgtttcttggctacaactggtctcaatatggtgatggccaggggacagatgagctttgaaagcctcgggccaaccagccagatgttctcttgcctccagtggtcactggtgatgcctggtatgggggtgtgtccagaggttgacccactgttgctccccatggcctatgatagagggccatgctcacacagggagctgggaccaaagaccagagtccagcaagaatctctggaccaaaggtcaggcagtctggagacagtctgcatctctggcagaccccagggtgagaagcagctatcccaggccagagtggggtcagctggccaatctgggggctctggagcagatgagagggagcctgtcctgcacacttgaaagagaagttgcaaggtagtaccaaggacaattcagctctacttgattctgaaaagactatccccaccctcaccataaggagaagagacagtgtagtttgccagtgcaactgcggagggaaaacaatcccaccctatctgcctctatctcttcttctttttttttggagacagagtcttgctctgtcacccaggctagagtgcaatggtgtgagcatagctcactgtaaccttgaacttctgggctcaagtgattctcctgtctcagcctttccagtagctgggattacaggcataagccatcatgcctggccccatctctatcaatccaccatggcctgggggggattttagctatcatagcctgcagctgggcccaaaccagcgctggggaaactccacacccaccaaaacaatgcagcacagcaaactcatgtgccccctaagagggacagtggtttgaaggaaggagacagccaaattctagaacagatggctactacagagcagaactaatgacagatacagaaatagactatataatataaacaatgagaattcataaggagatattattagagcacaaaaaatgctgccagaacagaaaaatgcttgattttttttattgttttgttgttcctggatcctaagagaaactccaaatgctcaactttttccatttaaaaatttagtagaggtactgtataaaagaacggtccccactaaaaaccaaattactattttaggaagataaaatgaaagacgtatcccacagcacaagataaaaagttaatgaactaagaatcacgagttaaggatcaagatatggagggtggatgcaggaggatgcatcctatgtaaataataggagttgagggagaaaacaaaagtatgagagaataaaaaaagaaatgccaaagaaacaaaaccaatcgagtcttaagattgaaagggttctgaaaatgctgaatttagacacatccttacaaagctgctgaatttccagaatagggaggaaaatcatataagcttccagacaggaagaacacattgcttttagaaataaccagtctaggggccgggcgcggtggctcatgcctgtaatcccagcactttgggaggctgaggtgggcagatcacttgaggtcaggagttccagaccagcctggccaacatggtgaaacccatctctactaaaaatacaaaaattagtgaggtgtggtggtgcaggcctgtaatcccagctactcaggaggatgaggcaggagaatcgcttgaacccaggaggcagaggttgcagtgagtaaagattgcaccactgcactccagcctgggtgacagagagagactccatctcaaaaaaaaaaaaaaaaaccaaaaataaataaccagtctaatatcacatttctcacctgcaatcatggaaagtaatagatcatgggctaacatttagtggctagggagaagaaagaactgatgaggaatcctccaccaggcaactacagagaaatcaatgattggacctgcagtcaggaaacacagcttctctgcatactctctgtgaatactccaggatacgctaccaaagagccagatcagaacaagggtccaagggagaagacagagtgcagtgatcaacagtgagagtgaatctcgtaatatttatttttaaatcttcatgcacaatggtaacgtcaatgcaagttataacacaatttttcttgaggattcttgaaatgaaataatgaaaattttagttagatcctagccccaatctcagcatactccaggaataaggagaagacaagggcgaaggagtgaaaagaaacatgattcccagggtttctcctccaggtgggatgagatgaagaggacactgaaaatattcaggcagaagggtgtgctggtaattaagctacgttttctcaatttcaaatccactgctccctgacgctggagtgggggctctttaagctgtggttttcttttgttagatggtgttctattgggttcttccagtaagaggcaatggagggagcctgaaaagtggggagaggagatgaacttgcttcttccttttctcttgctctccatgtcagtaccagcctggcagtacccctgccctgggcttcaacctctctcaggacttccaaaccagctttcttgtgctctctcagaagtatgaacaatagcaaagcacttccctgcagatatgaaaaagactgaaagagaatactatatacagcctttcccaaaacatttgaaaaacagagaaagtgggcaaattcctagaaaaacacaaccaagaaaaactgatgcaagaagaatcacaaagtttgaataattctaggagcttctgaatctggaattccaaacttcccttcccagaaaacttcaggccaagatgacttcactagtaaattccactgaacatttgaagaagaaataacaccagccttaaataaatgtttccagaaaagcaaaagagggactaatccccattgtgtcttatgaaggaagtttaacctccatataaaatctgtcaaggacattttgaaaaatgaagatgaaagaccaatctctctcatgaatatacgataaaaaaatcccaaacaaaacattaacaaacagaatcaagagattcagcttgagcaagctgagttcagtcaaggaaataaggttggttcaacattcaaaaaccaatcaagataattcaccatattaacagaataagggagttctctcatatggtcttcccccaaaaaagaaaagtcatatgataaaattcagcatttattcatgattttttttaaactaacaaaacaaaatttagcaggctagaaatagaaaggaacttaaacaatcactacaacaacttccattaaacatcatatgtaaaataatgagaatgttgcctcaaagataagaaataacaaagaaagctgccatcatcacttcatcattttactggaagtctcagtcagtgcaatcagaaaaaagaaataaaagttacaagattggggaaaaaccccaagttatcttattttcaaatgatgtgattctacatgcagaaaattcaaaagaatgtaaagataagttaatagactcactgaatttatcaaagtagctcgatataaggttaatagacatacatcagctttatttctattttccaataacaaaatagaatgaaaataacagcatatgtggtacattttcccaaagatggatgcaacgcaatctcccccctacatgcccttttgtaccaaaatgtgggtggctgaaccttccatcaagggacagggactatctgtccaccctctcaaatgtgaactccttttgtggcctgctttgaacaatggaatgcggcggtagtgacactgtctgagtcctggagccccggcctcggaggctgacacctctacttctgtcctctggccacggtccccactgtagtgctctccttgcacggacagagctcagcccatgccactgactagggatgacaggaaaggctcagcagccagcatcaaagttccaaatagaagagtgaggccgtttagaccattatgtaattgagtgtcctgtttttaaaaagtatttcttctttctccttcctgcctgttccttgtcttgcccttagcatgagataatagtctttgctctccctccttctaccaggaactccctggcacaatgtttccctcatctaattatgtttttgtttagaagttccagagactaaatcttgaaacaattcgggccactatgggattctccctgacctgcagattacttccaagctgcagttaatttgcaactgggctgtacccaagatggcaccagcccattcaccagatggggcaataacgcaagatagtcataggaacaagtcatgtagactggcacctcctcatcactcctgcatgcccctcataccaaacaccctttttaagcccttaaccttgacccaaaaagctgaaatggtttctttcaggcactatccgcggccatttccccatggaatggggaagaaagcttttgggataaagtcactttcctttcactgtattgcatccttgttctcggctttgcaagcagcaaatagccgtgcctgcattcggttacaattggattgctccagctacactgcaatcacagaagaaagtttaggcaagaccagcaaaaaaaaaaaaaagaaaaaaaaaaaaagaaaacccatggaatcctgaggaatgataaaactattgttgttttaagccattaccttttgaggtggcttgtggcacagcaatagataaccaaaacaccatactcaatcacaataccacacacacatttattttgtttaaagtagaaatatatctaatgagagatatgcagtgcctctactcagaacattataaaacaatattgagataaattacgtgagacccaaatacatgttcatagcagacatgctacggtaaagatatcaatattccccatattcatcaaaagcttcaatataatcccattaaaaattccagcagggtttctttatacaatttgaccaatttactaaaaagctcatgtgaaaatgcaaatggccctgaatagcaaaacaagtctgaacaacaaaatgctgatgttatagataccaagtcttatttataaatctatagttattaagacaatctggtattaatgcaagtatagacaaaaagaccaacaagatcgaacagagaatccagaaagtgacccacggttaggaggacactcattcgtcacagagatggcactgcacagctgtggggaagggactgtcttttgaataaatagcccaggatcaattggatattcatacagaaaaatgaaattacattttttaaacaaaaatttactttcggtaaactgtagttctaaatataggtgggaaaataaagctatttgatgataacaggagaaaaactctgtgaccctgaggtaggaaaaatattttttaaatcaagacaccaaaaagaccactgaaaaggcaagcctctgaaagcaagaaacacatactgttctgtatgcatatttgtatacgtgcgtgtgtgcatatacagtcatgtgccacacaatgctgttttaggcaagtctgggccacgtatgtcacagtggtctcgtttgactgtaacgcccagcacagtgctcctgctcctgtttccccatcatcaccaacacctggtgttgtcagggcctctacactggctgttctctctgcctggaaagttcttcccacatggctcactcccttgcctccttcaggtccccagcaatggtgagatcttccctcataactctatattaagtgtagtaattaacggtacaatatttctactgtaccttttctgtgtttaggtatgtttagaagcacatatgctcaccactgtgttacagtcacctatagtattcagcacagtaacgtgctgtacaggtttatggtccaggagcaatgggctgtaccctatagcctataggtgtgtagtaagctgtaccctcatctaggcttgagtaagtactctctatgatgtctacacaacatgcatttcccagaacacctttgtcattaagcacataacacataactatatatgtacatgtgtatgtatgtacatacatatatgtatatatccgcccaacaaatcacaaataactcaatgacgggatcatttccagaacatacaaaataaataagaaaaatgggcggggtgcagaggctcacgcctgtaattccagaactttggaaggctgtgggcagattgcttaagctcaggagttagagaccagcctgggcaacgtggcaaaaccctgtctctacaaaaaattagaagaaattagctgggtgtggtggtgtatgcctgcagtcccagctactctgaaggctgaggtgggaggattgcttgagcctaggaggcagaggttgcagcgagccaagatcacgccactgcactccagcctgggtgacagagggagaccctgtctcaaaaaaaaaaaaaagaaaaagaaaagaaaaatgcacataacacaatggaacataagggcttcaagaaaaagagcatctaaatgtcaagtaagcatgaaaaggcactctaccttattagcaatcaaggagatgcagaacaaaactgtaatgagacaccatgactcaccaccctatggctaagatgaaaatgactgacaacatcaagtgcgggtgataatggggaaaaacaggaacattggtggggtaatgtaagctggaccaaccactgtggaaaatgatctggcattatctactaaagttgaacctatgcaccccgaaatttcactcctagagagtgcacaaaaagatttgatatgaggcacggtgtggtggctcacgtctgtaatcccagcactttgggaggccgaggtgggtggatcacctggggtcaggagtttgagaccagcctgatcaacatggcaaaaccccatctctactaaaaatacaaaaattagccaggcatggtggtgcgcacctgtaaacccagctactcaggaggctgaggcaggagaatcactggaatccgggaggtggaggtttcagtgagccaagatcgcaccactgcactccagcctgggtgacagagtgagactccatctcaaaaaatatatatatacatatataagtgaaagttcacagcagcattatttgtaatagtcaccaaattgaaataatctaaatgtccatcaacaacaaaatgcataaataaaatgcaggatgtatacgacgaaacactgtacagcaataagaaggaggaactacggctaaatgcggcaacatgaatggatctcattccttcactgcttttgtggatctggccctggcctcccagggcacaggtaccagagggaccctcctgcaagtccctcctcacctcaccaccacaatggtcctcaaaaaagtcaaactctttaaaatcccccaccagtctgcacaccgggcagcccctgttgtctagcctcacctcctactttccctgagggcactctcccgagccataacttctcctcgcagtctgttccttgagtgtgccaggcgtgcttccacctcagggctctgcacgggttgtcctctctgcctggaaagttcttcccctgcagaatcacgcggctcactcccttgcctcctgcaggtcttggggaccatgagccctttcccatgactctatattcaggtatcaccccatgtccatactcccgaggttttgaacgagttttactttttcaccataacactcacctgcatctggtatatgatttatctgcccattctgtatgatcaatctccctgcacaagaatgcagctttgggagaatgagaattttgcctcttttgttcactgttatatccgtaggagccagagctcttctaacacacagaaggcgctcagtacaattctgttaaaagaatggccacataagaagacagaaacacaaatgctgactgatgctgtctgtgcttagacagagcttgtctatccgtgggcctcaccagtaggttcctctgcctgtgatttcctttctctaggccgtgaacttctatagaaaggactcttgcagctcctgccagggcattgttgagactagcagccagcactgtgggagccaaagggagtgaagctgaggaggccgatggagatgcggcctcatctcttcaaaggctctcacttaatcccaagtgacttaatcccagtgttcacagaacatccatgtgcccccctgcagttcctgcctcccttgcagctgggatgggccatgtgcctgagtctggtgaatggacatgtgagtagaaggggtgtgtcccctctggcctgaggtgctcaccatcaggtgcctcccccatccctttcttccccctagacagcaattctgggggccatggaaggggtctcattacctcccttcccacacagaggaaagctgccctgaagagctatccagtccatactatgcatttgtgactaagaaacaaacctttgctacgttaagccattgaaatttcaagggtttttttgttactgcagcatagactatctcatcctgacgatcttctgtcaggcacccccactcctgccttagctgtactagacatccttgtactctgatgtctctctggttcaacctctgtctgctactggggtcagatggacagttacaaagctgcacaggctccatttggggctctgagggggttgcctgcatatcacagactgtaaaccagtgctccttttgccccatccacattcctgccttcagagacatctggtgactctaattcctgagcccttgcagggccctgaggcacaaatcagcttgtttcttcctgccccaccctggacccccagctctcagcatggtggataagcagaaagaaatcgaagccaaccacacaatgatacacttctcgtgcttccaaaatgctgctgacattttccatctgttcatctcctctttgtgagtttgaatcttttttcttttattcttttattgtcattttaatggtgcttcaggagaaatagtgataaacaataactatttcgtgaatacctatttattttgaatattcattgtaaccactgctaagaacagcaaaacttttaggtttgcataggttttttttttcttccaagaagttcagagtacatttaaaatatcagttcaaagaacaaaaggaaaatattattattaccattttaaatcagataaagccctgtgaggtctgaaaaactgccccaccacccaatgtttgccaatgctgggacacaatccaggctcccatctcatgatctgattttctactagtggacactatcctgagtgctatcatttatatccatcttcccacctttcataggaattctatctgcataacccaaagaatacctgctggagactgacacttactgcaactttgccagcactttcatgttcttaacaaggcatttcaccagtttaactactgatcatcactgacaggcttcagtacataatttcatatatgaatcttcatccatctttttcttttcttttctttctctcttcctttctttccttctttttctctttcttcagtacataatttcatatatgaatctccttccttctttccttccttccttccttctttctttctttccttctttctttcttgtttttcatggagttttgctcttgttgcccaggatggagtacaatggcacggtcttagctcactgcaacctctgcctcctgggttcaggcaattctcctgcctcagcctcccgagtagctaggattacaggcacgtgccactacgcatggctaatttttgtatttttagtagagatggggtttcaccatgttgtccaggctggtcttgaactcctgacctcaggtgatctgccctgctcggcctcccaaagtgctgggattacaagcatgagccactgcgcccagcaatgcgttttcatatattccataaaacacagaagtgtgtactaagatcatgtatatgtatatggcttggaaaatttataaggtctccatctagaagctgtacatctttggttttaaaaggagagggctagagagaggataaatccaatcagttgcttctttcattcctcacttcttttctactgttaacatacgtggtcataaagaataccagatgcaggccaaatacatttgccatgagaaaaagataaaaatcaaaacttatggcttctcaatactgcttagtattaaagcacaatgctgcattctctactacagctgtgtagttacaagaatctatttgagtggccatgtgtcaaagataatggcacaaaaaggctgggtctatatggctcatggcccaacatccactgcttaacatgatgctttttctggattaagatcttcaagtcaggcaaaggctccggaggaggacagaaaaccaaagtgaagagatgcactaggtagggaggtttttgggttgtaagtgatagaaactcaactcccgttacctcaaacaaaaaggggaatttattgactctttttttttttgagacggagtctcgctctgtccccaggctggagtgcagtggcacaatctcggctcactgcaagctccacctcctgggttcacgccattctccctcagcctcctgagtagctgggactacaggcgcccgccaccatgcctggctaattttttgtattttttttttttttagtagagacagggtttcaccgttttagccaggatggtctcgatctcctgaccttgtgatccgcccgccttggcctcccaaagtgctgggattacaggcatgagccaccgcgcccggccaaatttattgactcttagaaccaggaagggttcccccaggtcccaggcagagagtggggatgcaagcaggcccagaagcaggtgtgagctgctgtgggcatcgctctgtccaggccgtcccctctgtccttggcttggctctaatcctgcagcatggcttacttcacactcggggaagcgtggaagttggccatgctgagcaactctcttaatggagagatggagtgtggggtccacaccctccacccccgctccactgcctgcacaccatgccaagtccaggtattctagggaatggaattctttggggttcgctgccatgcccaagacagtgccttcatgctgtcctcacagcgcatcctgcagtaactgtggggaaactgagggtggggggagattgtctgggaagaggagctgggcctacaattctgatgctccctgcagcctaacctccaccccccatgtcactgccaaggaatcttgcagcccagagcagacagcaagagcctctgcccactaggtctggtgctcagaagcaaagagggccctctggggggacagtcaacacaaggagacttagggtgggtatgggcagccagagccccagccccaggagctgggattagggcccaggaatgaggaaacagggaggggaaagcacattgaccaatcctggaagcagcgttattgaaaggttctggaaattcaaagaagcaggcaatgtgtgggcagactcccgttagtggccagagcccagaaggaaccaactttgccttcaacctcagcccactccctgctaacagagggagatggtgacgagtctgaggggcagaaggaggtccaggcatagaattgcacttgtcctgggtctctgcaggtcagcagtgggatgagtagggagacagcccgccctgggcctccacagtggggaaatgaggcaaacgtgtctcttttgctacaggaccaagtccactgtcctagaaaggtttagttgacaaaaaaggagacattcacacatttcctccagcagacccactcactgttatttgttacctgggaaaccaaacagccatatataaacaagggtaaatcttagaatcttggaaatgaaagtgccataatttccaggatgatattaaaacgccgtgactttctgaaaagggttccagcaacgtggttgacagaaaatattgtgctttcttttccacaaggagattgaatgtgtcttatttacagttacccagaaaacaatgatgaaagtagctaagtctgcattctagaggcacaggtcaaggtgtctgaggaacaatttggcatcttggaaagtgaagtcccgaggctgggaccctgtggggagccttcttcattgcaggctccaagccgccagtctcctgctgtagggagaaggctgtcggtgctgcaaggatggagggggatgtgcagagcccaggcactgagagaagcttcttagagccagaccatcgggagggagaaaacagggtgacaggggtcagttcatgaagacccttggattggatttcattccaagaacagtgaaaaacccatgtaaatcaggacttcgtgaatgtgcttattctaacttccagaggaaataatgaatgaactgtctactgaaaacccctgcctgtgctccatctgaaatgctgcctccctcaaagcatgaagctggagtcagcactgacgacgatgggcagctggagtgggagaagaggagtggcatggcctcagggagggccaggtccccctgcacctctttcccacttggtgtcccccacctggtcactcccaggaagccactgctgaattgacagccaggcctctactgagtcaagggcgacatctggagatgtagaatcagacataaaactcagcacagtactcatcccttatccttagggggatacatcctaagacccccagtggatacgtgaaactgcagatggtaccaaaccctacgcagcagtttttcctatacttacatacatatgatacagtttataaattaagcaaataagagaataacaatagctattgataaaacagaacaattataacaatatgccagtaaaactactcttgtgttttgccaccattaagtaatatgagggttccttgaacggaagcactgcgatgtatgtctgataaccatcctggctactaagtgacggccacgtggggagtgtggacagcctggagacgctggacaaagggatgaagaaagacagcaggagatttttatcctgcgactcagaacagtggatttaaaacttgtgagttgtctgtttctggaatattccatttagtatttgcagcccatggttgatcaaaggtaacagaaactgtggaaagtgaaaccttggggaagaggggactgctgtataaaaaactttgaaaccttttccatatgtgtgtgggctccatccaatcacgtgaaggcctcaagggaacaagactgacctcccctgagcaaggaggaattctgccagcagaagggctttggatcgaactgtaactcttccctgggtctccagtctgctggcctaccctgcaggtttccacaacaccatgagccaattcctgaaaacaatctctctctatgtatatatacacatcctgctgattctatttctctagagaatcccaattaatagaaacagtaatgtagaaaagagatgatggtggcttggatgagggggtagcagtggaggtgatgagaaatagttacattcagggtgatttgtaggatttcctgaaagtttggattataggattgagagaaacagaagggctaagaatgaatctacagaagggcaaatgtaagatgctatagaaggcagaattagacctattttaaaaaacacatgaaatcctcagaacaaatattggaaaaagagatcctttaaaaaattgttacaaaactacaaaataactaggcccaaaatcgacagaaaatattatgaacctaaagcaaagtaaaaactctgaaactctacagaaaatcataaaacttgatgttttttaaattaaacattacatatattgaatactataaagatgtcagttctactaaaataacatataaatccagtaatcctagttacagtaacaactggattgggatatgtattagttttctagggctgctgtaatcaagtaccacaaattgggtggtttaaaacaacagagcatccatcagggagagaattggtcaaatcagagctttctagaaaggccatcccttaagagcaggtctatctcagctctagagtaagggttactctaggccattggttggcaaactgtagcacatgggtcaaatgtggcctattgccctgttatcatatagcctgtgaactaagaatgacttttacattttaatgaagaaatatatgtcacagaccatctgtgacccataaaccctggtcctttacagtaagtttaccaacccctgctggaaacctaccataaaaaatcttaaaaacaaactcaaaagcaccaagctaatccacaaataaatgaactaactacctgccagaacaaaattcaacactctctgaagcgaacaaaatctaaaatccagacactcagccgtatcacatttacaatgtccagcatacgctcaaaacttaatagatgaattcactagagaataagtttcagacaaccaaaatgaccaaagagacactgacaaaagacatatggaaagctcacactggccaaacttagaacagtgtacgcatcatagggaataataattgcagggagtaaaacatgtctatgaagttcataatgatctttacaaaaacaccatttggccacttctagaggatgctcaaaaaccaatgtattctcctgatgacagataaagggaaataacaaagcacagtagataactagtaccatctctatatcaaataatcaaactaataaatgatgaggaaattgtagaattagaatatcatcagtttgcaaccttcagtgtattaatgaatccaggcatcacacattaaaagttgctaaaatcacagagaacaccagactttggcatgcctctttatgaatgaacagaatcccacctatcatcttaccaaagagaaagaactggagtctgatcaggcctctaaatcctgttgcttattaacaggaaatatacagaacacaggaacattttgaactgcagcaaaagtaggtaatcagtgaatccatgcggggtctacaggtgaaatgcttcggctcttgaacagctagactataaggaaaaatgacccattaagataaaaggagacaaaaagactttaaaaaaatccaacaaaacaaaactaaactgcagtgtctgaaggatgcacatttagtgttgaaacaataaaagaatctagcagctgaatgcacatggtttttaaacttgtggaacatggacaaaaattgaccacacatggggcagaaaagcaagcttcaacaaatgtcaaaagtttgaaacagaaaatgtatggtttctgacaaccgtataattaagctaggactatataacaaaaagatactagaaaacctatgttcacaaattaatatccttctaagtaacctatgaatcaaagaagaaataatcaatattagaaaataatttgaacggaatgatattaaaactaataggatacaagtcaagctgtgtttagagggaatttatagccctgagagcatttattagagaagtaaagctgaaaattaatgacctaagcattcatctcaagaatttagaaaaagaactgcaaattaaatcttcagaaaagagaaaaaaaaggaataataaagacagaaagcaatgaaataaaatttcaaaatacaataaaaagggaaaaacaattcattgataattaataaaactggcaaatctgaggtaagattgatgaagaaagcaaactgcaggcatagataactactatcagaaatggaaaggaggtatcacttctcctacaggcattagaaagctaataagaggatattatcaacaaatttataggaatacatttgaaaatttagataaaatggaggattgcttagaaaaatacaacccaccaaaactgacacaagaagaagaaatactgaatttgaatatattgtaactattaaagaaactgaatcataattcagcaccttccatgaaataaaatcctacagccagatgacttcaacagtgaattaattctaatgaccatttaaggaagagatactaccagtcttacatgaactcttccagaaaatagaaaaagaactattcactgtgttttctaaaggcagcataatcttagtaccaacctctgataagacctttcatgaaggaaaatgatatgaaccatctctctcatgaacataaatgcaaagatcctaaacaaaactttaacaaacgtgacttgaaagtgaaaaaaagaaaaaagaagagtaatgtccatggaaataaactagaagtacataaaaatgataacacaccatgaccacataaggttggatccaggaagcttggtctatccataacaggttgaagaaatattttatgattatgtgacagatgaagaaaattacagaactgtgttcaacaagtattcatgttaaaaaaactcttagcatacttggtttaggagttttggctacagcttactggtgtttaacaaactccttcggcctcagcagctgaaaaccactttcctatggtcatgaggtctgtgggtcaggaattctccaggcacagtggagatggcttgtgtctgctccatgatgtctgggcctctgctggaaagacgcagtggtggagatgaactgctgcctcttcagcgtcaccttttacctaccactcagccccaggtcacgtggctgcagcacactggcttcttgactgttccttcaactcaccagccaggctccagcatcacagaccttacttgctcttccttctgtctggggccttcttaactagacatccacctggctggacattcttctttctcaagtcacttctcagtgggatttctctggcctccctatgaaaaatcaaaatccccatcctgtgcccactgaccctctctggccccctttctgcctgtaattatcactttataatatataatatagttaacttatttaactatacttttattctatgtcttccctcatgaggatgtaagcttcatgaggcaggtatattttgtctaattttattcattgctgtatccccagagcctagtatataataaagcacacaaacattagctgttgattaaatggatgggtaggtagatggatgagtaggtgggggatggatggatggatgaatggatgggtggatgggtaggtgaatggatgagtaggtgggtgggtgggtagatggatgggtgggtggatgaatggatggatggatggctaggtgggtgggtggatggatggatgtgtggatggatgtatgggtgaatgggtagatagatggatagatgaatgggtaggtgggtggacagatggatgggtaaatgaatggatgggtgggtgagtggataaatggatgaatgggtaggtgagtaaatggatggataatggatggatggatggatggatggatggatggatggatgggtaggtaggtgggtgggtgggtgtacagatggataagtggatggagaaatggatggatggatggatggacggatgaatgggtagacagatgaatcggtaggtgggtagatggatggatggatggatggatggatggatggatgatggatggatgggtgggagggtgggtaaatgcatggatggatggatggatagatagatggataaatggatggatggatggatggatggatggatggatgagtggatgggatggatggatgttgaggcatggcatcaccaatggtagataatcactgggttaaaatggaatatatgttgctattaggaagaatgaattaaaactctatgtgttgttatgaacaattaccaagatttattatgagaaggaagcgaggtacagaacatagtcttttttttcttttgagatggagtctcgctctgtcagccaggccggagtgcagtggtgcgatctcggctcactgcaacctccacctcccgggttcacaccattctcctgcctcagcctcccgagtagctgggactacaggcacctgccaccatgcccggctaattttttgtatttttagtagagacggggtttcaccatgttagccagacagtctcgatctcttgacctcgtgatctgcctgcctgggcctcccaaagtgctgggattacaggcatgagccactgtgcccgaacagaacatagtcttaatatgctccttttatttccatttaaaaaataatttctatacaggtaaatatgtgtggatatgcatcatcagtgttttctgaaagaagtaaaaaacactattcataatggaagttctagggagaaggactgaaatacaggtgggaaggatgccttacttttccatttagcacttttctgcaaagtttggattttctaaccatgctactcatatttttattttaaaatatcaacaggagttttttgacagtatgatcatggactatttaaaacagtttttctttacaattcttgctacctaaaataatacttgttataaaataaaaaataagggtaattttatttaacagaatcgagaaaagcaatgctagtttttaaggacttccttgaatcactgagaggtcttcttttgtcacataaggattagataatgttcaatattttctatctgctaaggcagaagtacttttacttatgcatgtccttagagttttcagtaacaaaaatttcagataatcagagcactttgttctctacaccgtctgcttttctgtgattttacggtaataggcagtataacagagttgacagaaaaacacttagtaaataaatatggtttaaaactttttatactaagttttatgtctgattctgtgtctccagatactacctttgactaaggagaggcatggttgtacgttcaatgatggctccctgggaatgacccaatggaagtagcattttggaaaccctggttctgtaatctgaacgttgtggcccatgagattaacatatagaaacctaattcccagtgtgatagtattaagaggtgaggtctttggaaagtgattaaatcatgagggcgtaaccttaatgaatggaattagtgtccttataaaagaggctccagagaacttcccagccccttccaccatgtgaggacacagcgaggaggtaccatctatgaagcagaaggtgagcccttgccagacaccaaatctgcttgtgccttcatgttggacttctaaccctcctgaactgtgagcaataaatgtctatggtttgtaagttacccagcctatggtattttgttatagcagcctgaacaaactaagacacccggggtctttgtttgttaactatgcatattgaagctctaaacccatgcccatttccctgtttttttcatttttgatgtttgctcagtttgtggcccattttcactcttcatcttcatattgcaaatatctgatatgacagtcgagtggaagcttctcttccaataagaccatgtaacaaaaatggaaaaccaaaactattctgaaaaaagccatttaaaaaatgcataccaagattttaaaaaaattcctgttaaatttatcatgagtccaagctgttcattcaacttatcgtcttggtatttgatacaaaaaatccccattcactgactttttaaaaagtagaatgatgctggtgagttaaggaggtatagagtcccatgttttaaaggaagatgcagctcactcacactgcagcaatatcctttgccggctgaagcaaaataaaaatcagttctactgaaagttgataaagtttaagtccattaacagcgagagtactttatattagatttgcaaatgaatgagaaattaatggagaaaagagctctcacaatagcttcaaaatgggcatatttataaccctattctgcttgccaaaaataattacatcccatttttttctgccaaccatttaaactcatttcatagaaaacggaaaaagagggttggtgcaaatgggatgtttcccgcaagaaagaagaacggttttggaacccttgagcaatttgcaaggcgtgtcaattttggaacgctctgtcttgaaatattcgctttttttatgtttatttgtttacctattgtttattctccaaatcaattacacaacatttatttccaaatgccacaataatggaagactggcatcacatttggaattgattctaatgctgcacagccgcctgctgaggatcctgatccggttcatgagctgaggctgatcccagcgaccccagacctgaccaactctgcattacccagggaggagcaggccagtctgagcagactcaaaggggccgcttctactcggagccactttgcatccactccaccctaagcttctaagatacttcggagcccacacgacactccttcacaggggctgggtggcctggcctgccacttgaaatatggggctgctggcacctgctgtatccttctcagccccaggcatagctgctgaaaaggtgacaggaagagtctattttcatgtcatcacttagtttgtatttgtttgcagctatttcagccttttacatttgtattatgcattctgaacaagttgctatttgttttcttagttgatgtagtcagctgcacagaaatgcttaatgcttttctcagatgattccaaccaaactgactttgatttcagacagatagcccatggccatgctgacacataaaaccaaccatgacactgggttttttttcagccttttattttttttttaggtttagggacacatgttataggggtactttttttaggtttaggggtacactgtcatagagctaaatggcatgttgttgggggttgttgtgcaggttattttgtcacccaggtgattaagcacagtacccgacaggtagtgttttgatcctaacccccctcccccaccctccaccctgaagtaggccccagtgtctattactcccttctttgtgtccatgtgtacccaatgtttagctcccatttataagtgagaacatgtggtatttggttttctgttcttgcattaatttgcttaggataatggcctccagttccatctatgttgctgcaaaggacatgatctcattctttcttacggctgcatagtattccatggtttatatgtaccacattttctttcttttttctttatttttgagatggagtctcactctgtcacccaggccggaatgcagtggcgtgatctcggctcactgcaacctccacctcccaggttcaggcgattctcttgcctcagcctcccaagtagctgggactacagacagctgccaccatgccctgctaatttttgtgtatttttagtagagatggggtttcaccatgttggctaggctcatcttgaacctctgacctcgggtgatctgcctgctttggcctcccaaagtgctgggattacaggtgtgagccaccgcacccggctgtatggcattttctttatcaacactccactgaaaatattgaacagatcatcgaggcagaaaactaacaaagatatttgggacctgaacttgacacctgaccaaatggacctaacagacatctacagaactctccacccaaaattaagagaatgtacattcttctcatctgcacatggcacatactctaaaactgaccacacaatcagccatgaaacaattctcaacaaatgcaaaaaaactgaaatcatagccaccacactatcagaccacagtgcaataaaaatagaaattaacactaagaaaatcactcaaaaccatacgactacatggcaaacaaccatgacactgttacagccatcttacctgttccctccttcaagacctcccttgcagcctgctctcaactcaccaaccagagtgggcctttaaaaaattaagccaggcaatgacactctctgcttaacacctcccagtggctccctacagcacacagagtaaaaggcagaggacttagattgacttacaaggccctgcagtttccttccctctcccttcctctatgatcccctctctttcctccccactgctcacttccctctagccacagggcctcctggttgctcttagaactgtcagtcccactcagggcctccgtactgactattccctctgcctcagacattgcaaggcaaactccttcacctcctcactccctcacttggctcaagagtcacatgctcaatcagctctgctgtcaccatcctatttacaatgatagtttctgcccccatcactccctcagccaactgtaccacgttctactttctaacagacgttaccatttttagtctattactatatgccttcattaggatgtgagctccatgagggctgagatcttggtctgatttgttccctgatctatctcaaatcctcaaaacagtgttaatagttgaaaagcactcaataaatattggttgaatgaacaaataaagggcttatcaaatgcaaagataaatttttcatttaaattctctgccagaatttctggttccagaagatgggcagaggacaagtcatactggagcttgcacggcacaatgagttcagaagactattctgagtgagactggaagacaaatgagaattttgaactggggagtgacatgaggtgacttacaggtttttaaaagttcatcatggcttctgtgtggtgcacaggattcaaaggcaggagtagcgccagggagagtatttcagctgccttggtccagcaagagattaaagtggttcagaccagagaagctgtgctggaggtgatgagaagtggctggaccctggatatactacgaaggcagagctaacaggtcttgttgatgcactttgctgagagggagaggaagagagggagtggcgagagtcaagggtaactgttgaagttttggcctcagaaactgagtaaatggcagtatccattactgggacagaacagaggggagaagaacagacttgggagtggaatcaagaattctgctttggatgtgttaaaatggaaatgcctaccagacatccatatggaggtgctgactggccagttggatacatgagtctggagcccaaaaaagaagctgaactaaagatagtttttaaagccatgggtctggttgaaatcccattagagagagaagctggatagagaggaagactcggggcttcgtgctgaagcacttcccctttaggaagaaaagccagcaagaggggctaaagaagcagccagtgaggtagggaagggctgagcagctctaccgaactggaagccacatggagcatgtgtttcaaatgttgctgtggggtcaggtgagaagagtctaatcactgactgcgggatttggccatatgagggccttggggccccaggcagcgctgcgataccccagtgggttgttggtgatccttcaggatgggaagcagtgcccactggggcaagtagggtggtacaggctgactgtgggaggcgcagggctcagggaaacctgagcattcagcatagacaggaacctggagtcaggatgacaaggaaaatctcctgaattgggcacaaggatccttgggggggatgaggaagaggaattgagcatgctgcatttcctaaatgtggggcattggggtgcaaggcggtgcacctgaatatgaaaggaaatagccatcctataattccagaagcttgaagacaccaagagagttacactcacagagaagaaaaaggtttgcttttctcatggaaaaggttatatgtaacaagtttaggataccacatgacaatgtcttagttttaattaacttttataattcagcacatttttaaaagcacatacttgtatttctgataatgctatgccaggtttttacacttgtttcatattttttctcaagaggaagttatagtagtgtatctaagatatactgaaaaataattggtaattttttttttttttttttttttttttttttttttttttttttggagatagagtcttgctctgccacccaggctgcagtgcagtggtgtgatcacccaggctggagtgcagtggcgtgattacccaggctggagtgcagtggcgcgatctcagctcactgcaacttccgcctacctggttcaagtggttctccaacctcagcctcctgagtagctgggactacaggcgcatgccaccatgcctgactaattttttgtacattttagtagagacagggtttcgccatgttgcccaggctggtctcaatctcctgagatcaggcaatccaccctcctcggcctcccaaaatgctgggattacaggagtgagccactgcacccagctggcaaatattcttttttatttttaagttcatttgccaagaactcaattatttatagtggtacttctctctagctttctgtaactaaatgagaacattaatttcaaatgtatctctctactaaaatcatacagggtgttctatccttccttttatacaaaaaaaattgacaattatctgacgaaataggaaaatttgaacagccatgttttaaaagctgatcatgtcatgcttcagctaacataaaaaaaaaaaacctgaagtcaaaataaacgtttaaataacctgaacatgctgataattgacattgctttctatcataatcatcactttaacactgaaagatgaagaacttgctagtggtttaaggtagatcaggcattggatacagatccttcccattggtgtttactatccaactgcaagagatattggatgaaatatgaacatagcaaaacatttaaaaaggagaaattagatttagagaaaaaactaacttacctattgctatggactaaagtgtgccctctccattcatatgttgaagccttaaccaccaatgtgactatatttagagatagggtctttagtaggtacttcaggctaactaagatcacaagggtagggtcctgacccacaaggattggtggccttagaaaagaagaaagagacagagacctctctctctctacctgcacacacatggagaaaaggctatgtaaagacacagtgggaaggcggccgtctgcaagacaggaagcaagtcctcacgagaaccagaccatgctgccactttaatcttggactttccagcctccagaactgagaaaaactaaatttttgtgtttaatccacccagtttacattattttgttatgacaccccaagatgactaaaatacctattaatgagtttttaaaaaattattttagaagagaaacaatatgttgggttgtaatgtcaacaaataagtaataatgtgtttatatatttctatgatttttctgagagagaaaaattttaaattgagtaaatttctccccctaggatgcctgtctacagattacttcttccataaactctgacctcaacaattactcctaacaggaattcgaactgtcttgatgcttgaccagcctggccaacacagtgaaaccccgtctctactaaaaatacaaaaattagccgggtgtggtggctcacgcctgtaatctcagctaatcagcaggctgaggcaggagaattgcttaagccagggaggtggaggttgcagcaagtggagatcatgccactgcactccagcctggctgacagagactctgtctgaaaaaaaagaaaaaaggaaagcgtggtgacttgttttagacactttcactactgataatgacagttcacaggaccaggcaaagcagagactcggcacagtgccacagggagaccctgtcctgggcgccgagtggacctgcccctgagtcagctgcctccccttaccagcggtgcggccctagcgctcactgcatttcctcccacccctagtttcttcctcagcaacacagggataggagctcccttgcaggtgactggaggcagtgaatggtccacatatataaagcagctgcagtggtaccttgcacataacaggaattatttttagaatgacgttgaagatgttcagaatacccaaccccaacatatggagctctggcatactgttttcagttaaagacccttgaaaaacagcagaggcaagaaggacattctaatcaccccttttcttcctgaaaataggagataaacattgccatgtgaaagatgtcctccctcaccaggagaatgaaacattcttcgatggggaggaagagccaagagaccctgtgaaatgattcttactccttcagcctccccacacagtgtacctgtccccagctgcctctctttgtccatcttggtataaaagcatttgtgttttgctacttctctgggtcttcatttccttatgagggctcctgagtcacataaaacatatataaattggtgtgctttttcctattaatctgtcttgtgtcaatttaattcacaggcccagctgaaaaccctaggagattagaggtgaaattctgtctcccctataattgaatgtattataacacaaaaatatactcagaaagaagtcattaatttgagtatagtgataatgatagctatcagagtaatcccttttaaaatagtttcagttcctgtaataccaaggcccactcacatgttgtagtattgttaccactgtcgcggtaattagtttccatgacacaaaatcacctcacttgctttcccacagaggcagcaatatgctaaaagagcagactctagaccaggtctcccggggtccaagtcaagtgtgtgttgatgaccttccctgaaccctggctttcttctctatagaaagtgctcagtgggccaagcacggtggctcacgcatgtaattccagcactttgggaggacaaggcaggtggatcacttgaggtcaggagtttgagaccagcatggccagcacggccgacatggcaaaaccccgtttctactaaaaatacaaaaaattagtcgtgtgtggtgctggcatctgtaatctcagctacttgggaggctgatgcaggagaattactcgaacccgggaggcagaggttgcagtgagctgagatcatgccactgcactccagcctgggagacagagtaagactctgtctcaaaaaaaaaaaaaaagtgctcagtggtaatgcctatcccataggacgactgtgagattttgaacaataacatatgtcatgcctgtgcttgaagcctggcatgcatggccctcaggaaatgtgtacactgacctgggcataggactgagactgtcagagggaaacacggggcctgggagtagaccctgcatgctccgagggtctgcttccatgtgacgtggactgaaggtccctctcctgattcttcatgagatgagccagacaaacatcttatgagtgtcaccagcagcaatcaagacaggaagaaaggggcatcatgtcctgtcatgaactagaaagggggggcaggacagaaataagtggagaaaaggagatcctgaaggttccatgtcctccccagccctcacctatgtgagcacaggtgagcagacagaagctgagaattcgcactaataccttcaagtctggggtgatggggtctgagttgggtgcaggtagttctaggacaattttttaaaatctctttaaaacagaagctcctacgcagcaactcaggagctcaaccaagaaagaaagggccaggactgagggacggatgacgctcactggagcagaactgccctggctcggtcaaggggacatctctagggaggtcctcagagggaagagcaagaacccaagacctagcaaggatgtgctcagcccctgggggatctccccaccctgtcctaagttagacagtcaaggccaaaggcaacatccatgtctgaaatggagcctctgacaggagaagagaaactggccctggtgggtctgaaggctgtcggggcagggaagaattgtccgggccaagcccaggagcacaaggagagtgggtacatcaaggtgcatggaagcacaccacagcttatttggcaaacagaaggtcagcagaaacagagcttgaaaatggggaaagaaacatcaacccagacgccaaagctccccacaagaacttcatggaacctaatacacacataaacttaacaaaggaaggactcaaagtgagaaaaacaagactatgatgaaaagaaagctagagacagaactaaggaaaccaattacagcgtgagaattaaaaccccatcactgcaaatctagtaaataatttagaaacagcaaggaacagagtagacatgagtgaaaattcaagataatggcatgggggaaggtgtgagatctccacagtaattttgtagaagaaggaagagacaaattacaatgaagaggacccgtaaggagattgggaatttttttttttaactctagaaacaaatgtgctttgtgatgagagacctgtaatctaaaatttagtattctctcttcagtttcatttcaattctcctgttaatttcaaacaaagacaattttttaaaacatacacattattcttccatagcttgtgtcttgtatcattatatgatcgatagatttctgaatttatgaccacataacagtctgatcgtttctggatggtatacttctgggtaattcattgcctttgctgttgtacttttctgtatttgcttaaataatttatgagagacatgcattgttttttatttttaaaagtataatcttggccagatatggtggctcacacgggtaatcccaacattttgggagggcgaggtgggcggatcacttgagatcaggagttccagcccagcctggccaacatggcgaaaccctgtctctactaaaaatacaaaaattagcagggtgtggtggtgcacatctgtaatcccagctactcaggaggctgaggcaggagagtcgctacaacctgggtggtagaggttgcagtgagctgagatcgtgccactgcactccagcctgggtgaccgagtgagactccatcccccccccaaaaaaaagtatgatctttaaagggaagaaaatccactcaacattctttcaataagtagatattacacactatattgtaggcactgggattatgagctaggccaagaccttgcccagcttccagataaagtcatggaggttatagattcaggaagacaaacattactccaaatacagttcattccagaaatgcaagagtgattcagcattagcatatagtccatcctgttaacagagctaaagagaaaaattatatgatcatctctacagatgcaccaaaggtatgtgaaaaaatcagcattcattcctatgagaaacaacaaaacagaaactgagggataggataaagtcatgcctaacaagatagaaaatacatatttatgcaacacatacctaacctcaaaagccagcatcttaattaacaaagaaaaactaacttttcctgctacagtctggaacaagacaagcactcactctttaacactgggtctgaagtattagcccatgtacttagacaagagaaatcaactgtagaaataacattcatgaaagaagaagttaaaattatctttatttgcagagcatatgtttatgtactcacatgtggaaaaacaaaagaatccccacaaaacaagcaccaaaaaaaaaaaagaaagaaaatctaataagaaagctggttgtataataaatataggcataccttgttttattgttcttcactttatcatgcttcacagatgttgagtttttttacggattgaaggtttgtggcagccctatattgagtaagtctatgagcaacatttttccaacatcatgtgcttactttgtctctgagtcatattttggtaattctcagtacatttcaaactttttcattattactatatctgatatagtggcctgtgatcagtgacccttgaagatactattataattgttttggggctccatgaactgtgcccatataaggcagtgaacttaactgagaaatgcatgtgttctgattgcttcataggctggccgttcccctgcctatctgttccctgagacacaacaatattgaaattaagccaattaataactctacaatggtctctaaatgttcaagtgaaaggaagggtcacacgtttctcattttaaatccaaagctagaagtgattaagcttagtgaggaaggcatgttaaaagacaagagcagccaaaagctaggcctcttgcaccagttagcaagttgtgaatgcaaaggaaaagttctcgaaggaaattaaaagtgctactccagtgaacacacgaatgatcaagaaaacagccttatcgctgatttggagaaactatgagtggtctaacagaagatcaaaccagacacaacattcccttaagccaaaatctgatccacagcaaggcccgaactctcttcagttcaattcaatgaggatgagagaggtgaggaagctgcagatgagaatttgaagctaacagaggttggttcctgaagtttaagaagctgaggcagcaaatgctgataacctgcaagtccagaagatccagctaagataactgatgaaggtggatacatgaaacaacagattttcagtgtagacaaaacagccttatactggaagaagatgccatctaggactttcatagctaaagagggaaagatgacgcctggcttcaaagcttcaaaggacagactgactctcttgctaggagctaatgcagctggtcacttaaagttgaagccaatactcaaccattctgaaagtcccatggcccttaagaattatgctaaatctatttcacctgtgcactagaactagcccaacaaagcctggatgacaacatatctgtttaaagcatggtttacttaatatttcaagcccactattgagacctaacgctcagaaaaaaaatatgcctttcaaagtattactgtttattgacaatacacctaagagccctgatggagatgtacaagaaggttaatgtcatttttctgccagccaatacatctactctgcagcccacgggtcagggagtaactcactttcaagtcttattatttaagaaatgcatttcacaaagctagagatgccatacatagtgatcctgtaataaatctgggtggagtaaattgacaaccttctggaaaggattcaccattctaggtgccattaagaacatttgtgattcatgggaggaggtcaaaatagctacattaacaggagtttggaagaagttgattccaatcctcacaggtgaccttgaggttttcaaaatttccgtggaggaagtaatcacagatgtggtaggaacagcaggagaattagaattagaagtggagcctaaagatgtggctaaattgttgcaatctcatgagaaaactttaatggacaagcagctgcttcttatggatgagcaaagaaagttgtttcttgagatggaatctactcttggtgaagatactgcagacattattgaaatgacaacaaagggtttagaatatgatataaacttagttcataaagcagcagcagggttagaggactgactcaaattttgaaaaaagctctactgtgggtaaaacgctatcaaacagcattgcatgctacggacaaatcttttgtaaaaggaagagccaatcaatgcagcaaacttcatcactgtcttattttcagaaattgccacagccaccccaaccttcagcaaccaccaccaattagtcagcagccatcagcatctaggcaagaccctccaccagcaaacagatgacaacttgctgaaggctcagatgactgttagcatttttgagcaataaagtatttttaatcaaggtatatgtataatttttttagacatatgctgtggcacacttaataggcaacagtataatgtaatcatagttttatatgtactgggaaactaaaaaattggtgacttgctttattgtgatattcgctttattgcactggtctggaactaaacctgcaatatctctgaattatgtctgtatacaaaaatcaataatgtttatccataacatagataaacagttagaaaatgtaatagaaggccaggtgcagtggctaatgtctgtaatcccagcactttgggaggccgaggcgggtggatcgcttgagctcaggagtttgagacgatcctgggcaacatggtgaaaccccgcctctaccaaaaatacaaaaattagccaggtgtggtggtgcacacctgtagtcccagctacttgggaggctgaggcaggagaattgtttgagcctggcaggcggaggttgcagtgagccgagatcgtgccactgcactccagcctggtgacagagcgagactttgtctcaaaaaagaaagaaaatggtgacatgcttgtgaaagtaaagagtattttgaataaatggaaagaaatatattcttggataagaagatacaacagcaaagagatgttaattctcctaaagttaatctataaatttaatgccatattgattaaaaaaaatcatcattgtctcctagaagctaggcaaactgattatatagttcttggaagaacaactaagcaagaatcacaaaggaaactccataaaagatcaataaggaaggctagcccttccagatattaaaatgtatttaaagcccccctcttggccgatgaattgacagaccaataaaataaaacggaaatatccagaaacaaacacatttgtctatggtaatttagtatatgacaaaggggtcatttaaaataattgagggaaacatacacttttcataagtagtactgataaatccagatgggatggccatatggaaaaagaaaaatacacatctgtttctcaccagttatatcagaactgattccaaatagattagaaacttaaatggagacagagagaccccactttaagtattagaaaaaaacatggaattcctctctaaccggaaagttgagaaatatttcctataactcacagtccaaagtaataagggaaaaactgatgaacttaactacataaaatacaaatctttacatatgaatactaccagaagcaaataaaaaagacaaatgaaagacaaatgataaaccgcattatgcagtaaacaggaataagaaatgtctttatacactgctacagactgaccccacgcgatatcactaagttataaaaccaaaggctggaacaatgtgcaaggtaggcacacgtacatgcagtatgtgtacagcacatgtgcttgcttataatttagaaatgaaaggacaaagcgaaaatctaagagtagttactatagggccggggggtggggagacaaggaatacaaacaggacagaaatgataactagaattttcaggggaaaacactttactgcatagatttgactttgtaacagtaaatgtcttatataattatgaaacaaaattaaatcaaaaattaattaaaatccctaaaatcaaaagcaaaatgaaataagtgaaccagtaaaacgggcaggtgccttaaccacagagagcggtttaaactgactgtaacatatcaccatttaattgtatatctcaagtggtttatttcctgaaggataatcaagagacatgggagctctggtggcctctgctcactggggccagcaagggaaaataaagaagagagacagagagacttaagagacctaacaacccaatgcaaaaagagagaaacaggcacacagaaatttgaacatgaggtatttgatgataaaccaaattattggtatctattagttgtgatcacggcattgtgactatatcattttaaaaataaaaaataagggccaccttctcttttagaggtaggcatgtatgtattttgacacaaaataatgtgatgtctcaggcttgctttcttcatccaagggagaagtggtggggtactgatgacgcaagaatgtccaggagtggctggcagctatagctgagtaatggatgcatagggttcaatatgtcattctctttacttgtgtatatagttgagatatccacaatgtaaatgtcgaaaaatatgaaaatatgggttcagataataactctgctacttagtcacacagccagtttgtaaaaatttcctatgttttgggaacctgaattccttccttttaaaaagaagacacataaacctaagttacaagacaaattagtatatgataaagaggtcacttaaaatcactgggggaaacaaatattacaaatttgttttattacatattacaaagcctgtcatatagcagaactaaacaaaggccagttattttttattttggtatgaatttaactatgccaaattactaaaaatattttcctaaacatcacatcaaagtaagatttcacatggagttttaaagaggaaataaagaatgaagccttttggttttataattacacaaaatagcaatactagaatagaactaaatttatgcccaaatgtattcctcaattagtgcccaattcaaataccagatacaatgatgttattctgagtaacacccataaaactacatataactattaccataaataacatttaatttgtgggaccgcagttgctaagcctgctgtacctaaaactttgctgacatattctgcctactgtttcataaaaaacacacagtaatcagattaggtcaattagaaagctacaggcaaaacattgttccctttcaaatgtcctggtaaatagaataattttaaaatgaagaaatatttgaatcaaaatagtcaggaacagacctcaaagcattaaagaactagatctttatactctcgagagttgcattcaaagactcaatcaaattcaagttcatcacatatgcaaaacggaacacgaatctcccattaaaattatcataactgctggcttattaaaatgcttgagtgcattagacatagcatagaaaaattcaatataatatcactccaataatgtttctatattaatctagaaaacatggggaatggccctaaagcaaaaagtgctgctacaggctcatgcagaattgaacttatggctgttgaggccaacccacctcaaagaggcaaaaactgtcacagcagcaagatccagaggccttcatccgacccgggtgggatgaagagaagaattctcagcactgacccacagaaggaggcgggaggctgtggtgagatgaacagactagcgcccactctggctagctctcaaggtgagatgagggtgtggcttttgcacggtggcaatgtcgatgattttgaaacctcatgacagtgtttctgaatgtccaccgaaacatggctctcacaggcaacaaaacactcctgattagaggtgtaaattttccgcgtttccagagagctcttcatatgttgatggaaaattcccagcaacaaacttgaaggagtaattgcaggcaggccgtgttttattgcacttcgttgcattgcactgcacagatactgcgttgttgataaattgaaggtttgtggcaaccctgcaaggtgcaagtctatcagcatcatttttctcacagcgtgtgctcacttcatgtctctctgtcggtatattttagcaatgaagtatttttaaattaaggtatgtacacttttttttttgttttttgttttttgagacggagttttgctcagtcacccaggctggagtgcagtgtcgcgatctcagctcactgcaagctccgcctcctgggttcacgccattctcctgcctcagcctcccgagtagctgggactacaggcgcctgccagcacacctggctaattttttgtatttttagtagagacggggtttcaccgtgttagccaggatggtctcgatctcctgacctcgtgatccgcccacctcggcctcccaaagtgctgagattaagggtgtgagccaccacgcccggccaaattaaggtatgtacactttttaaagatacaatgctactgcacacctactagactacagcttagtgtaatcgtaactttgatatgctctgggaaaccaaaggatgtgtgtgacttgctttattgtgataaccgtcttattgcaatagtctgcaacagaacccacaagctctccaaggtaggcttatacattttcctattggttggcttagtgcaaaagatgaacccaaactggcaaagattaggtagaaaccagtttctgcaaactgaatgctccctttctccaggaacatctaccatcacatagccatttcctctacaaaactgttaccaaagagaagccaatttgtttacagtcatatgtaaaattaaaagcaacgattaactgtataccacctaaagtacctactctattcaaaacaaagctatgaaaagtaagaacatctcattttgccatctgcactgcatactcaaaccaaggcagagccctgagaggaagtgccagggagaccctcacaaccgccatgggtactgaagacacgagaaatagttaatggcaggccacttcttacttcacttcagatgaacggaaatctgaaggcttccatgttctataaactcttgggttttcacattagagaccagtggagagaaagagaaagtgcaagccagacccctgctttaaagcactgaccattcttttggaacaagaagctcagacagccccagtttcctctgaagtagcacaagtcaatgcaggctgagtgaacagaggtcctgggttgttcaagtgccatctaattccctattgaaattcactgctgccatcagtccaatggcagagcatctgtgcccctggactagggaagcggagatgcccagatttctgacacataaaccactgggtgagaaattcatctggaataacaaatttatctttaaaaagccaaacaaggacatccagtttcagttccaacacgtaaaaagcttggagttgtcactcccatccttatgataagaaaaaagctgaacaaacagaaactcagcaacctttcttggacccctcagagagctgaggttgcagaacaaactgccactgggaaatctgaagagatgggaatgcacagggtcccggctgagatctgctcacctagagatgctgctgggccagcccccagttggagcctccaaacgttaattctgacaaattgctggaggctgagggtggaccagcctccaagtgagactgctggggctgcagttttagggggacaccctacacttttgtgtgttttgcctctgagaacatcaccagattctcagggttaagagccctgatggctgtagcaggggagggaaaggctagtcctagtgacaaatgaacagaaccttctccataacaaaggcctgctctccaacacagtattccatctgggggaaggcgttttcctgaccccatgcccgtgcagccttcctgtctcacctaaggcaggaataaaaggctagaaacgcttgttaaggtgatagcccagagatacaggcccactaaaagactgaaatttcatcatcagagtaaaacacaccacacacacaccttcccaccacagcaacagggctgcagtataactaccacaaattacagttgaaggagctgctagacacaagaaagcattcttagggaaatccaaagacaagaaaaggacaaaaacaagagaaataggtgaatttgaaccctctggcacctacagctacagcaaatattaagagcctaataacagccatattaatataaaacctcacaggtaaggcctgtttcctttaattcttattatctgatacactatatttggttttcagcaaaaaattagaaggcatggtaaaaggcaaggaaaaaagtctgaggagacagagcaagcaacagaaccagactgagacacagcagagaatttggaaggactaaatggggtatttaaaaccactgtgatgaatatgctaagggctgcaatgggaaaaatggacaaatatgcaagaacagatgggtggtataagcagagatggaacgtctgagaaaaaatcaaagaaaatgctagaaatcaaaaacactgtaacagaaatgaaaattgcctttgatgggctcataagtagaccagacacagctgaggaaagaaacagtgagcttgaagataggtcaacacaaatgtcccaaactaaagtgcaagaaagaatgagaaaaaataaaaataaaataaccaccataaaacactcaagaacagttgtataatttcagaaagtgtaatatatgtataacaggaatattaaaaggcaaaaagagaatggaatagatgacacatctaaagtaatataaactgataaactttccaaatgtaatttaataatgataaattaaattacatttattttatttaataaaataagctgatagctttccaaacagaccccaaaccagagatcaaagaagcttggagaacccaaacaggataactatcaaaaactctacgctgaggcatctcattcaaagtgcagaaagccaaagtccaagagaagatctagaaagaaaccagagaaaaaaataacaccttaccatagatgaacaaatataagaattacagtcgatttatcatcaaaaggcaagcatgaagagcgtggagtatttaaagtgatgaaagaagaaatcccaccaacctagacatgtatatccagcaaaattatcccataaaagtgaaaaagaggctgggcgcggtggctcatgcctgtaatcccagcactttgggaggccaaggcgggtggatcacaaggtcaggagttcgagaccagcctggccaagatggtggaatcccatctcaacaaacaaacaaaaaaattagctgggcatggtggcgggcacctataatcccaggtactcgggaggctgaggcaggagaattgcttgaacccaggaggtggaggttgcagtgagctgagatgatgccactgtactccagcctgggtgacaagagtgagactctgtctcaaaaaaaaaaaaagaaaaaaaaaagtgaaaaagaaataaagactttttcggagaaaggaaaatgcaggaaatgtgtcaccagcaaagtgacctgcaaaaaatgttaaaagtagttctttgcaatgagaacatatggacacagggaggggaacaacacacactggggcctgtttgggggagtgggcggggagggagagcattaggaaacatcactaatgaatgctgggcttaatacctaggtgatggattgataggtgcagcaaaccactatggcacacgtttacccatgtaaccaacctgcacatcctgcacatgtaccccagaactaaaaattaaaatttaaatttaaaaaaaaggagttctttgaagaaaggaaaatgaaataggtcagaaactcagatctacacaaggaaagaaaagagctttgaagaaggaataaatgaaggtaaaataaagtcttatttttcttatttttttaaaaatttgaatataaacttattttttaattgacaaacttatatatatgtattatgcacatcatgttgttttgaaatacgcatacattgttgaggggttaaactgagctaattaacacatgcactgcctcacatacttattttttgtgttaagaacacttaaaatatattctattggcaattttcaagaatacactacattgttattacctatagtcaccacattgtgcagtagatctcctgaacttatcccttttatctaagataaattttttatcccctgaccaacatctcctcaaccactcatatattttcttattcttaattgatctaaaagataactgtttgcttaaagtaatatgaaagaaaaataaatcccgggaccctaattcactatggcaaagggaaaaattaagttggaagctgagtcacacaagaagctgcctttccttttgttgcccagcagacagctaaagataaaaggccagacagaggccagctgtctccacgagtgctgctctgtgtttactttatcttgtgtaaagtgtcgacttgctgagcactagatgaatatataatcgattatttctatgtctcctccttttcacgtgcaacacgtggattcagtgatgtgaccacacccaccctccttcccttcctgcccacttttcccctttaaatactgaagacctcaaaatcctcttgggaaaaagtaagatcacagattgttcctgtggttttgtgttcctttttcccggatgcatccttaaccttggttaaataaacctctaaattgcttgagacctgtctcagatacctttcggtttacggtaataatagtcaacatctattgagtgattatagcatatggataaatgcaatgaatgatagcaatgtcataagaaatggaagaaggaaacagagaatactcatttataaggtacctgtgatactgtgaaatatttggtcttgacctctttttttggcaaacaattcctaaaatccttggaatccccaaagtccttttgctaatgatgctaatgttaactgacagcttcaggatggggttgctcactggaaagacagaggcaggattagagggttgggactttcagcccaatcccccaaccccagggagtggagagggcctgaaggctaagttgatcaccaatagccagtggtttaatcaatcatgcctacacaatgaagcctcgataaaaacccaagaggaccgggttcagagagcttcctgatagctgaacacacggaggttcctggagggtggcgtcctgaagtgggcatggaacccaagtacaccttcctcctatcttaccctatacatctcctcatcggtgtcctttctaatatcctttataacaaaccagtaaatgttaagtgtttccctgagttctgtgagctgctccagcaaattaatcaaacccaaagagaaggctgtgggaaccccaaatgaaagctgattggtcagaagtcctagaggcctggacttaggactagtgttgggagagggggcagccatgggttccaggctctgcaccagtgaggtctgaggttatttccaagtagaagatgttaaaattaaattagagaataagcatctggtggccactccctgctgtgtggggaaaacccccacaatttaggtcacagaaggttctgtgttgattatcgttgtgctgtgagagcagaggaaaaacacagtttgagaaattttttcccaaacagtacctattctagatatgaaccagtattgtgttatttgagagtgaatatagagtagttgaaaatgtagagtgaaaactctagggcaaccactaaaataatttgtaaaagaagtgtaattgatatgctaaaagaggagataaaatggattcattaaaaatgctctattcaaaccagaaagggcagggaaaaaaagggaaagaagtgaacaacaacaaaaaatgttacaaacatagtagaattttttttttttaatacagggtctcattctgtggcccaggctagagtgcagtggcacgatcattgttcactgcagccccaaccttcctgagctcaagtgaccttcccatcttagcctcctgagtagctgagactacaggcacacatctagctatttttttatttttattattattattttttagagcctggtcttgaactcttgggatcaagcaattggcctaccttggcctcccaaagtgctaggattacaggcatgagccactgtgcccaaccatgtagatatttttaactacatcaatccaactgtgcaataatcactttaaagtaaataacctaaatatcccaattaaaagacagaaactatcagagtagataaaataaaaagccaactatatgtagtctacaaaaaatccactttatatataaagactcagattagaagtgaagggatgaagaaagttatagtgtgctatgctaatcaaaaggaagttggagtaccaatattagtttcagagaaagcagactttaggacaagggaaattatcagaggtcaatacgagcatccatagtgatataaaggtcagtttccaagaagacataacaatccttaacatgtatgcacctaaaaacagagcgtcaaaatacatgaggcaaaaactgacagaactgaaaggaaaaatggacaaatgtactattatagttgaagacttcaacattttcttcttagtaattgatacatcatcaacatctatagactacatccaacaacagcagaatacacattcttctcaagctcacagggaacattcaccaagactgaccacattcttggccagagaacacacgtagacaaatttaaaagaactgaaatcatacaaagtatgctcttagaccacagtagaatgaaactagaaatcactaacagaaaaagatggaaattcccaaatacttggagattttaaaacacatttctaaatagcatatggttgaaagaagtctcaagtgaaatgaaaatatactttgaactaaatgaaaatgaaaatacaacttatcactattgtgtatagcaaaagccatactcaaggagaatttgcagcactaaatgcctataacagaaaagaagaaacgtttataaccaataatataagcgtgtaccttaggaaactagagagagaagagcaatccaagcataaagcaaacagaagaaagaaaatactaaaaattaaggcagaaatctgaatagaaaattgaaaaataatagagaaaattagactcagaaaaaaggatacacaaattattaatatcagaaataaattaagggattaccaatattaatccatggacattaaaatgataacaaaggaactctatacctctaaatttgacaaattagaaaaaggactaattccttgaaacatacaaatgaccaaaactcatacaaggagaactagatcgtctgaacaggtttaaagctactaaagaaactgaatcaataattaacgatattccaaaaaagaaagcagcaggcccaggtgatttcactgacgaatcctactaaacactgatggaaaaaatagtatcagttttctgcaatttcttctacaaaacagaagcagagggaacgcttcctaatttattctatgaggccagcattaccctaatgccaaaaccagatacatagagcataaaaaagggaaactacagaccaagatctctcatggacataaagttctcaacaaaatattagcaagactaaaaatgtatgaaaagaattatatacttcaacccaatgggatttattataagtatgcaagactggtacaatatttgaaaatcagtcaatgcaatataccacatcaacaggctaatgaggaaaaatcatatcacatcaattgatgcagaaaatgcatctggcaaaatctaacactcatttatgaaagaaaattctctacaaactaagaacaaagatgatcttcctcaacttgataaaaagtgtttataaaaagctaacatcacacctaataatgaaatactgcacactttcccccaaaaaagaacaaggcaaggatatcctctctcactacttctgttcaacatcatattagaagtcctagctagtgcaataagacaagaaaaggaaataaaaggtacatagattgaaaagtcagaaataaaactgtctttgttcataaatgatatgattgttcatgtacaaaatcccaaagaactgtcaagaaactctcaaactaataagctagcataggtcacaggatacaatattaatatacaaaagtcaattgctttcccatattccagcaatgaaaaattggaatttgaaatttaaaatgtaccattaaacactgcaccaagaaaacgaaatacttaggtataaatctgacaaaatatgtataagaactatatgtagaaaactagaaaactcaaatgaaagagttcaaagattacctaaataaatatagagatattccatgttcatggacagaaagacaatattgttaatatgtcaattcttctcaactagatctataaatccaatgcaaccctaatcaaaatccaaaaactattttgtagataaaagctgattctcaaacttatatgaagaggccaaagacctagaatagccaacaaaatgctaaaggagaagaaaaaagaagttgaagcactcacaatacccaatttaaagatttacaataaaaatagtataaacaagtcaacatggtattggcaaaagaacagacaaagagatcaatttaatggaattgagaacccagaaataaagcccataaatatagttaactgatctttgaaatatcaacaaagtcattcaatggaaaaaagagaagatttttcaacaaatggtgctggaaaaattggacatctatatgcaaaaaaaaagaaacctagacataaaacttacaccttactcaaaaaattatatcaaaagggatcatgcacctaaatgtaaaatgcagaactataaaagttctttaagaaaacacagaatatcttggtgatttggggtttggttcaaagacactgttaagagaagaaaaagagaagtcacagactgaaagaaaatatttgtaaaacacatatctgataaagaatttgtatccaaaatgtataaagaaaagtaaaactcaacaataagaaaacaaaatgtctaactttaaaagaaggtggctgggcgcggtggctcaagcctgtaatcccagcactttactttgggaggccgaggtgggaggatcacgagattaggaggttgagactatcctggctaacacagtgaaaccccgtctctactaaaaatacaaaaaaattagccaggtgtgctagcgggcgcctgtagtcccagctgctcaggaggctgaggcaggagaatggcgtgaacccgggaggtagagcttgcagtgagccgagattgcaacactgcagtccaggctgtgcgacagagcaagaccccatctcaaaaaaaaaaaaaaaagagggtaaagatctgaacaaacatcaccaaagaagatacaggaacagcaaataagcatatgacataatgttcaatatcatttgccagtaggggactgcaaattaaagcaacaataagataccattacatacctatcacaatggctaaaatccaaaaatggacagtatttgttgtcagttgctgatgaggatgcaattgctagtgaggatgcagaccaacaggaatttttatccattgcttataggaatgtaaaacagccacttaggaaaacagtttaaaagtttcttacaaaacgagacatagtcttattgtatgatccagcaatcatattcctaggtatttacataactgatttgaaaacacctgcatgtgattgtttatagcagctttatttttaattgccaaaaactgtaaacaagcaaggtatcttaaataggtgaatggataaacaaactgtggtacatctacataatgaaatgttatttggccataaaaataaatgaagaatccagccataaaacaatatggatgaatcttaatgcatattgctatgtgaaataagtgaatcttaaaaagtaacatattgcataattccaatgacatggcattctggaaagggcaaaacggtagtaatagtgaaaagatcagtaagagttcagggagagagggaaggattaaataagtgaagtccagagaatttttcagggtggtgaactatttttatgatatgtaattgtggatacatgactatgcatttgtcaaaacccattgaactgtacaggccaaagagctaatctgcagatatgctaacttttaaaaagtatttaaaaggtgggaggatctcaggatcctaattttgcaaaatgtgacaaaaaacaatctacgaaacaacctcactgaaaggggttggggggaaaaggtgctgacttaagtaactctgaaaatcatggagtctgtaatactaaaggccaaagaagctgtacatcagtgatgaactctagttgataaatttgtttcccaggtgggcagtggttaatagttctgataccactactcacgtattttgaaactgaccattaagtaaatggatggcagatggtgagaaccaggtttctcactgctggagtgggaacaggggaggaggctggactgatccacgctgtaaaggattggcattgaagacatcactatgaactcatgtttagcttaatagactattgatggttatatatagaaatagttacaggttacaggtatatacatgtgttggtatacactcatatacagtcgtcctcccttatatgtgtggaataccctattctaatacccctgtaggtgcctgaaaaaacagataatgctgaaccctatgtatactatgtgttttcctatacatacatacctttgataaaatttatcattaggcacagtaagagattaacaatgatccctaataataaaatagaacaactaggctgggcgcagtggctcacacctgtaaccccagcattttgggaggccgaggcgggtggatcacgaggtcaggggatcgagaccatcctggctaacatggtgaaaccccgtctctactaaaaaatacaaaaaattagccgggcatggtggcaggtgcctgtagtcccagctcctcgggaggctgaggcaggagaatggtgtgaacccaggaggcggaggttgcagtgagctgcgatcgcaccactgcactccagcctgggtgacagagcaaggctccgtctcaaaaaaaaaaaaaaaagtatgaattgttcatctctaaaatttgctatttaatatttttggaccatgattgaccgcacctaactgaaaccacggaaatgaaaactgcgaataaagaggaaccaatgtatttccttgttttgtcagctgagtgaacctagaagcaaaggcctctcccccacccagtaataacaagcacacctggcactgagattttggtttctaatgccaacctccaaccaaaagaaccagagctttcttggagaaatggccaatttgcccatggactagggcaggaaacatacaaaatgagccaggaacctcttgtggtgccagaaagtaagaacgtgataaaaattaataacctcacaatgatgggggtgtgtcaaaggaacacagaagccaacttttaacaataaagtaacattggattataactgtgagtataaaataaatatccatgagtccatatttctataaatacatgattgaacacacaagtaaataaatagtaaagaagggacaaatctcccaagggaaaaaattccaaatactttatgtagatactccgccctcagggaagaggaacatgattccccactccttaagtggaggctgcacatagtgacttccttccaaagaatacaatataggaaggtgggcaggtagaacttcacagtagagaaaactgccaatcactccctcagtgatcacctggctaggtgatcaagtcaacatcaacagtgatgccttactgatagtatgtccccctgatgtgatgagataagaacagtcttggccgagcgcggcagctcatgcctataatcccagcactttgggaggccaaggcaggtggatcatgaggtcaggagatggagatcatcctggccaacatggtgaaacccggcctctactaaaaatacaaaaaaaaaaaaaaaattcagccaggagtggtggcatgagcgtgtagtcccagctactcaggaggctgaggcaggagaaccgtttgaacccgggaggcagagactgcagtgagccgagatcacgccactgcactccagcctgggcgacagagcgagactctgtctcaaaaaaaataaataaataatggtctttacctctctggtcttcttcctccaaatccagtctaatcatgagaaaaacatcagagaaatcctaatagaggggcaccctacgtaacactgaccagtactgctcaacactgtcgaggtcatacgaagtgaggaaagtctatgaaaaagccacaactgtgaggagcctaaggcaacatggcgacgaaacgtgatgtggggttggatggtatcctgggagagacaaaaaacattaggtaaaaactaaggaaatatgaataaccatggactttacataatcataatgtagcgatattggctcattcattttaacaaatgcaccatagtaatgtaagatgttacaaacaaagaaactgggaattctttacactatcttggcaatttttctgttcatataaaactattctaaaggatgaactttatttaaaaatccaaatggcaatcacaacgcataaatatcacagccaaccacaccccaccccacagtaagttgcttttataaaccaacagctgctggttgctgcagaatccccagggccaggctcaggggctgtgtccccactatacccagggcaagcccctgagctgccactgccagggattcaatcccccacccaaattaatttacatgtggtgtgagttttacactgacggaatgagggcttaatgtttgcttggtgtaaaactgatgtatggaggaataattttagagcatgacttttagaaggaccaaagagggcagcttctcaatcggcagcaggtggcacgaggatcaatagctgacgtctgtgccgctggacagcaggcccgccgggaggagggaaaagcacaatggacacacatgaaggacccagtgaggactgagtgatgggctggggacacctctcatactaccctgtcatgaaggccacagtgcaacacaggagatggggaggtcaggtcagaacacctgtccggggcctctcgatgggcactaggaatctgagacgagtccttggcactgatgctcaaaacatctttcatacctccagaaattgactctcctaatccagtttcgagcaggagggactcatctatctatgtgcaactgacagaattagagggttcccttgtgacatctaaacatccccatgaactgagcatactgtatgaacactggtgcaccgatattcagcaatgacagcatgatcgttaatccaccaaccaaaaatgcaagctgagcggctgggaagacaagtcacttgcccttgcaggctccgtcttctcaccccaacaattctacttaagtaaagaaaataaagcacaaaagctttgaaaccacggctgatagtgcaggctcctcaggggaaaggcaggcacccgacagaccaagaatctggtttccacacccatcacacctgcagcactgattcaccagtgcagctgaggtgatggaagcagggaaagtctaaggggagggacaccgaatcatccccaaaaccacaacagaattttctctgtgaacctctccaacactgtcagcctgattcttctgccaggattaactgaatataaacacctaaagcataaataatccgtgtcaataatttaggtgtacagtaagataaagtgcactgctcaataggcaaaactacagacaaaagaaaatatactttaataaaatttacactagtaccagctaaacaagaggtcgaagaaagttgttaaatttctcatcgcatcctcaaagatataacaaagttaaacaggaaattacaaaaagaaggtggttttaaaattcagcaaaaaaaaagatgaaatcatcgtgaccccagtgtaactctatagccatagctttacatgtaaacactggatttaaaatgcaaaatctgtggttactttagaccactgagactcaattatttatgctgattatttataggtagcttctaatggaagttgattattgaatattttcaaagagaaaaaaaaaggaataaattctcatttcgctaaaaagctttgagtttttttcctgaagggaagaaaatagattaggtggtgtcctgagttcctctgcagcctggggtgctggcatgaataaataaccgtggtaagaagcaagcatgctagcagccaagccacagacaatagtgcccaatgcatcgcccatcttcagaaacgaaacatgttgcataagacattttcctaaaaacttcatacttggagccgggtggggtggctcatgcctgtaatcccagcactttcggaggccaaggcgggcagatcacctgaggttggaagttcaagatgagcctgaccaacatggagaaaacctgtctctagtaaaaatacaaaattagctgggtgtggtggtgggcgcctgtaatcccagctactcgggaggctgaggcagcagaatcgcttgaacccacggggcggaggttgcagtgagccgagatggcgccattgcactccagcctgggtaacaaaagcgaaactccatctcaaaaaaaaaaaaaaaaaaaccctttatactcggactttaagcatgagtctttctaaagtgcattctaattagagcacatggggctagataggggtgactggcagaaactggggaggtccgaaaatgcccccctcagagaactgacctaagaaagcagctagagcctgaggagacccactggaggtcacatagagtgaagtgacatgaagaaatggctatggacacagtcctgggaaaccagggagaggccagagaggggtcacagtctgtctttagagcagaactagaattaacatcaaacgccaccataagcagaaaatagaagctgatgccacctctgacctctgagctgagaaaagtgagtccatacagggctcatgaaggccttagaagggcctgcagagaagacaggagcactgtgcccaggaggcagcctggccagcagtccagagacatccagcaccccccgccccacttgacacaggcgcatcagggtgagcacctgtgatgagaatacccactccctgtgcacacagtacctgcatggccctcccgggcacccggctttggggggacacgtgggcagcgagctacacacagaccctatccctccagcaggatcccccttcctcatttgcattccatttagtgataagattttccccatagccttatccattttctcttactccccaaggaaaaataatcagaattattagttttggtggttatcctatgttatggggtgaatctgtccttcccccaaaattcacagaaattcctaacctccaatacctgagactgtgaccttattggaaataggttcactgcagatgctattgactaagatgaggtcatatgacagtaggggaggcccgcggtccaatctgactgtgtccttaggaaaagggggatttgaacaccgagacatgaacacgaggagaacgccatgtgaataggaggcagagacggggtgatgcatctacaagccaaggaacgtcacgtcacggattaccagcaaatcacaggaagctaggagggagacctggaacagattttccctcagggcctcgagaagaaatccacgctgccaacaccttgatctctgctttccagtctgcagaactgtgaaggaataaatttctgttgcttaagccaccttgtctatcgtactttgttatgggagcccaaggataggaatccagcctgtaatgtgaacttcagttttacagagatgttccagcaacttccccgggacatgataacccagaaaacaagtgaagaaggtcccgggggatcctgctgttgtcacacttcaaggtccctgtgcctgactcatgggaacccccaggccttccatcggagactacgcgactcttactagaagctcaggaaggtacacaacccagggcaggcagaacactttatctctaatgagcagcaagcagggctttcaaggcagttaagaatttcctagctgttttcttcctcatcgcaatcaattctgaaaggcatgttttcatagttcgaggattctaagggctacgatgaaagtctctgctattaggttaaacatttgaacaacatattaaatattcaaatagaacattaggttgaactttgactgagcgtattaaaatactttaaggttaacactgaaaaggaactttttgtagtaaattaaaggtggcttctcctcctgaaggaaagtggagtctaattcctagcctctcgcacaccggccggcctgtgacttgcgtgatccagcgaatgtgacagaggtgacactctgggacacgggaggctgagttgtaagaagcctcttggagcctcttagaatgctggctctggcagaagccagacactatgtagcaagtatcactcacgtggtgaggaagcccaggtacccacatggagacgccatctgaagacagaaaggtgtctggccagccctggctgctctgtctatcccagccaggcatgtgagtaaaggaacctttttggacattccatcgcagcagaaatgacatgcagaagacccagggaacccagccaacagtgggaaccaagatcccaaacgtatggccccagcacagctgccccggccatctccagccatcagtgagggttctagtcactggtctgtctctgggtcatcctgctaaattcctcactcacagaatcatgaaaagtggttgcttagtgccactatattttggggtggtttattgtgcagccatagataactggagcacacttttctgtgaagtattttctttccagactcgaacagttagatgggtttatccggaggctacggtgtaattgaaattccattaaagatgctttttaacaagtaagcaggactaatgtatcttcccactgcaaaggcctgcactatctttgccaaaccacatcatactctgtgaagtcatccagtacaacacgtaccccaagttcatactctttaacagctctctgaatcaaatggagacttagtcagggtgaacagtgtcactgcaacgcttgcaagcaaagtaggattcaaccccacagcagaggtcagaaatgccaataaaaatgaccttctggggtcatttatgggtttcacagctctgatttcaagaggtaccagatatgccaaagaaaatgtggccaaagacctggaaatacgggctcttctgattcagtagggccaggggtcgctgccccagccagaggtcagccaccttggggtcagccaccctggcactgcccagctaagacagtccccacagaacctgagagctggctctccattgtgtctctccagagaaacagccccaacttctgttggttgtctgtacagacttcaaaggaaaaatatcttcctcctatctcatgaaaacattccttgctggggctggacgcagtggctcacacctgtaatcccagcactttgggaggccgaggcgggtggatcacaacgtcaggagattgagaccatcctggctaacacggtgaaaccccatctctactaaacatacaaaaaaattagccgggcctggtgtcgggcgcctgtagtcccagctgctcaagaggctgaggcaggagaatggcatgaacccgggaggtggagcttgcagtgagccgagatcacgccactgcaatccagcctgggcgacagagcgagactccgtctcaaaaaaaaaaaaaaaaaaaaattccttgctgggacataaacccttttcctatcgtcatacttgtccaaactgtgagttcacagccaatgataattggatgcgtggcctctgctgggtagataacctatgccaaactgttttcaaatagacagaaaaccaacattaatatggtttgttgttgttgttttgagacagagtctcactctgtcacccaggctggagtgcagtggcgtgatcacagctcactgcagccttgatctcccaggctcaaacaaccctcccaccttgcctcccaagcagctgggactataggcacacaccaccacattcagctaaattttatttttttagtagagacaaggtctcactatgttgcccaggctggcctgaaactcatgagctcatgtgatcctcctgcctcagcctcccaaactcctggaattacagatgtgagccaccgcgcccagccttagtatgttttaaaagtcaaaagaaaacagtgtactaacagtgacctgaatctgcctgcacttggaggctcaccgttttcacgtgctcacgtatgccatctcctttaagcctcaggtcaagtccatgtcatgctcatttcagcaaaaatgtcaggcagctctccctggcccacagctggctcctggtagggcagtcaaagtcagatctaccagatgccagcacccatgagaaaaggatctggatggtgccaacctaataccccctccatccccagccaccagcagcgccgaggtccttccgtccatgctgtgtgcatggcttttctcatcccctctctgaccccagcagctgggtgagcatcttacagatctccttcccagatcccgtgcaaaatggccagaattctaggtctcaggctgttcatttgtttgatgtgaagttagacttagttaccttggtgttaggagagaacagtgtttaaattatgtgtggcaaggaaaattaatttgagattatgaattccctgcagcgttcaaagagtatcatggagcttaagagcaagttggctgggtctcagtttattgacctggaggaatgtggaaatgctaagggaaagcatggagctgaagagtgctgtgcggactgtcaatccatttccatctgaaatcacactggaaaacagaaaagcctacctatggatctgtgtgggggcatggagaacagtgtgggtggagatgcaaaaagctccacctcagagagctgggagggaagcggagtcagggagggctgcctgcctttttctgtagacattcccctactgattgactggtgacagtgagattttatcacgtttgtaatttccagaaggggaaggcacaatgactggttacagtgagattgtattacatttgtaatttacagaaagggaaacacacaaactgcaagagaaatagatccctagagagcgtggtccaagaaggctgtgtccacatttccacattccctgtggctgaatgcccagactttgagatcaaccccatcaggaagaaagttaaagacagaggctaatcagagtttggcaatgctgagagcttccacgtgccaggtcctgcctgggctctttacctatattacgtcattcagttttcacaacttccccatgaggtgtcatccatgttacaggtgagaaactgaggcacagagacagtagcaatttccctatgatcctaaagtgatcagaggtacagctgggattcccatccaggcatcccaaagcctgagctctctatgttgtgacacttcatagttgtgttgacttttatcaaatcattcaacctctttgagggtcatttttcttatctgtcaaatgaaggtgacaacaacaccttctttttgcaaagattcctttgcaaaaaggaatcttacatatctttatcatatgtatctatatcatcatacatgtacgtatatcatctcgcccagtgcctgcagacaggagactgcagagctatgtgcccaaccaacctcacagggagggcacttttgagtgtgggcaaggtgccatcaaatccactgataagggacagtttagggagtgaggagtgcatgtcccacagcccctctgcatataaggagtgaagaggagggtggtgatgaggtaggacaagggttggaataggagatgagactaagaaaccaggcagctcaggaggctgaggcaggagaatcacttgaacccgggaggcagagcttgcagtgagccaagatcgcgccactgcactccagcctgggtaacagagcgagactccatctcaaaaaaaaaaaaaaaagaaaagaaaaaaaagaaaccaggcaggcacagatggccacgtggagaggtcagcccctgagagggctctggaccacagcctgaacaaagagcacggatgcaggcagctgccttggaggacacagaggatgtctctttgtgtcgcctccatagggcactggtgtctggaagagctcctcggccagccatcacttagatggctggctgactgggttaactttccacccactccctcctccaaccacccagcttgatgttccttcaatacctcttcaacactcatgaggagggacgggagtaaactggttttcttttaataaaaaatattatgcctttctttttaattgcaaagtaaggtttttaaaaataccatttccaaataaaacggttgtgggaggcatagtaaacatttaaaatttacatcatacaatgaattattgattcccagcaaataatactccccactcagtttcagattttcagctgaatgtagcagggcccgagagcctgtgccaggcccagtcctctacatcagggaccagggaacacttggatggggtggggttttatgtgtctctccactgccctcaaaggcactgccaatctcagcaacaggaaggtgctgactcctgactcaccagctctactgcaagtccatcacctgcaaaacctcagtgatttggtccagtgatgtgctactgcccagcactagtggagttggcacgagatagggcccctggcagctgcccagcggcccacccctccattcggctttgatgccatgggagagggctggggccagtgacagtcaagacccatgggcccaggccttcagagtggctcttagcataagggagaagggggtcaaataagggagaaacagcagggaaaattgaaaagacattctaatggctagtggggtggagatggaacaggtaaccaggtctttctggggacagacaggcatgatatgagagatccatccaaggatccgtgtttaactgggacaggtgtgcagcttcgggatgtggggatgaactgtgaagtgaagacagaaagaaaattcgtgcgctgtaacaggctcagtgctctctctaccatatgtcaccataatatttcaatcattagatctgaactaaatacagatttaatttaccaaataacgttttaatgacaacagcagtggcccccagcagcactccaatttacgtacaacttcgagataaattacatcgtttgacttgcgagaaagatgtctaattaggaagatttccagatataaagaactgtcactgtaaggcatgtcatctcatcactctaaagtcactcattaacatatgaaaacattcccgtttaataaactgcttatgtcaaacgaggtcctgaagatgggacgtgggtgaaggtgctgcccagtaggcggctcaactgattcatcacctgatgttatcggccatggccatccctccgccttcagatggagtcgccagatagatatttttgccatacaaggttcttatttcattttatcgtattctgattttctagctgggtatatttcagaattagtatttgtgttaggataagacactaagattctcttgaagcactggtgttttacacagtttatcttaaaggctgcttccaagttgctgcaagataaaactgacttaaggagtctgtcaattagatgcaaccatggtaaccagagaaaactgcaaaatggccataattctgcaactttgccccaaatgaggacaaaaccaccctgtatccaatacaatacatatactgggttttgtagtggcatgaagaaatgccttctgaagttggcccagtttaggaggtatcaggaacgacatctcagtgggtttttgcaggaagaataggagtttgctgataaatttcatgcttcctctgtagacaatggggaagcatcagaggggacgtagcagggtgttgaagtgacaagttctacagcagggagggtggatttggagcagggcagggatgaacagagggccagtgcaggggaggggaccactcagaagaatgctacattcctttcagaccaaatgtgtttgcagcctcactgggaatgctgggttagaccctacaccaaaaactacctggaacaagagctgttctaataatgctaagcatatgtgaaactgtgatgattctaatattggaactttttattttaacagaaaaccaattatcgtaggaagcttctaccatctctcatccaacagtgttagcatgactgttactaatacattgaaaaaataaaaatagataatggagatctggcaaggtggccgaggaaatcacatgtatgagagatgggtggatgaaaaagtcccaaaccccttcaagaagcatccgtgccatttcaagctttccagaacttcagagtcatggactgtctactcctgtttctctgtatcctccccccaaccccagttttaatttccattctattttccctttatccatttactatttcacttatttatgactcaaatatgccaggccccatgggagagctgggacacacagtgaactaactggagccagcaccatctcacactatcactcccgccttccagtgaaggagagaaccaataaccacagggctggttagggaagtacaactgtgccacatactcccaaggagaggccaggtgcctctgaaggcttatagagtagacatgtcctgcccatcacaccttcgtcgtttgtgtcagagctacaactaaaatctagaattcctaatttccaccctactcactctgcctcattcatttttcggtttattcatttgctcattcatttgcttatacctttgttcactgcccattcattctttcaacattcgatcagttattcatccattaattactcacagggcaggccctcttgtctcagctcagctacaaggcacagaggcataacaaggctaatgaacactcacgggtcataaccagggtgctacgggcacattggccagtgaaagctgaactggtctgggcagctcgatgaaggctctgcagaagtggccctgacaagtgctagtgaatcactccacaacatgcaaacctgatcactaacataatatgcaacacacgctcacatgttccaggtgccgcgcagacaggacccctgccccttgaaagtcagagtcaaaagggggagtggcgaggaagcaaaggctgcatcttgtgtcaagcgccgtggaagggaatagtgaagtactcccgggtcttgggggccttctataaagaaggtggtagcatctgggcctggagcctgcaggaaaagaaccgggagaagcaccttacaagcacggagagaaaccgtggaaagttacagaaactgtcaggaggcccgtggcgctggactacaggatattgtcagatgaagtcagcagcttgagcaaagcattgcaggtggaggaaaatttttttaattttttcctatatgtgtcaagaagccactgaaagctttcagacgactttttattgacagaatcctatttacatctttaaagaagtatactggttggaccctcaagcccatagaggggtaatgttgcaagtagaaaagaccaccccttgctctaagtgatgaggcagattccaacccttggccaggccgccatgcagggcagaaggtgccctgattctggctgctgcagaagttgggggatggcaattgaaaccaaagaggtggccatacagatggcgatgaggggacggactgcaggtaacttttgaaggaacagctggtgggatttgtatgtgtatgggcagggaggtgagggaaagggactgctgtgcgttccatgcatcttgattccattatctttgtggccctaatgcaagctttcagctctataggaatgcgaaacaactgcagatttcccatcgggcacatgccagagataagtgcttcccagagattcttggttgttctcagtcttctgcatcacatgccatagtgcgacgaagtctcccttccgatgtacaggtctctctgcaggatcaaattccagaaccgggattcctgagtcaaagcgtgaattaacctataattgtcttaattctgaaaaattatcctcctggggctggttgggggggcattttacactcctcttagcaaaatgtgaaaaggtctgtttcaccccagcctcagtgaaagattatgttctccagcttgtgggtttttgcctgacatggcaggtgacatacaatatcttactgttgttttaattgtaatttctgttaccacgaggttcacagtgttttcatgtgattaggccatttctgtgagctctctgaccccgcccatttttcttttggatatttgtggtctttttcttataaacttctagaatgcaggaactattcacgatctgaattagaaatatttctcccagtttggtactttgcttctaagtttgcatactttcttagaaattttattttatttatttagccacgtaaaagtttttgctttgatatggtcacatttatcaaaatttgatagctgcaaagaatactatatgagctggtaaaaaggaatggggggggtggttcttcggtccagatttagaaagatctccaaatgcattgtgaagtggaaaaagcgaaggtacatattctacccctttttctctgagaaagagaatgtgggcacgtatgttcttatttgtttatattttcataaaggaagtatgataggttattttatatgtcagcttggccaagctatggtgcctggtcatttggttaaacactagtctagatgttgctgtggctgtccttttagatgtaattcatatctacaataaatagactcagttaagcagattaccctccatactgcggggggcctcatccaatcagtcaaaggccctcagagcaaagactgaggttccccaagtagaaggaattcctttcaagactgtgacatagaaagcccagctgagtttccagcctgcagaattcagactcacaaatgaaacctcaacacctacctaacctccagcctccctgctgccctacagatttcaggcctgccagcccccacaatcaggtgagtccattcctttaaaaaaaaaaccaggcgctctctctctctttctctctctttctctctccctctctgtctcttcctctcattggttctgttactctggagaaccctgattaacacgggaacacttggaggattccacaaaaaatgagtacagtaactgtgtgtgggaaggatgagggaggggtggtaatgggaattctcagtttaggccttgttatagttagaaactttaagccgtgtaaatatctcacctactcaaaacagaaagtaaaatttggggcaaaatcaacttttaggtataaaataaaataaatgctctataaattaagcaataaaggttatttgttttatagaaatttaagatacaaaaaaagagaattatccaggtttatccaaaagatgaactgctcaggaagaagacaatttttaaaagcactgagatgcaattcttttaaacatgaacctatataccatatttaaatccatataatattctacaaatctggtgtatcctccaagcatttgatacaaggtttaactctcaccaactcttccactcctgaccccaccaggtgggcaaacataacttgtggcaatctgcaaagaggccaggccacgacctgggctggagtggccagcctgtggctggggagactttccagggaacaggtgccacctccccaaaacgcttcacgctgcgtgcaaggattcagagatgtccagggtaaaccaacactttttaagccaaatctaaatgtttaataaaaactaagaatgatgcataacaagagcttcatcctggaagtacacaccattttacaggaaactcaaaccctaaacatatgtaatcttgtttgtagcagggaacttcctccctgctagattgaagaaaagtattaccatctgggacacattcctctcaccctcagaagaaggggctttatagaagggtctttacttttattagcagcaccctgctatgcacctgctgatgttcataacacatggggctttctgggccactccagtgactgctgagctggcacctgatgacatttcttcaagtaagttgccttagttgacccagctactgctccacaccagaggtggagtggggaggagtgtcctctggtggaaggtcagtgccacagagaaacactgggcactcagactgcattcggtcctgggacagacagcgtgtccccaagcatccacagtgcagcgtccacagagaggcctgactcccaggggctgacagaggcagaggacagagctatttattgaaatgaggagtgccctgctaaaagaaactgcatgcatagcattatagagccaggtaaactcatggtgaggagtctgtgttttggattaaacacgcacgcgcgcagacacacacacacacacacacacacacacacacacacacacgtctgtgtttaatcccagctctattacataactttctggaggttgtttccctttgccaaggctgcctttccctacattaagtgggaacaatataatcccaccataaagaactgtcatgaaatccgaacgcaatgatgaccactaaggctacaagtgcccgtaccgtaggtagtaagtgcttactaaatgctggctcctcctccgtaactgatgggaatattaggagacatataggtctttggatagttcttgaaagctgtctctagaggctgtatttggaaacatatcacatggatcatctcttgaatgaagttcctcgtgacccttaggcctttcaggagtaatgccagggtccttcctgtgagcagctcagccgagtggggctagcggggagcagagatggggctgggacagagcacaagcacagccctggggtggggtagacagggatgctgggcaagcacaccccacctccgctccccgccaaggctgtctgctttctgcaccaaggccccttctacccctgcaagcccacctggccccctgcacacaggagagttgatgcccccagaggaaacaattagggggaatgggaacaaggccccgcatgccctcttcagggggacagttctgggacattctgtacggctccaggcaccccccaggctcacagtggcagccctgataacaccccccagggattccttctcctgccccacatcccccccagctcctcacacctgcttccttgtcctgggctctgcttctgggctaaaaacaaccccagcggggagagctgttaggaatgcaaagaggagaccaaggacttgaggcccctcctatcacctcatttacatccccaggagtgcaggccacactgcccatcaaaagcacgtccccgtgaggcaagatgatgatgatcgcagcggacatttattacctgccagacaccaacctaagcaccttattattaactattttaattctcacaccaattccacaaattactatgagtttgttttccaaaagaggaaactggggcacagagaagctaactttctgaggctgcccagctggtgagcagcagagccaagcatcccgctcggcgaacgagctccagagcccatgcactcaaaggcagaagctgcgctgcacaacgacgccaagaagagaacctggagggtccaggctggcagaaatcagggagggcaagggcaaggaggaagccaaaagctaagaacaaagtcagacaaacgccgaggcagaagccagggaagcagagcatgtcaccaattactggggacatgctctgagagagagggtttgagaactgccactcaccggccggggactgcttgttctaaaggtgcctcaggctgaaatccagctgggcctgtgctccaagccaggagtcctggcacaaaaacacggatctttgctctttctgtccgcagggcctgggatctcagccccaccccaagacagtagaagagaagggacccaggcaggggctgtggtcagtgtagagcctctggtttactagggaagtcaagcctgctggttcccattttctccataaattactcccattaaagtcaaatatccacattaactaaatttttgatatttcacagaatggttccacaaaaagagtactttcatttagctttaaacagccctttctgctgacatccaaattcgtatttcacttccctctcatctttaattaaagcttattatcctctgtgtaaaccaagaagatttatgacattatttagtgagttttctttttttaaattataaataacagtaaacttcagaaaatgctccaatttcacagttatttgttttcaagatttttggccacacactaaagctaaagctaacctccaaaaggcgcaagtcacatcttaaatgaaagctctgatcaaatctagtcctccccagcttctctgggcataaattggaattttaagccataggccaagagttaaaactatagcttctgatttgcttccaatgcgatctgtaactagttattcatggtccaaagaaaagtttggattcatgtcagaaccgcctcatacacacagccatctgaaaagtcccagagaagccctgtttaaatgcaatccaaactgatcctgccatgtttcttctaaaagaaggaaccatttcctgtctcgtgtatggtttcttttcctttctttctttcttttttgagacaagatcttgctttgtcacccaggctagagtgcagcttcaccattatagctcactgtcttgactcatgcagtccttctgcctcagcctcctgaatagctgggactataggcccatgccattgtgcctggctaattttattttattttattttttatagagacaaggtctcgctgtgttgcccaggctggtctccaactcctggcctcgagcaatcctcccaccgcagactcccaaaaagcttggaattacaggtgtcagccaccacgctgagcctatggcatcttaatttttaaatttttcatctcttttcactattttttctacaggagatcattatttcatttaatatagatacccatagtcacaaagagacttaggacttcagaatcagaaaacaaatcaaaaaaatacaatgtcctactacaagaaaatagtttttaccttaaaaaccatggagaaaggaaagtgctaggaaacgatggaccaaagtgattgtgattgaaaagaagataaggggcaactggaacaaagcattcacatgaagtccgtcagcacctagaagggctcatcaggagtctacgcaggctcgccaacacagcagcaactgcaacactcactgctcttttactgacaggatcaaggcatgtagacacggtatctgcgaggcagaggtcaattcagatttttaatttctctcctgcagcccagagccttgtattgggagaccaaacttccattcactgtcatggcattctggagggcacagagagtcaggtgtaacaaatatagaggggcaccatctgggatgggtggggagtattgtcagattctgcgtcagggtgcaaggggtgggcgagcttaccagagtgaggggaaatctataaggaatacatgtccaaccttgcactagagtttgaaaaaacatcaacttttaagtgctgaatcctgaatgcatttattgagtccaaaaatatctgtgtatgtcttcaatgtgtcaggcactgttctcagtttgggcatgcggcagtgaataaaactgtcaagtaaatttcacacagtgagagggcaagaggcttgatacatcatatagggtattagaaggtggtaagtgggggaaatggaaacagggggaggtctaggacagggagcagcaatgttgaacgggtctggcctcactgaaatgtcaacagaacgagaagagggccgcagggctgcagctacgtgaggaacaatgttcccgactcagggagcagtgtggaggcgtgtggctggagctgagctggagaggagaatccaggaagaccggctcgggagtgggaggggtggttgcagatggaggagttggcttttagcctgagagaatgtggagtcttcggagcatttccattacaggagtgacaggatttggaatgagctttgaaaggttcgcaaaagtagctctgaagaagtggggttatgtggcttctgcaatgtgacccgcgatttggcacaaccttgagaactccagccccagtaggaaaatggccaaaggccataaagaagtcacacaagaattcacagaagaatattttcagccccatggtgtcatatgagtaaaaccacacagttccatttcagcaccaggtgggaacctgtctcctataagttaagcggtataaatgaaaatttaatcatgattttccctttcatagaattgtggcctaacttctgaattctgataaaataacttaacattggccaacaagatcactcagcatctgagacctaatttgataaccataactcaaatatctcatcaactgaagttgcaattaacaaaaagtccagttggcagagcagggcctggatgatgaacgattcacagctgatctggggctgccgcctctacggcggtgtcttctttccagaccccccgaaagttcacagactgtcacacatgcacacaactcccgtggccctgcaaaaccagctcccatcaggaaacatgtgggctccttcctgcatggtacagtgaaaagcaaaatcctaacgtacttactcgcattaaaaaaaataaaatgagaagactcagttttatgtctacacaactgcaaaaacaaaacaaaagtcagagatgtgaactccagattgttaacatatctgctgaaacaaacagaacagtttaatcaggaatgtgtacaagctatattgcatacaaattggcatcaatcatgaataaatgaattttggctttttgcatctcatgtatgggacttatttacatggcatactggcaaactggaatgtaaactaacaatataaatgatattgcaatttaggagcatccccaagctgccagaaataggaagaaggcagtgttttggtttcctacagtatggaaaacttatagtgataacccaactaattcatagcaagggggagaagacagcacactaacctttaataaattaataggattgggaggctaaggcaggtggattacctgagctcaggagttcgagaccagcctgggcaacacagtgaaaccccgtctccactaaaatacaaaaaattagcctggcgtggaggcgcgtacctgtagtcccagctacttgggaggctgaggcaggagaattgcttgaacccaggaggcagaggttgcagtgagctgagatagcaccactctgcactccagcgtgggtgacagagcgagactctgtctcaaaataaattaaataaataaaaataataattaattgattaattaattaattggagctgttttcccttttctgcaggtactgaaaaccatcttatgcctgcctataggcatctccatttaagggcttcccacaccctgaaatacaaacactaccaaccaagctataaattatattgctttctactcctgtttctactagctatttctttaaaatttgctaaaatctgcctacaaaactatctaaacttggtgtctattaagaaatagggggatttttcaactctaatttgagttctttaataactatttctgtttgggttttctatttcttcttaagtttggctatattatttataaattaagccatctcatctaaatcttcaaatatattggcataaggttgctgattatcatgtctgaaatctcttgtttatattattttcctttcatatttctccattattcatgtttcttctcttttattgtaatcaataacaggtgtatgtacttataactcttttcaaagaatttttgattgcctctattgcttcttggatatccatttcgttacttttcctttaatcttacttattctttttgtgaatgtatgcatttactttgattaagaatttcaaacagaaatttaagtttatctctggtgtttgtgaaatgtgaaaagtaactgaaaactgcaaaaacaaacaaaaactcctaaagctcccaccaaaagttttgcaataattattaatatttcataagagagggtgggtatggtggctcacgcctgtaatctcagcactttgggaggccgagttgggtggattacctgaggtcaggagtttgagaccagcctagccaacatggtgaaaccctgtctatactaaaaatacaaaaattagctgggcatggtggcgtgcgcctgtaatgccagctacttgggaggctgaggcagggcaatcgcttgacccaggaggcagaggctgcagtgagccaagatcacgccactgcactccagcctgagcaagagtgagactccgtctaaaataaataaataaatatatatataatacacatacatttatacatttcataagagataagagaacacatcaatgcagtcacaagtcacttaatgacaaagatacaatctgagaaatgtgtcattctgagcaatgcaaatggtaacttcatcattgtgcaaacctcagagagtgcactcgcactaacctagatggcatagcctactatacatgcctaggctatatggtgtagcctattgctcctgggctacaaacctgcacagcatgtactgtactaaacactgtaggcaactgtaatgcaatggtaagtatttgtgtatctaagcatatctaaacatagacaaagtgcataaaatgtgatacaataccactgtcctatatgtggtctgtcatcgatggaccattatagacatcattatgcagcacaaaactgtattttattcattccacagatgacatgggagtcttcttatttttgtaatcaataataacaggtgtgtgatcaataataacaggaggagtgatatgctaattaggaactaaggatgtgcaagataaatgtttatactccaagaatgaaacagaaacgaaaaattaaaagtaataacaataagatgattaacaatatcaatagcaactaacagtagtttcttggttacttatcacatgctaggtaatgttctaactatttcatatgaaatttatttattttattttattttgagacagggtctcactctgtcatccaggctggagtgcagtcattgcaatcatagctcactgcagcctcaaactcctgggctcaagcaatcctcccatctcagcctcccaagttgctggcactacaggcacatgccaccacacacagcttttttattttttttttggtagagatggggtagggggtttcactttgttgccaactcttggtctcaagctatcctcctacctccacctcccaaagcactgggattacatgcacgagccaccacgtccaactaattttactttctgtagacagggtcttgctatgttgcccaggcaacaatgtagtggcacaatcataactaactataaccttgaactcctggactcaagcgatcctcccacctcagcctcctgagtagctgtgactacaggtgtgtgcaaccataccgggctaatttttaaattttttgtagtgatgtggtctcactatgttgctcgggctggactctaactcctggcttcaagcaatcctcctgccttggcctcccaaagcactgggattacaggtgtgagccactgcacctggcttcataggaaatttaatcctcaaaagatcccatatagaatgatggaggttaacactgttctccccactttacagatgaaatccccaggaatgaaggcggtgagagctagcaagtgggtggtgtataaggcaaatcattattaatagccacaagcacattacacagagtcttagttttaacttcaatggaagttttattgtttttgacagttgccaaagcagatcagatactgtgattaggtacacggtttcttcctgcttatgaaattacattctgaagcccttcggtctcattccccggctgcctccactctttcttgtaaccgctcgcctgtcacctgtctgatgtgcatcaccagctcattcatcacctggcagatttactaactcactcatcatgcagacactgatgagcctgtccttccgcattcatccccacaccctggctgccgctcactctgacataccgccgcctgtcactgtttgccagccaaaccgatacttttcttaggagctgctattagctcatttgtcagattattttattcctttttgcttatcaacttcccttcagacatcttttagaattttttcttcttgttctcctctgccaaccacttggctcatttgcttatcacctgatattattcacccctcatcattcgacagcttttcagattctattagtcaacatacataatgtgagttctatctcttgtttctattaggttaaacccatacaaatcttgctctgtgccaagtgacttagaatttgcatggggatgacacttacattagagcatattcactatggcacatgaatatcagttataaaactcacattccctttcacaggtcagaaaatgtgggatagcagcagccttttaaaaggtaacacacagcggcatttttttttaatgtttaaaaatatataaataatttattctccccattgcacagaatggcaatatgttctctcctaggtgattgaaaaggtttttgtctttagtctcttatggactggtgcatttgatggggatccagaaaaaaagatgggactaagtgctgcacgcaaaagagaactggccatgaagaggacccacccgccagacaagagccctgtgtgtctgcctgggaaggagaggagctcattcctgaaggtcccacctggacgggctgtttgcttatgaatgtatgcacttaggtaggtaggtaggtaggtaaatgtgtctatgcatgtatacacataagcgtatgaatctatgtctatgggtgtgtgtatgttgcatggaagtacacatgtatgcagcaggctaacactgactgcatttactgtgtgcaagtctctgcaatatgctcccaagacacagtagctcatttagtcattacaacaacctttgcaatagaaataccaatggccacccatattcactggttctcatttgcctggctgtgttctaagccttgccaccacctgggaggtaggttctatcattttcccccatgaaataaatgaatgaactgagcctcacggggatagagttactcacccaatggaggagctcttatgatccccatgttaccagtggggagactgaggcacagagaagttcagaaagtcacttgaggccatacagtaagaaatagagtctgtacccttaagcacatcacactacttcccagtagagaaagatcaccttctgtgatgcttaattttacgagccaacttgacagggctaagaggtacccagagagctggttgagcatcatttctgggtatgtgtgtcagggtgtctccagaagaggctaggatttgaatctgtagactggagtagagaagatcaccctcaccaatgtgggtgcacctcatccagtccactgagggcccacatagaacaaaaaggcagaggaagggcgccgtctctctccccttgagctggaacatccatcttctgtccttggccatcagagcttctgcttctcccaccttcagactccaggacttaacaccagcagctccacccctcctcctgttctcaggccttcgggctctggctgaagcacaccaccagccttccagggtctccagcctggagatggcagattgtgggacttcttggccttcacaagtgcatgaacctattcccatgatcaatgtcctgtataccccattggttctgtttctctggagagtcctcctaatacactttccttttaagaatgtataaaaagacatacatatgtgtacacacattcacagctcaattaagacccttctatcatgagagaatggagacacgttctaagacactaggggatcgggggtgggagagggcctggctccaaaatagatattttgatgaaaccagagtaaattcttagaaattttctgagtctcacggtgataaacagacactgtctctatgaaacacgcacaagtttcaatgatagaaaaggaagagatgagaatagctagcgaccagaaggaaacacaccaagagaaaaggagactgccccaaaacagaaagagagactggaccagttaaaactctgcactggaaatagttaagaccaggccagatactgcaaaaaaagaaaaaactggtaaaaatattttctgtagagcagtattttacatttcccctcattttgctagatttttctgtttgccctccagatccaccatacacctttactgctgcctggaggctgatcttgatgaggcttccctgttttccactgggttcagacttgggcagcactgaggggagactggagtgggcaaggcatggcaactggggtatttgtttcctctctgctggaaaggaccagtgcctgcattctctcaccaaaggccacccctgtctcagggtgaatcctacgaattcaggtctcactccaggccccagagccactccctccctgtgctgttaaggtccaggagccagggcagctctcagctatggctagccctgacagcctcaccatttctgcccctacctttgtaaatagtcaccccattaaactccccattacccaatttaaatatgtcatctgcttcctgctgggatactgagtatgaagtgctccaggcatcccccaggacagagcccctgtatcatgatctgttttataaaccgtggttctggacagtaatttgagtttttaaaggtcccattggcttttttttttttaagcttaaaaaccaaagatgaagtttaaatttgagaagcattcatgagaatgccaaaaaagggacagagtgatacaaataaaaaaaaaaaacctcacacttggaggatcagaagctgagatttaaatgattaataatgcatgcttccagagaagagcccagaacaaatcattctgttctcattatgtagtgaaacttacactggcttcagacctttcctcaaattgctaatgccagaaaaactgattgctcaagaattctgaatctaaccaaattactcttacattgaaagtaacagatggctactttcatttatacactgtgggaaatatatatcacccatgtccccatggtgaagagatgaatgaaaattcagaacgtaagagagctgaagtcagatagtaagcaaatgatggagagtggaatggctgagctaaataaggggtcccacgaagaggaggctttataacctgagttccctatgtaaaattaaaatgtgaagggggttttagatgcacagaataaaaaatgctaatttactcatttttccataaggaaaagatgttaaaattgactttttttgggagtatcacttacctacgaggcaatgttctctgttccaatagcgatggtggtcacccagggacttacatttgctgaagctcattgaactctattcttaaaacaagtgcatcttgttctatgtgaggatgtgaggatgagaagatttttatctttggttttggtaatttgataaatgtagggttgaggatacttttgaaaaatcaacaagatggtctagaagtgaagaagatatgaaatgtatatatatgtgtgtgtgtgtatatatatatatatatatatatatatattttttttttttttttttttttttttttgagacggagtctcgctctgtcgcccaggctggagtgcagtggcgtgatctcagctcactgcaggctctgcctcctgggttcacgccattctcccacctcgcctcccgagtagctgggaccacaggcgaccactaccacacccagctaattttttatatttttagtagagacggggtttcactgtgttagccaggatggtcttgatctcctgacctcgtgatccgcccgcctcggcctcccaaagtgctgagattacaggagtgagccaccgcgcctggcctgaaatgtattttttaaaaacatattgatatagaagttaaaaataaggtaccaaggataagtgcatgagaagatatgcaagtcctctgcagaaaaaatcttaaaactccaatgaaatactctggaaaagaccaaaacaaatggagggatatagtattccatggtcaaggccatttaggatcacacagatgttaattctccctaaaatgatacacagataaaacacaactccaataaacatcccaataagggagtctttcataaaatccaacaagctgattctcaagtctccatggtagagcaaagggccaagaaaagcccagatgcctttggagggaagagaaagctgggggcccttcctcctcacaggtatcttgttgtacaggaactaccaaagcagaccaaaggggcagaactgagtgcctagaaacagacacacagagatacagaaagtgtatttacaacaaagtgggcactgcaggtcatggtaaaaaacagattctagtgccactacaattggtcacgcataaaagaagaaaagagaattcctgtctcacagcatatacaaaatttaattccaagtagattaaaggattaaatgtgaaaagcaacacttctgattctgtaggggagaaaaaaaaagaagcaaatgtttttacaacttcgaggtagggaaggatttcttaataaaagataatcacatacatgcacagaaagtatccccagtgaaggaattaataaattaataaagataaccataagaaaaatgacatggtaagtcaaagcctcggagggggtattttcacatattccaccaagaaatcagcaccagaagatatagtataaataacttttataaattagtaagaaaaagagaaatgacacaaatgggtaaaacacacaaactcacatattacagaagaagaaacacaacataaaactggttgatctcagccaggcgtggtggctcacgcctgtaatcccagcactttgggaggccgaggcgggcagatcacaaggtcgggagatcgagaccatcctgcctaacatggtgaaacctcgtctctactaaaaaatacaaaaaaattagccgggcgtggtggcgggcgcctgtagtcccagctactcgggaggctgaggcaggagaatggcatgaacccgggaggcggagcttgcagtgagccgagatcgtgccactgcactccagcctgggcgacagagcaagagagcgagactctgaaaagaaaagaaaagaaaaaaaaaaaaaactggttgatctcattaggaacaaggagagcaccaactgggactggagatgccgtggcacactcaccagactggcaaacctctcaaggcatgccatgaagaatgcggaacacttggggcacctacatgagtacagttgctttgggaaaaccatgcgacatcatttcatcaatcacactgcccatgacccagcaatttcatgtccaagtgagtgccctggaggaacccatgcctatgtacctgaggagacgggcatttaaacattcacagcaacacaggtcacaggaacaaaatattatatacatggcccatgcagccactgaaggagaacagacaaacatattgtgatctattcacaccatggaagactgcaacaacaatcaaaataattgatgtagagctacacatgaacacgtatgaatcaacaaatatcatggtgaatgaaaaaaagcaagtaatcaaagaacataaagtgcaattccatttacacaaagttcaaaagcaaaagtaagcagtacattatttagggatgtgtacatatgtgtaaaagaatgatgaaccttgaatctctgctctgaagacaggcaggagaccagatgggaaggagcccacaggagggtcctggagtgggcagcttacacttctggtgctggttggtggggccttcaattgcctgcttcatagcaatacatgaatttcattgtacgtgtcatatatttcatgtttaataatattttattaataaatatttcctaatttaaaacagaaaagatgaaatacattttaaacataactgtcagtagaaaaaaaagctagattcctacagtctaaatatttacataaagtaaagcactctcaacgtggtatttatcagaaaaaaaaaccagaataaaagacagaagtgccgaagaaacgtgtaaaaacaagaagataaaaagagtgactgaaacaatccctaaataagtaaagagatttcataataactcaatcccttattttaaacaatttgatttctataagatatgtacctgaaagaaaatgtcagagagaaattaaagaaaaactgatgggcaaagatatcaggcacattcaaactaaaggaaagcaagcccagtgctctaatttaaacaaagccaaattcaagacaataaaacactaaattgagacaagaccactttatattattaaaagatataatctacagggaatgaacagtaatatcccaacatccaaacagagcaaaatgtgacagaaagagccgcagtgaatatgaacatgaatatggatcatgtaggaaaaagctgttatggaaaaaaactgcaaaagctaacagtagctgtgggccagggcagaacacgaaggagtgttttctaagctgtttccctgcattttccaggttttctgtaatacacatctatactcacttatcaggaaaaccataactgtaaagatctgtgttttggtgaggatatcacacgtttaagaaaggcagactcctttcttcctccaaaagtcactgctgaaagtcatgatttttaaaacttctttttttctgaaccccaagacggagtcttgctctgtcccccaggctggagcacagtggcatgatttcagctcactgcaagctccgcctcccgggttcaagcaattctcctgcctcagcctcccaagtagctgggaataggggcatgcaccaccacacccagctaatttttgtatttttagtagaggcggggtttcaccctgttggccaggatggtcttgatctcctgacctcgtgatctgcccacctcagcctcccaaggtgctgggattacaggcgtgagccactgtgctcagccagtttcaatcaattattctatctattgttgaaccacacaaactaaagagcaaaacaaatttgaaacctttgagtcttccttcccttactaatcagaatttttatattttgacaaggaaacatagatctacagcaatttgattaaatacacatgaaaatcagggtaaaataaaattgtttcaacttcatcccactatttattgtatatcataaaattattcaggaatcaaagataaggttcatgaataatattcttcattaaaagagggtggatgtttgaaagaaaatctggtaactaatagcctataaggtagaattttttaaaacctgggtacgtagagagagttcctcagaattgcatattaaattcactttcaattagtatggttcagcattttattctgatgatttatttgtatgcttggtaatactttttaaattaactgtgccacagacagacatatcacatacttcacagttataataattttttctaacgctatatctttataacggtaattgccttctttctgaaagaatacgcattttgaatctagtgacacttcatttattacttttcttatattagagctacctcagcatattagattttttcttaatgacttttttctattaggagaccatgaagaccccagggcaaaggaagtccattaggaaaggggggcattttagaggaggcaggaatttctaaggtagacatcagacaattcttgtcaagaacagactgaacacgagatcctccatttcctgtgaactatagattaattttgatatctgtacaaacaagattatgaaatttgcaatattcatcattaatacagtgaattaaattcctcacatagcaaaacatacatcaagtatgtcactgctcactgcacctcccactctcagttgacacatcaccctgcacagctcctccctggacaactccagctgaccagagtacctgcttataccacgtggaacaggagaccgaggatcctctcaccctgacagctgccttgctctctcctggaacatagcagcaggtgattattcagtgtgggggcaaaaagagtccctatcactcctctggtctgagagccagatgctagagtatgtccaggaagcacttccgagaagctattccctggacaggctgagccgccttggggcagtcacccatctcctgaagccaggagtgctggagcacaggctgagaatgactctgaggctggagagaagactcaacaacctgttggtggctccaccacggctgtccctttctcccaaaactttctacagctcgatttactcctggacccctgcacctggtgcttttcctgcttcctggattttgtcttggttgttctgctggcctgcaaggagtctactctctgatctacccgcccaaactccacccatccaataatatttgggctgaatcccattctcactgtaagattcagtctgaatcagtcttctcctacttcaaccttagtggaagcagcatgacacaatgaaaagagcatgccctctgaaatcagacacacctagactcctccatccaagctttagcaattacccttgtattatgctacccaagtacataatccctttgaaaaggacatgctcttcaaatgcagctgtgaatacttgtcttgggccaatgtataaaaagcaccaggtaggcaccagtttcctcttatctttctaaataaaaattatatacaaaattcatttctcgatttctaacttgcagcaatttcctcccattatcttatacaactttatgtatctttaacattttattgatatttttatttccccaactcatatcataacctcacctagaacctaaacctaaataccatatcttaaccttcttagtttccaagtcattgcacggctcagggccctgtgcaatgcatttcattactgcggcacaacaggctctgagcctcatctcatggcaattctgacgaccactctgtgctcacggtgtgctgatggtgtcctttatgtatccaggacagatagaacaaggaactgctgaccaggcaggttacagaatcagcccagggttagacacttacaggtccaatggggaagcaccccaggaaacatgtaacaaagcctccattagcagcagctggacaaattcttcccctcttctggaaacatccttaagctttgctgatgcccacacctggggatactaagtggtttattgtaatcaagaaatgtatcatggtcttggggtccagctacatgcaactcacttcacagcacattaaccaacagacacggatcacaggaaaatcactccagccataaagaaacacacagactctgggactccatccagaggcacatcccagggcttctgagctcccagagacggcccccactcagtgctgttccacagaccttaccacccactcagtctctaccttcacaggaagagagtaacattacccagacagggctatgagaataactcactctttctcagaagcttctcagccagtcagaagcagcaatcagggaaaagttgattacaattgtttccaggtgaattcaagatgatgcatttaattatgatttttgagcacataattaccttattgggtatctttgtctaccttgtttttaatctttttttttttttttttttttttttgagacagagtcttgctctgtcacccaggctagaatgcagtggcgcgatctcggctcactgcaacttccgcctcccgggttcaagagattctcctgcctcagcctccagagtagctgggactagaggcacacgccgccacacccagctaattttttgtattttagtagagaaagggttttaccatgttacccaggctagtcttgaactcctgagctcaggcaatacgcccgcctcggcctcccaaagtgctaggattacaggcatgagccaccgcgtccggccccttgtttttcatctttctattctagctcgctgtcacttgcaaaaagttaagtttttatatattttcaataaaaaatgtgcctgatggattaaaagagtttatacttccaagtgaagtgacttaagcaaataaaaataattgtcatgtttcaataaaaattagtattttatcaacaactatttttaatttcacttggtcttgagtggtttccttatgttatactttagtctgtttcagtctcgtttttctggttagactatctttccctgctgatatttaatactgttagtaaatttaaaagaagcgtattagtccattttcataaacgaggtgggaggttgggatacttaagctgctttatgagcacagcaaaattctgcattgttttaaggatctgtacaaatatgttttcaccctacttccttcttttcttctgcacttaataaatgaaagcttcatctttaatgtgaccaagcaaaatacattctcttaaaaaaaaaggtcacgaccttgactgtaagaaatccccaaagtggatttataatgaattttccgaataaataatgactccaaatacatttacattaaaaatattaacctttaactcacctatatttttaatagcatataaagtgatatttgagctcaattcatggcttcgaaagaaagccttgcaggctttctataactcatattaaaggttaagatgattcataaatttttttccacagaatatggcaaacagatgactttgtagtgtgactgggactgaatttctgatgggcacagcaggaaacatttctgtaagtgcaaaaattcaaagacacttttgaaaagaagttaatatatgcagcgtaagattttaagctttcttacattgaaaaatgatcagcatagcaatgaagagagagaaataaaaaaaccactaatccaggctgaagttcattcatcacacacttccaattccttgatatctgcatgttacattaaatactgcagtggagaaaaacaaaaataagagaatccaactagaatggaaagacaatcaaagctatttttcttcaacagttgtctataagtttccaataaaattggggctatgacaagaatcgagcatttatacttatgcataaagtaagggctggtttctctaatagggctaattatcggacacctattaccaccactccggggacagcatcaatgaatcaaactccacaggactagaaatattctgactagtgtccaggataacaggagagctaccagggcttttggtgccacacacctgggtttattagggccagaattgctctccataacctaagaaccacccaaacatccgcaggataaatgcaaaaccctgggaaccctcttttttttgagagaagaaatatggaaggaaaaaaactttcctctattttgtagcttctaattaaaaggaatccatgaaagaattaattgcacctaaacgtattttactacgtcttacgttgtactgcagtaagtcttaagatgagctgcagaggggaatggattatgccttactaaggcatggaaagaggtttttttggttatattttaaggtctcaggtaaggcactgattaagagccagttggcctgggctggaaacctgcccaccacttgcctgccacacacctgccctgtgcctcagcttctcttttggctaggatgataacagagttgtctcactggggtgtcataagaagtaagtgcagcaggcatctatctgaacagggcccagcatatagcagtttcccaccacgcttgttattgtggaaggtacacagaaatggtcggatttctctgctgtgacgtccttccattcagctctcttgcggtaaaacgcttcagtctaagtgccttccttcacccagctgaaaggcagaacacttactcccgttttggataacagtgcaagctgtgagtcataactggtgtgggagacagagatagatcatgcctttccctattgttagtcatttcaaataaactgaatgtatcctggtttgggggtgatgcctttaaaaattttttttaatttaaaatttttttagttgactttatttttagaacagttttaggttcacagcaaaagttagcaaaaggtacagagagtcccatacactccctccctccccagaggcacagcctccgccactaccaccagccgccagcagagtggtgcatttgttaacaactggtgaacctacattgccacaccattatcactcagagtccatggtttacattagggtccactcttggtgttgtacattctatgggtttggagaaatgcataatgacctgtatccaccattatattatacagaatagtttcactgccctgaaaatcctctgtgttccacctcttcatccctctttcccaacctgtgacaaccacttatcttattactgcctccacagttttgccttttccagaatgtcatatggttggaactatacagtctatagccttttcagattgacttctttcacactgtattatgcaaagtttcttccatgtcttttcatggctaaatagctcatttcttttttttttttttctttttgggacagagtcttgctctgttgcccaggctggagtgcagttgtgtgaaatcggctcactgcaacctccacctcctgatttcaagagatccttccatctcagcctcccaaatagctgggattacaggtgcccgccaccatgcccagctaatttttgtatttttagtagagatgggatttcaccacattggccaggctagtctcaaactcctgacctcaagtgatccacctgcctcggctcccaaagtgctgggattacaagctcatttctttttagcactgactaatattctattgtctaatgtaccacagttacatatccattcacctagtaaagaacaaggttgcgctttttttaccccactgctctgggaatatagtttccaaaaattataaaaaaaaatacagagccgcttttagtatttctgaaggctgctctgatttgtctttgtcctttaaaagtctgcagaaaaaaaaaacaaaactgaatctaataaaggtgcttctgacatttctgcaacctaaacacgctttacttggtatcttccgtaccctcacaccagaagacgacacctttgttggttctgtttgttaaagactcagaagccagggccccagcaccacccagcaaccccccgaatcaaggtgcagcagaacccagcattcacgctgaaacacgtgtcctgtgctctgatgtagacccaaatctaacagccattgacatggactgttagatgacttccgttatcacctactgggataaaacctattttgttttggctaataaatactgttctatgtcattactattattattattttcgagatgaagtcttgctctgtcacctagtctggagtgcagtagcatgatcttgattcactgcaacctccgcctcccaggttcaagcgattctcctgcctcagcctcctgagtagctgggactacaggttcatgccaccaggcctggctaattttttgtatttttagtagagacagggtttcaccatattggccaggctggtctcaaactcctggtctcaggtgatccacccgcctcggcctcccaaactgctgggattacaggcgtgagccactgcatccgaccttcattaaatttaatgtattatttaaactaggatttttttatcagctttattgaagtataatttacataaaagaaaacccaaccatttaaaatgcacggttcctgacaaagtacagcctgataaactcatatggccatggaagcaccaccgcaattaaactacagaacattccatgtccccagagtttcccttgtgcttccctgtagccattctcttcccacaccccagcgccaggtgaccactcatctctcctccatcactagaatttcagaaaaatggaatcatacagtatgcagtcttttgtgtctggcttcttctatttagccatttgcttctgagattcacccacattacatgtatcaacaaggagaatctttttaaccccagaaatactctggctggaaagtagaaaactattcagcaaaagctactgtagaaaaacactccaagatgattaagaactgtattccacccctctcaaataagacccttgaacaacaagtgattcctattttaggacagcaaggagattgccaagtgatggatacaatgtatttattttttaaatatcttgctagctaaagacctttaaagatatttggagagagatgacatcagaaaaagtggcaaagacctaaaaattcactcctccataagaggaaaaaataactgaatgaaatggttagaatcaagttgctcataactctggaaattaaccaaaggcctgcagcaaccttggaagcatttcttcaagatgaagagctgaatctcggtaagaacagtaggatttggggcattttggcttgccctagtcccatcctccattcctcatctctacagtacccttgaaaaataaaagctcacatgcctggtgcagcctggaagccacttgagggaagggaacaaagctggatcttttccaaagtcccattcccaaataattctcatgatgtgaccattctggtgattccctagaagaccatacttacaaacctagttatatttgacctgaccctgagctcacccagtgtgaacagtcttttccctgggggtgactgtcaaatacatttgtaggcaagtgttttcactttgcagctgcctaatcagtagataatagttggggcaaacaatatattaatctaaacacttaaaaaaaatcctggggaataagatgcccatagcacttttgaaacgccccaatatatctctgggaatacagagtgccacatgcatgcatagcgctgtgcatatgcccaggaaagccctgagaaggctctaagctctcagatgacaactgccttgcagaatgtggaaggtgtgccccaagagtcacacagacccccttgtcaaagactgggagatgtactggctccaggcatttaaagaaatctctgtccaataactaggtaactcctaaactaacttggtagacaattcagtagccacacatgacaaagaataggctttacagaattcattcagaaaagtcatcaacaataaactatagtggacaagaagaatttgctttctagaggcaccacattatattagtgaaaatgcccagttttcaacaaaaaaaaaaaaagagaaatatgaagatacaagaaagcatggcccatattcaggcaaaaaaaaaaaaaaaagcaatcaatgtaagtgatccctggcctggcacagtggctcatgcctataatcccagcactttgggaggctgaagtggggagatcactcttgaggtcaggagtttgagacctgtctggctgacatggtgaaactccgtctctaccaaaaatacaaaaattagctgggcatggtggcacatgcctgtaattccagctactcaggaggctgaggcacgagaactgtttgaactctgccaggaggcaaggctgcagtgagctgagatcatggcactgcactccagcctgggcagcagattaagactccatctcaaaaaaaaaaatatatatatatatatctagctcacatatacatctcatacacacacatatatatacacacatacacacacacacatatatgacccctgagaaaggcatggtggacttagaagacaaagactttaaatcagttatttaaacgtattaaaagaactaaagcaaactgtctaaagaactaaagaaaaagatgacaatgatatctcaccaaacagaaaatattaatgaagagatagaaattataagaaccaaatagggctgggcatggttgctcatacctgtaatcccagcaatttgggagactgaggcaggaggactgcttgaggccaggagtttgagaccagcctgggcaacatagcaagatactatcattaacaaaaaaaatacacaaaaattagccaggtgtggtagcactcacctgtaatctcagctactcaggaggctgaggcaggagggagaatcccctgggcccaaaagttcaaagctgcagtgagctatgatcataccactgcactctagcctgagagacagaacaagactctgtctgaaaaaaaaaataaccaaatagaaattatagattgaaaagtacgataactcaaataaaaaactctctataggggttaaagagcagatttgagtagaccaaagaaagagtcatcagttaacctaaagataggttaattgaggttatccagcctgagcagcagaataaacaatgaagaaaaatgaacagatcctaagaagtgtgtgagccatcataaagtgtaccaaagtgcatgcaatggagtatatcaacaggagaggagagaaagtgaaaagggcagaaaatacctttgaagaaactatggccaaagacttcccaaatttgatgaaagacaacaatctacacatccaagctgaatgaaatctgagtagaataaactcaaagagatccatgcctagacatatcataaacaaactgtcaaaagccaaggccaaagagagaagcttgaaggcaaaagatcagtgacttaccacatacaaggggtccaaataagattaacagctagtttctcattagaaaacatgcaggacaggaggcagagcaaatggcaagaaaaaaaaaagtgtaaaccaagaatttcatatccagcaaaactatccctcgaaaatgaagaaaaaatcaagacattaccagataagccaatgctgagataatttgtctctatggaatctgccctaaaacaaatagtaaaggaagtcttttaggctgaaattaaacacacacacacacacacacacacccaggtgcacgagcgtgtgcaaaactagatagacagtaaattaaactcacatagacataaaaagcatgattaaagataactacatggatgctatggtttggatgtggtttgtcccagtcaaaactcaggttgaaatttaattgccaatgcaacagtgtttggaggtggtgtctttaagaaatgattaacttaagttggattaatgtctttctcacaagactgggttagttctctgcagaaaggattagttttgataagagttaattgttataaaatgaggttgcctctcacgtttttccctttttgcctttccctttatctgccatgtttggaggaagcacaaggccctcaccagaagcaggagatgcgattgtccaatcttgaacatcccagcctgcagaaccatgagctaaataaacctatttttttaaataaattacccaatctcagatattctgttatggcaacatacaacaaaaggtaagacatacagaaaacaaatagcatactgggagacataataattcctcatcagcaattacattaaaaaattaaactctccaattaaaaggcagaaatttcagaatggattttaaaaacatgatccaattacacactgtctataagagattcactagagtttgtcagtaaaaagtagaaaataatatactgtgcaaatgctaaccaaaagaagtttgagtaactatcctagtattagacaaaatcatctttaagacaaaaattgttactagaaacaaataaggacattttataatgataaaggcttaatcattcaagaatacagaacaattatagacatatttgtacataacaattgtgccagagtagcaaagaattagcaaagaacaacattctgaacagctgagctggtagctctatactgaaaaatgagaaatgtcatttgcctaaattattgacaaccggaagactgcaaccgagatcaagtgcaccctagaaagccacaggttttctatcctggctgcatattgaaatgatccacagagtctaaaactatagataccccggccctatgccaagaaatcctgatatagtgagtctgaagtaacatttcttaaagtgccccaggtgttctgaagtgcaggcaggataaggagacacgggcctagagtgtgagagcatgggctctgaaacatacagcctgggtttcaacctgagctctgcctcttactcgctccaaaaaaccttgaacatgactgaaccttgctgtacccacatcatggaagagtgtctggaacacatcatagaagacactaagaacagatttaaaaaaaaaactatcccagtaatgtgaaaatacatattctttattcatgtcgctagttttcagcatttagaaaggcacttataaatgttagccattactgtcgttgtcatcatcatcatcatcatcatctgtcatcatcatcatttgcccaggacaggcacaacttgaggtacctctgaaccctcacaatggacactgaagttggggaagaaagagacaaatggcagctttacctggtggaaaataagctcagctcttccctcttgagcctgcttcatcccccaggaagactaaagtggatcttgccagtcagcacaacagagctcccactttcaaagatggccttcacattctggaccacgcatactagggtggagtttaggaaaggtaaactgtgccaccctcccataccaccacacccccgcaaacacacacacacacacacacacacacacacacacacgaaaccaactaatccaacaacaccaactttctaccttcattaacatagtccttcttttgtaaatataaataggacaatgaaagatggcctgatattgagtgggaaaaaaatagcataaataatgacctagatgattaaagagaccagttaacctgtggggggaggtgagaatatctgataaacagaattctaattaatatacttgaaggagattgcacccattaaatgagtgtttcataaaatgtgaacatattgctatgaaaaaaagcaattagagaaaaacacagttcttagaaaataacataactgtctgtcaaaataaaaaattcaacagaatgatcaaacagtagaatggatacagctgaaatccaaagtagttatctagaaaataaaatagaagtgccccagaaagtaaagaaaaagagaaagaaaacattagaaaatgttaagaatcccataggatcaatttagaaggtagagcatctatccactaggaattcaagtaagagaaggcaaaaataaataaatagatagatagatagatagatagatagatagatagataaagagatacaatcaaagaattaatggaagaaatttccccaacaatttttcttgaactatccaatagacgaataactagaactagtttaataattcactatggtctgtgataaacaagtatgagatcaatacacataatttttccagaaattatggcagaaaatacagttggttcttgaacaacacaggtttggactgcataggtccacttacacatggatcttcttctacctctgccacccctgagacagcaagaccaacccctcctcttcctcctcctcctcagcctactcaactgatgacgatgaggacgaaggcctttatgatggtccacttccacttaattaatagtaaatacattttctatttcttaggactttttgaaatgatattttcttttctctagcttactttattgtaagaatacagcatataatacatctaacatacaaaatatgtgttagttgactatgtgatcagtaaggcttccagtcggcagttgcttacttgtagttaagtttttgaggagtcacacattatatgcaaattttcaactacatgaggggtcagtgcccctaactgccatgttgttcaagggttaactctatatccccatctctaaatattatagatattattttccaggaattaatctataaaatcaatgcaatcacaaaatcaaatcatggccactgtgtaactttacaaactcattctaaatttattgaagaatgcacagaagagcaaataatatgtgaaaataagtcatttgacttattataaagctggactagttaaaacaatgtagtgttgtcttagaaatgaactgatagattcattacacaaaataaagattaacaaacagacccatatctagcagtgaggtggtggaaaacatttcaaatggcaggagaaatactgaatcgttcaaaaaaaataatattgggaaaatggtcatccgttaggaaaagataaagttagagtcttcataccatatgtaaaaataagctttgattcaattaaacataaaaagaaaaattaaacattttagaaataaacaggtgaataatttcagaattatggtccaagagagatcttttacagtgtatattttaaaaagacactttgttaaaaattaaaagacaaacaaactgacaagacaaactgggataaaatattagtcacttaaaacagaaaagtattatgatcttaagaaaaataaaaagaaaaaataaaaataaaaataaggaaatgaggagaggtcccctccaaggagggacagtgacagtgaaggagaggagtgatttgaaagactagaaggtaagaaaatgacatattaataatttggttcaatatattgaatcaggtcggggtgaggaaggaaccaagggaacctgagtttaggttttagaataaggcaactgaaggaaagggagaaacattcctaatgagataggggagcaaaaagaaattagtttgggtttggagtagattgagttggggtccttgtaggataaatgctaacatggaggctcctccagtttagtctcactaggcagattcatttgagttaacaaaaaactaaactatagacctcatgtgaaaaattataagattgtgttgtgtttctgttttgctttcttttcattctctttattatttttttattttgctttcttttatttttatttttattgtctcctacttgagttgctttattgaatcttcttttgtagacaaataagaatcatataattgtttggatttaaatggttattttcaaattgcttaagggtattcgaaaacaacttctttccttgcaatttttaaaatgtccctttctaattgcttacatgttaatacagtcacacaacaaaataatatgcaactgtttaaaacagtttgtactaagaaatattagtgaatggagcaacagtcatgaaatactcctaagcagaaaaaaaaaggcaggttacaaaataggtgcactatgaatctaattttcataaaaatatgtacgcatctgtgtatgcatggggaaaaatggaaggcaaaacagcaaaatataattgtctatctctaagtgttgggatctgggatgatttttaaaaattgtcttgtgtttttatgcatttgctaaattcaaaacaatgaatatttaatatactagagtttaaaaattaaaaaaaagaaatctcacacatcaatgtaacacagtctcacagaaaaaatatgtacaagcaattcatggaagaaattcaaataggtaatggaatcttattctttgtttcgtttcggtcccatctattctttgtttcctttttcctgttttctgccttcttttgcattaattggatattttttattattccattccatttcctttgttggtttcttagccaactctttggggtttttggttttattttgtggttgctttaagctttacagtatacaactttaatttatcatagtttaccttcaggtgacattagacttcatcaagtatagtctaagaatcttacattgtatagttccatccgccctcctttacagtattttcacacaattacttattcaaatgttataaaccccacaatacattggtgcatttttttttcctatttttggttctttgcatgcattcagcttcttgaatctgtgggtttctagtttttattccattttgaaaaaaaattactactatttcttcaagtattttttctgtttgccctcactccttattccacatatattagtgtttctggaaattattccacaaagctctgtgatttttttccatatttttgttgaaaaaatgttttttctctgtgttcttcattttggagaatgtatattgcattgcaatgcctgtaagtccactaatcttttttcttgtctcaaatctgccattaatctcatccagtgaatttttttctctcttacattgtagttttcatcagtagaagttcaactgggttttttttatacctccatgtgtctacttaacttttggaacatacaattttaataactgtaatctttgattagatgatagacattaggaatgttatctagttggtgctggatacttttgtattcctatgaacgttctcaaactttgctctgggacacaggtaaattacttggaaactatctgattcctttggatcttgcttttaatatctgttaggcagaactggaacagcatttagctcaaggctagttattctccactactgaggtaaaactcttctgcatgctgtatacaatgcccaggtgaatcatgaggtttccaatctggatggtgggaaaaccctaattttgtgactggcacttttgtctctagtcctctcagatagttctttcatggcctcagtttctctacctacatgcaagagctgatcagtagcagctgaatattcacagggcttcctctccaaatctccagaaccctctacttgagtaagtctttcctctctggcactttgttctgcaaattctagccaccttggactcccaggctcagtatagcctccttaactcagcaggactgccaggctcttcccaggttcctgtgctgtggcctagaaaccttctcacaacaggaggctgcagcaatccatccccagaggatccagaggcacacctttctctacagttatgagaaataaatacgcgagaggaacctcagcatccctgaactcttcctggaggccacaaattacagttggaatttctgtgctgccatctaactagggtccctaaatgcaatgaagatgatgagaccccagggttgcaggggccaggtggcagctcttaattgccaaaggcatggtggatgtggttactgtgaagcacagagagccaaagcagccatcagagtagactggctcaccgagatctttggtgttggctctgaaaagccctgtttctctgattgagccgtgatggatacacgtttctgtctgggttgataaagcttagcaataaaaataaaccaccatctgagtaaggcaaaaagccagatccctcaaacaatgtaatataaaatgcaaacaatactaaacacattattggatctatatggtactcatattcccatagattagtgcttcttaaagtagatttactttgctttaaaaaaaaaaactgtcctaaactgtaactaatttgttattggtaaaaataaattctaaaaaatgttttcaactccatggttattagtttctcaacagtattagttattatgaataatctaatatccagttcagtgctactgtactcaaggttttaaaacttataccgcctgtgattgtgggagactgtttccattattcatacataagccatcacaagatggttcactgaatctttcaaaaaatcatctaatcagagctatataatctgatttctaattggcatccagcataatatagaacccgttatagtttaatgtaaggaagacaatgatctcaatcatagaagacactaagaacagatttaaaaaaaaaactatcccagtaatgtgaaaatacatattctttattcatgtcgctagttttcagcatttagaaaggcacttataaaacactatggtaaacacacacacacacacacacacacacacacacacagcatttcccttcttcccctccgacattgcattcgccagcctacaaagggaggcctccctcactgagtgctcacagtgagctgctgctcccctctctttgccctcccgcacatcagtcactccggcagggactgtacagctctccttcatctcgctctgtgtgtctgtaagcgcagaatgatgaaaagaaggagctgcagcagggctccggatggccttgtgcttgggagccctgcagaggaaagctgctgccaggagagcaatggcagcaccaaaacgctccagcagcaggggccactcatgcctgtactcagccagccaggcctgcagggcgaatggagtggctgcaaagaccttggagctgtgggcccaaaactgcttcttctcactatcctgagggatacgcccctttcagagagggcaactgactgtgtggtgtttatggaaggagttggggggagggcaggccagtgtgcccccctgggaatgaactagaaaactcactgctgcatctttagttgacacctccaggaagaaaaaaaaacaaatcattagcacagacaataaaagcaggagcttttattttaaaaatcattgaaatcaagacttcaagtcatgctagtgctaagtcccagggcagggtactttgctttctaggtcttcctttccttgcataaggtctcacacgtcatctggaaaacctcagttccattttgtggtccctgggaaaccatgaagggcttaacgaaggggagtgacacaggctggcagacactttacataccacccacggcatctgtgtgtgtgtggagaacggattggagaagagccagctttttggcacacagatctgttaggaggctactatatgagatgccaggcaaggacctgccctagaatggtggctcaaggcagagagaagacaggggcagctgcatacaaataaaatgagtcacggccaggcgcagtggcttacacctgtaattccagcactttgggaggccaaggtgggcggatcacgagatcaggagtttgagaccagcctgaccaacatggagaaaccctgtctctactgaaaatacaaaaattagctgggcgtggtgcgcacacctttaatcccagctactcaggcagctgaggcaagagaatcgcttgaacccgggtggcagaggttgcagtgagccaagatcgtaccattgccctccagcctgggcaacagagtgagactctgtctcaaaaataataataataataataataataataataataataataaaaaaatgagccacaaggagagagcttgtgaataagtatgatgggtgaggaaggagaaggatgtctgagtgtctccccagtttctagaatgggtaggcggtggtgtcatcaactgagacagaaaatacaaagggacaagaagatgaggttgaaggaatgtaagtcatgtgatacctaattagagaagaaagataatgtccacacagactacagttggctggaacaaaggaggatttgggagtcagagaggtttgggttcaagtcctagctcattacttaaggtgtggaagccttggcctcgctttaaaaaccttttttaaaaaaactcttttgaactttaaaaactcttaaaaaaaaaaaagagtaggaaaacctactcttgccaggactgttgtgaggataaggacatacaggtcccactcgatgaatggttaccatcattgtttacagtattttctttggtattattctggatagaacatctttggtcacatttccaaaactctgcggtgatggttcctgatggttccttagtcaactcggctagaccacagtacccagatatgtggtcaaacactagtttggatgttgctgtgaaagtatttttgtagatgagattaagttttaagtagaccttgaacaaagcagattaccctccataatgtagtgggctgcaaccagtcagtggaaagaagagaaaatgacggacctgctacagggaggagggaattccacctgctgcctcccttcaggctaaagctgcagcctcagctcttccctccatctccagcctgcgggccagcactgcagactttcgaattgcccgttcccacaactgcgtgagccaattctttaaaataaataaatctgtctatatacatatacatacatatataaaatttataacctagatatatatatacatctgtgtatgcgtgtgtatatctatctatatctgcctctatatctgtatatctcccattggttatgtttttctaaagcaccctaatagaactttatattgtagattttccttgcatctattgtgaatgcctttactcctcataaagccaaagccgaggctatctcaatggtcatgattcagagagtgagtttttgctaatgaaccaaaagattgcactgttgtggtcaacacagcagaagaacattctcatggtacagataaaaaactacccagcaaaatccatacacttccgtctgcagtgcagaactgcctctgggaagtgcctgtccagagaggcagtgcctgccacaggttcctagatgggcctcatgacaggctctcctgaatggcttgaaaggcaagcaatgaatgtcagtttcaggccaagaaaattaaactgctagggttccttttctgttctctattccctttcactgacttgccaggtccctgagcccctctgtgaagcctgccacaggccacgcctgacctggacaggggccagggtagccttgccctgaactgagccactgatagtcaggaggttgctccagcaattagtgtcaccctaatgataccctaacctccctacataaggcaaggaagtcagtcaagccacatgaaccccttctcctctgcctggggcttgggaagaaattagtccatggaaggtcagtgctgaccacctcccagagagcagactggccctgctccaactatgcggcagggctggggagcgagcactctgaacattctactcctgtaggtccagctgctgctacatccccccactgggatgagtcctgagaccccagcctgcttccctggcttccctgggacactcctcagccaccaccataaggggtcctaactcctcgtcagctataagcttatgcatcctgcatggtaaaatgcccagccctgtgagattcctgatgctgaggccagggctgggggtggcgcgcgggggtgattgggtgatggacgtcatttctctcttgtcttttcattcacacacccactctgcggaaggcggcttttcctttgtttagagagcttaatctgtctgcaccatgaaggtgggtgtggagtgaggaggcagctgtccccatgtcactgaaggcagcgcagtcaccacactgcataccccgaggatgtcaaccccacagtcagcctattcactgcatttccccttggcaccaagagccagcttcaaaataatccagcaaggggctggggggaggtggggggtggggagatagtgacaaaacaagatgggccagatgttggcatctgttgaagccagaagaggagtacacaggggttcatgacagcagtctgtttacttttacgtatgtttgaaaagttctaaataaaaatatttttctaaaaggaaattccttatatgagccgagatacagcagaagaggagcctcacctgactctaaggccactcctgtcttccctgataccatttcagggcgtcatggttactctcatgaaggaagaggtgtttttaatagacaaatgtgggttatttttctattcccattaatatttactacatgtcattatctccaagtctaatcacttaaagaggagattttaaataattgattaatataaaagaagaaaaatgccacgctgtctttttcattatctatcaaaacccagaaaacctcttcctctagtcctgacacagacacatacatatattaatgcatacactgagaagaacaggcatacaaatcaatagacacaaatctgctcagggcatttttccgagggaaaaaccattaacctctctccatctcccgcgtggcctgctcctcagcacaatgccacggcaattcaagtaactctttttattttactcacagaattttagggttcccccaaaaacacaaaaatctaacatttcttgaactctgataacatatattttgcttgtgcgatcatacatatgcatgtatagtgcataaacaggctttaatgtctagatgaaatgcatgcatccacacttttttttttttttttttgagatggattctctctctgcaccaggctggagtgcagtggtgtggcgcgatctcggctcactgcaacctctacctcccgggttcaagcaattctcctgcctcagtctccccagtagctgggattacagacacccgccaacattccccggctaatttttctaattttagtagagatggggtttcaccatgttggccaggctggtctcgagctcctgactcattatctgcccgcctcggcaccccaaagtgctgggattacaggcgtcagctgcgccaagccgcatccacacttttaaaatgcccttgttggccaggcgcagtggctcatgcctgtaatcccagcactttgggaggccaaggtgggtggatcacgagttcaggagttccagaccagcctggccaagatggtgaaaccccatctctactaaaaacacaaaaaaattagccgggcatggtggcaggcacctgtaattccagctattcaggaggctgaggcagagaatcatttgaacctgggaggcagaggttgcagtgagccgagatcatgccattgcactccaggctaggtgacagagcgagactctgtctcaaaaaaaaaaaaaaaaaaaaaaaaagcccttggttcacgctcggtccttacaggaggacagcaaaacaaaacaaacacaaagaggatgccctcggagcatctcagcaagacactgaggagcgctctcagaagcacctcccatgagaaacacagtgcttctcacaagcccatcagcattcagcagtgagattttatcaagctctgcttcccgctgcctgaaaagaagttggaattctcttcgccactgcctccaacctgctcacgcatctgaaggtggaaccctgctccaaggccacctggagacgcaggtgccacttaccacaagggagagaggcctcttccaggagacgacacctatgagtcccgacagcagcacctggaaggacaaaagatacaggaaggtgagatgcttccgaaaccttgcatgggcaatcaaaacactgtgaaccgtttcaacccggagaaggacgtgtggaacacagcacacacacagtggcggggctaccatgagctgcattttcacagcttgcacccactctgagaggcacattggtctctcagggcaccagggtgctatggaggggtcactttgtgcactgcactaggtggcccgagagtgacaggctttctgaaacaccccaccctggtcctcgatgtgatttggctgtgctaggcacacgcttgtattcctagctactcgggaggctgaggcacgagaatcacttgaacctgggaggcagaggttgcagtgagccaagatcacaccactgcactccagcctgggaggcagagcgagactccatctcaaaaaaaaaaaaaaaatcacagagaacactatttggggaaaaggcaaatgcaaccccacccacgggccacctggccacctgccatggttgcatggaccctgggcatggcagaccctgcaggctccttctgccctatacacacttggctcccctgatgcacacccttctctcccctccagcccctgcgagcccctccccttcactcatcacagcttcccacctcacccgtacataggcagtgtcttctgatgaggctccagaactttctaggccctgactccaagcagcccactcctttcccaggccaagtcctgcccttgaccttgcctggggtctcaccagaagtcatcccctctctcctgcctcctccctactgtcctgatcacatgaatacactgtgacttctgtcccttagaagaaccactgcttagccctgtgtccagctcctggcctgcctgtctcctaggcggcctcctgaggccaggcaacctgaggatgacactggctctgatccccacattcctgatttcctggtgtccaggaagggccaatggatcatgaagacacagtcacttcccacccactaccatctatctggcttcagccccacaactccaaggaaacttctcccaaggttccccagcagtcaccaagtgcgacagacaaagctcggtccccatcacccggctgagggctgaggctccctcccatctgggctcctgtggcttctcactcccctgcggttcttcccacttcccaggggccgctctcctccacagcctccctcctggcctcctccctctccccaacctcttcctggtttcccaacacctgtctcctgagccctttgtctcctctccccagggctctgtggtggctgtcctgaggctcctcgagtaccatccactggtatctgcacaggtgattctcagcccagggctttgccatggccacggcatcacaccgtccacaggctctgctcctggcatctgtccaacccaacatgtccaaaaatgcagctgcagcctccacctcagaagcccacacttcctcttgcaacctctgctctccacaagagtacctcttcttccccgtcactcaagccgaaatcctggagatctttccctctcccttacccccatgtccaaccagggaggaacaggaggctaaggctcactcaacagggcagcatgtgagaaggccgaattaaaaggaaggtgtttgcagaccaggtctcctgtgaagacaaattgctcacgcttgccactgtgggcacaagccaggcatccgggcactggctggaagggcttggctgcatgtcccctgagactccaaaagcactggccagacccgggaggagggcatgatgctgacaaactcacaaggtacccttggtcacagactgcagttcaccctcaaccacctccacagggggcagaaccaggtctcagacacagcagccactatcacatcctgcaccatgctagtctagtatcaaaaacatctggccacaaaacaacaaaacaacaacaaaaacatgaaccaaagcacgcacaccagggctctgctcccaagcctctcacacgtgtattttttctgcaacgctcacaagtcctccaaacacagttaccggcgacagacattatttacagccatttcccaccgcccgggtcccctcccatggccatgccacccaggctccttgcctcgcagtccagttccagccctagggaaatccttgaccaatgtctctcgtgtctctcaggggctgtgtctcactaactctccttccaaatgcccctgaaacctctctcttgccttctgtacccaacatttgaacccagtgggcacaccatgttcccatgtcatttcacagtcagaggacaccggcctttcttggaaggagatgaccattcccgccggagctctcaccatcatttcatgtttgacatttcagaccctgacttcactcctccacacccactttcttctttttgtgaattcaaaatttctgaccataatgccatcatgttttgagctcatggtatatagttcaggggccactccgtcactaagcaggatccattcttctgctcagcaccctccatttcccggttcatctctctgccctctgccggcacgctcctgtttcacctgcccgatgacagccttgtccactcgctcttgtctccacctcctccctccccactgaagccatcctggatgcctccaccaaacaaaccgcatcaccctggcctgacaatttagaccacaaagctaggtccctgattttccagcactggaggcacctcccttggtggccccactcctgtccaggccactctgggcacctccagggaggctggcaagggaggaaactgcacagcagccactgtgtgactcacctacaagccacagagctctgtgggctgtcttccctccacacccaacctccgagacagcccccatcttccagcactcccttcctgtccccagccctcccggccccagcctcagcccccgactcttcttatccctcaagttgagggccacattccggggctctggctctgactctgccatctgcctaggatgaaacttccaaaaagtgtcttccatttttccacacgccccaacactggcctcacgcagactaagcctggacagatggtgagaagaaacatcccctagaaaatggcgtcttctacttcccatgtctaccagatgaaatcttacccgttcttcaaccatggccccaccctcctcactcacgaagagcctaggaattcaagagcccagggggcccatcagatccccaaactaccaccagagtcctgcaggcatctttaataaactcagattgaacgccttgacctcttctcagctgaagtgtattaaactatcaaaattctacagtgactaagtcgcttgtagcaggaatttcactggaagtacataaaacttccaaatcgtagccactactccacctacttctaagcctgaaggaagttaatattgcttttatcttattaagctacagggagagttcttgaccttccccattcccataagcaaagctatcattccacaaatcccctcacagaatttgactttcaacaaacacgggtgacttgctcactgaagacaatgtgcatttccaagtatcattaataactacaactaggaatggatcaaattctcctacacaaagcaaaagaataaagccattaaacttggcgtggcaggcagaattctaaaatgacccctggtgacccctggccttacagaatgctctcccctgagtaagaatatgatgggctgtcactcttgtggtcttcccccagggacatgttcaaataacatggccccagcaacactctggttgcagccttgtgaaacctggccaggtgactcttctatgggaggggggcaaggaaatgctgggtagagaagggtggggtgcctggcgagggctccaccctcaggcctgtgcccatggacctaagtgagaacgggcaatcctgttttcatgcccaaatgttgcatcttccaagaccactctggcctcccatgccccccatcctgtgcccataaaaatctgagaccatagtgggcatggacacaagcagctggatgttgaaaggaggagaagggcacaccaacagacaccagcagacactggcaggccactgacggcgggatgacacagaatttggtcgagggcagtcggaggagagtccagccactggccggcctgactccaggggaagacaccttcccactccatccccgttttgctccccatccacttcgctgagagctacctccaccactcaattaaacctcgcacccatcctccaagcccatgtgtgatctgatttttcctgtacactagggcaagaaccaggatacagaaagccctctgtccttgtgataaggcagagggtctaactgagctgattaacacaagctgcctgcagatggcaaaactgaaagagcactctgtaacacacacccactgaggctttgggacctgcaaacactcaaccctagacgatgccgtggagatggagccccaaaacactccccaaaacctacccatcttcatgttcccccttggagtttgaacagcggggcaccgaagaagcgaaccacacccttgtcacacgcccggtgaggcggataagggaactcctccggtttcaactctactaagcaaggtccagactcctaacccaagaaaactatgaggtattaagtgagtgttgtgtcaagctgcaaagtttatggtcatttgctacacagcaacagaaaacaattgttagggactaaatgtatgtgaccccccaattggagatgttgaatccctaacccgcaatgtaatggtatttggagatggggcctctgggaggtgattaggattagactgggtcatgaggatgacgccttcacaatgggactggtagctctacacgaggagaaagcgagctctcacgctctccgcacacacacaatgaggcagaccattcagagtgcaagtcagttattggtgtataaaaatgcttgtgaattttgcacattgattttgtatcctgagactttgctgaagttgcttatcagcttaaggagattttgggctgagaccatggggttttctaaatatacaatcatgtcatttgcaaacagggacaatttgacttcctcttttcctaattgaataccctttatttctttctcctgcctgactgccctggccagaacttccaacactatgttgaataggagtggtgagagagggcatccctgtcttgtgccagttttcaaagggaatgcttccagtttttgcccattcagtatgatattggctgtgggtttgtcatagatggctcttattattttgagatacatcacatcaatacctaatttattgagagtttttagcatgaagggctgttgaattttgtcaaaggccttttctgcatctattgagataatcatgtggtttttgtctttggttctgtttatatgctggattacatttattgatttgcatatgttgaataacagacaaaaagagagccaaatcatgagtgaactcccattcacaattgattcaaagagaataaaatacctaggaatccaacttacaagggatgtgaaggacctcttcaaggacaactacaaaccactgctcaacgaaataaaagaggatacaaacaaatggaagaacattccatgctcatggataggaagaatcaatatcgtgaaaatggacataatgccgaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcacactacctgacttcaaactatactacaaggctacagtaaccaaaacagcatggtactggtaccaaaacagagatacagaccaatggaacagaacagagccctcagaaataataccacacatctacaaccatctgatctttgacaaacctgacaaaaacaagaaatggggaaaggattccctatttaaaaatggtgctgggaaaactggctagccatacgtagaaagctgaaactggatcccttccttataccttatacaaaaattaattcaagatggattaaagacttatatgttagacctaaaaccataaaaaccctagaagaaaacctaggcaataccattcaggacataggcatcggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgccaaagggctcatatccagaatctacaaagaactcaaacaaatttacaagaaaaaaacaaacaaccctatcaacaagtgggtgaagggtatgaacagacacttctcaaaagacatttatgcagccaacagacacatgaaaaaatgctcatcatcactggccatcagagaaatgcaaatcaaaaccacaatgagatgccatctcacaccagttagaatggccataattaaaaagtcaggaaacaacaggtgccggagaggacgtagagaaataggaacacttttacactgttgtgggactgtaaactagttcaaccattgtggaagacagtgtggcaattcctcagggatctagaactagaaataccatttgacccagacatcccattactgggtatatacccaaaggattataaatcatgctgctataaagacacatgcacacacgtttattgcagcactattcacaatagcaaagacttggaactaacccaaatgtccatcaatgatagactggattaagaaaatatgccacatatacaacatggaatactatgtagccataaaaaaggatgagttcatgtcctttgtagagacatggatgaagctggaaaccatcattctcagcaaactatcgcaaggacaaaaaaccaaacactgcatgttctcactcataggtgggaattgaacaatgagaacacttggacacaggaaggggaacatcacacaccggggcctgttgtggggtggggggaggggggagggaaaacattaggagatatacctaatgtaaatgacgagttaatggatgcagcacaccaacatggcacatgtatacatatgtaacaaacctgcacgttgtgcacatgtaccctagaacttaaagtataatttaaaaaaacaataataataattaaaatattcaggaactatgaaaaaaaaaaaaagaatgcaagtcaggaaggagccctcaccagaaaccaagcttgctgacaccctgatttcagactttccagcttcacaaactgcgagaaaataaatttctgttaggtcacctagtctatgctatttcgttatggcagcctaagtagactaagacactacgacatccggagtgggacactggattgttgttccaaaacatctgctttctccccagacctctccaggaggggcagcacaggcttccctccccacacccctccccaatcctggaaacactgacacagctcccaacaccaatgcttgagcgcttggaactgactgtgcatgcattgcttgctgttcatcagtgagcttctgtggagccaagttggaaaacttttccctagaaaggtatagttctgccagtaacaggaatgcacccaggatttggaaacactgtgatgctcgagggcctcagctcacagcacagtagaaatcccaggccaagcccctaccttgccgtgggcatcaggctcagccacagtgctatggtggacactcatgctcagggcaagtcccttctccagccacatgccgcctgacgctgctccctgtcattgtgactccagccacctgccactctggcctcaattcattatttgtttatttgtttcttcgggagtgggacactggatcattttttcaaaacatctgctttctccccagacctctccaggaggggcagcacagacttcactccccccacccctccctgataccggaaacactgacacaggtccaaatacgaaggccaaatagattgggaaaggcatgatattgctcagggagaggaggcttaaccctaatgacggagggcctgcagaatggcttgagggaggcttttcacggcccaggtgctggtgtgcctcctccctggagaggccagctctggcccactggagaccaagggcggttgatgtaaaagcagctcagagcctctgctctgaaaccatcggatcttgaactgtttttgctcaattccagctaccagcaaggattatgttgcacattctgacatgtcagtaatcctgtaggttgattttgcaccactctcatgagaaaaagggtcatgaatctagttagccatgaaattaccgcatcatgaaaccttcatcccgtttaatttacaggtatcattattcagagtccacagttcacaaagaatatggagaaaacgaagagggttggggaagagtaacatagaattaaatagctgtggaaaaaaagccaaatagattggaaaaggcatgatattgctcaaggagaggaggccgaaccttgcgagcaccatgagttgtcacaaggacgccaactcgctcttttctccacttccccacccagcctaatagaggcaagagataaaatcagaacagagacagaacttcctgctgttgaggctgatgacaagggataacaggctgccgggaaataatggcatccttagagtcaaagacctgcccatttgattggtaccctgcctggacacagaggtctggaataaattagctctttaaatcttgtcctctaacactgaaaagttcttttacttcctaaaatcaagaatgttcttcagatcataaagtctggtccaaaggcaactgatagtgaagcaagtccttctagaacgcagtcttgaaagccaagtaaattactttcatgaaacatatggcagatgggtgcccaatagctacagagatatcaatttaccactaagaagccagcattcactgtgtgtggaaagaattgttgcaaaaacagagcaaataatattctgagtccaccaaccccccatcttccaaacctcctggactgcagctctgtgcaatattcctcctacagcctcctggagcagctgatcttcctacttcaccctccgtcaattctccttgctttgggtgtggctttctttctctgagtcttgctggggccacagaaggctcacgaggcatgcaggcctctaccatctgtctctacctttgaggacacactcattgctacccccaccctgtccatgctttctgccccctctccttagggcaacttccaactcaccattccctctcccagcctttcatcccaggctgtggtccaaacatcctccacaccatttcccttcaggggctgcaccaacacatcacactcataatgtccctgagaaaagttacctttcttctcaacctactgatagaaaaagaactctgcagctttcattatcttctcaagcagaagcaaaactataaattgatgacaaagatcacctcatgaaagagaaaaaactccttagtgttgaagtgttttaaaatattctaaataactcatgagtcaaaagatactgaaaggtgaaatacaccatggtctgttctgatgcaatgcatgcttctttgatgcacattctctcttaagtgcttggtaacaaactcatttgtccagggcctgccctgtaagatgctgcctcctcttacgggtatctactctgacattagggtagctgctggattttgttacttagtgggttattaggtagcacatatattattataatacattttaaaatatttttagtttaaaaatttcaaaataatttgtttcctttgtaatagtttttttggttttgttttttgttgctgttgttgttttgagacagagtctggctctatcgcccaggctggagtgcagtgacacgagctcggctcaccgcaagctccgcctcccgggttcacgccattctcctgcctcagcctcccaagtagctgggactacaggtgcctgccaccatgcctggctaattttttttcctattttttagtagagacagggtttcactgtgttagccaggatggtctcgatctcctgacctcgtgatctgcccgcctcagcctcccaaagtgttggaattacaggcgtgagccactgtgcccggcctttttttgtattttttagtggagaaggggtttcaccatgttagccaggatggtctcgatctcctgaccttgtgatccacccgcctcggcctcccaaagtgcagggattacaggcgtgagccactgtgcccggcctgtaatagttttatttcatgcttttaaaaaccttattctgagaagggatccacaggcttcactagattgtcatgacaaaagttatgaccccccccacccccgaccccgattaaagttcctttagagcagattttttggtgataaactcccgtttttggtttatctgtaaatagcttacttcgttcgccttgatgcttgaaaaatagttacgctggaaacaccctaggttgacagttgcatctctcaacagtttgaaactattattccactgttttctgactgccattgttgcagccaagtcagctgtcctcattctctaaagacttttgagatcatctccttgcctttagtattctgaactttttgcctggtatgttaggtgtggatttctttttaatcttctttgagagatactgtgctactgaatctgtgaatttatatttttcattcgttctggaaattttgtagctaatatctcttcagatattgtatcttcgctattctctttgccagggactccagtagctgtatgtttgtccttcacattccatcctccaaatgtcttagtttttcttccacatattccccacacatgtcattcatgacttcattctggttactttctttagctgtgtcttccagatcatcaattgtctctgcactgtgtctaatcagctgttgaactatataactgcacttgtttagaaaagttcagtgattatatctcaatatctagaaattcttttatttccaaatgtaactatttatttcaaatagttccttgttgtgtgctcatctatatgactgtgttgataatttctttaaatgtttcatacactaatgttctagattccaagacatgttgtcccaggagggtatcaaagtttgccctttgttgtctcattgtgatttgctttctttgatgcttgagcgcttggaagtgtttgactgtgcatgcattgcttgctgttcatcagtgaacttctgtggagccaagttggaaaacttttccctagagaggcatagttctgccagtaacaggaatgcacccaggatttggaaacactgtgatgctcaagggcctcagctcacagcacagtagaaatcccaggccaagcccctaccttgcagtgggcaccaggctcagccgcagtgctatggtggacactcatgctcagggcaagtcccttctccagccacataccgcctgacgctgctccctgtcattgtgactccagccacctgccactctggcctcagttcattatttatttgtttgggagtagggcagtggaccttgatgatctgcaatgcatcaaggagcatgtcttttgcagtgtatagttgttctataggagaagcatccttcaaagtgcctactcagccaaaatgccagaatcagaaggaaatcccccattcctggtgtttttattggtcccataaatacaccaataaagcaatgaatagaggctacttttatttttttttaaattaacaaatgttataagttatcaaaatatgaaactttatttagctaataaaattctttataaattccaaagtattccacatatcctattatttatttactcttttagccccagcaactatatttctcaaatcactttactttcaaaaaaacaaaatgttatcccaaattattctttccctccattttcccctggaaaaaaatattactcccatccaaagcctttctaattcagtagctttcctacatgctggtaagaaactgtaagacaaggattccattcacaaaagcaaaaaaattaaaaactatccaagaattaacttcatgatgaatgtataaggttttttaaaaggcaactacaagactctactgagacataggaaggaagatttttagtaaatggacgtatataccatgttcccaaatgaggaaacctaaagataataaaaatgttaatttctctatattcataaattaatttagtgaaatctctatcaaaatcccaatgggattctttgaaggttgacaaaatgattcaaaaatttatctgaaggaaaaatttttccttcagatagtagagaagaaacaatgtcattgaactatgtggagggaaagaggtttatgtattactggacacaattttcatcccttcattattttaagttaaaaattcccaggaacaaaaacagtttagaaagccacaatagttataagtggctcaagaacaaacagacctgtaaagaacagaatataatgtccagaaagagacttaggcatatattagggttttaaaaaattatttgttttttagattgtggtaaaatgtacatacataaaatttaccatttaaccatttttaagtgtacactcagtagcattaagtccattcaccttgtgcaaacattcccctcatccatctccagaaaacctttcatcttgcaaaattaaaactttgtatccattaatttacaccgattccccattccctcccccactctagcccctgacaaccaccattcttctttctgtctctatatgagtggaatcatagttttatccttttgtgacaggcttctatcacttaggataatggtttcaaggttcatccatatgtagcatgtgtcagaatctctttttttttttttttttttttttttgagacagttttgttctgtcgcccacgccggagtgcagtggtgtgatctcagctcactgcaagctctgcctcctgggttcatgccattctcctgccttagcctcctgagtagctgggctacaggcgcccaccaccacgcccggctacttttttttgtatttttagtagagacggggtttcaccatgttagccaggatggtctcgatctcctgatctcgtgatccgcccgcctcggcctcccaaagtgctgggattacaggcctgagccaccgcgcctggcctctccttcctttgtaagtctaatagtattctgtacgtatagacctcattctgttgagccactcgtctacagatggatgcttgggttgcttccaccttttagctatgaggataatgcttctatgaacacaggtgtgcaaatatgtctttgagacccttctttcaattcttttgggtatgtacccagaagtgaaatatggtaattctatttgtaataatacagagtggaaaacagtataaacctcctcaataattacaaatagaattaccatatggctattatttttataatagccattctgatgggtaggaagtggtagtcattttgattttttctcttttttctttctttttttttttttgagacagggtctcactctcacctaggctggagtgcagtgacgtgatcacagctcactgcactttcaacctcctgggctcaagcaatcctccctgctcagcctcccgagtagttgggactacaggtgcatgccaccacacccagctagttttcgtatttttttttctcaagagatgggggtttcgccacgttgcccaggctggtcttgaactcttgggtgccaacgatcctcctgcctgggcctcgaaaagtgctgggattacaggtgtgagccaccacgccagccattgttgtgattttgatttgcatctccttaaggattagtgatgttgagcatgttttcatgtgcttattagccatctgtatctcttctgtggagaaaggcctagtcaagccttttgcctatctttgaagctttcctcccagctttattgaggtatgactgacaaataaaaactgtatataaaatgtacaacatgattctggtatacatatactgtgaaatgattaccacaatcaagctaaccatatccatcacctcactagttaccatttcttctgagtgtttgataagaacatatgaagtctctttcagaaaatttcaaatatacagcacattattattaagtatagtcactatgctgtacattacgtctccagaatgtatttcttttataactgaaagtttataccctttgaccaacatctcccctttcccctctctcccccagccccgggcaactacgcttctcctctctgttaccatgagtttgactttttttttttagagtctacggacaagtgagattattcagtattcatctttctgtgtctggctaatttcacttagcataatgtcctctgggttcatccatgttgccaaaaatcctttgcccatttttgaattgtgttctttacttttttgttattgagttttaggagttttctatatgttctggataataatttctgatgaaatatgtgattttccagtactttttcccattctgtgggttgcctgtttactctcttaatagtgtcctttgatgcacaagtttttaattttgatgaagtccagtttgccacttttcttttgttgcttatgcctttggcatcatatccaagaaatcactgccaagcccagggttgtaaagcttttcccctaagcttccttctaagagttttataactttagctcttatgtttaggtctttaatccattttgagttaatttttgtataggatgttagttaagggtccaacttcattttttttgcatgtgaacacattaaattagtttttacaatttaatttatataattcagttatacaaggagtgacatagtaactgatgggggaaaaggctattcaataaatggttctgggataattgttaaatgtaaataaataagcagatagagaaattaaaattagttccctcccacaaaccaaaatacattacaagatgattaaaatattaaatgtaaataattaaccacccaggttactggctaaaactcacagaaaggcaactgctcctcaaaaaaatttactgagaggccaggcacagtgggtggctcacacctgtaatctcaacactttgggaggccgaggtgggcagatcacttgaggtcaggagctcgaggacagcctggccaacatggtgaaacctgtctccactaaaaatacaaacaattagccagacatggtggtatgtgcctgtagtcccagctactcaggaggctgaggtaggagaatgtcttgaacccaggaggcagaggttgccgtgagccgagattgtgccactgcactccagcctgggcgacagagtgagactccatcttaaaaaaaggaaaaaaaaatttactcagaaaaacaccttataagtaagtaatcaataaaatgcaaagtggaataagaggtcccttgctgcctgtcaagctagcagtggttagaaagaacagtggtcctcacttacagggctgtagagaatgtacatcattaagaggtgcgatgctgtcaactggcaaaaagtataataaacaaagcatgggctctatgcaaataaattcaaaacccaggatgacaaagataacttgctaaattactacaattgattccccaaaagaccaaaacactaactgttcccataaacaccaagaaattggaaatatgctcaaacagctgtaggcaaagtcttcaaaaacttctacgtatgaagatttccaaagctgtttaaattttttctgagcacagagggaaaaaagggggaacttccaaattgtctttataaaggtcagtgtaacaatcacaaacctgtaaaatatcacaaaaataaggaacagaccagtggcttttaaacagaagtacattgtttttattttatttttcctgtgctggatcaatatttaatgaatttcccccatgtatcaggcattgttggactctttcagatatttaactccttccccctcattatttatttggcaaaagttacattaagttattccctcccctcacaaagcaggttctccctgacttcaagggccaacatccaaacaaaaccaaacatgaaagacagagactcaaaaacttagcattcctcatctactacacatactagatataaacacacaaatttaaatgccaaaaactcataggacagtgcattaaaatgataattttactggtacatcatttttaaataaaaggttagaaaacagaattcagcagtacatttaaaagaatgaagaacatgggggttcacgtcaggaatgaaaagatggttctgcatattaatgtgacgaaaatgaaaaattctttcattcagtagatgcatggaagacgtccaatagaatttgatctccatcctctcttttaaaaaagaactcttagggctgggggcagtggctcacacctgtaatgccagcactttgggaggccgaggctagcggatcacttgaggtcaggagtcctagaccagcctggccaacatggtaaaatcctgtctctactaaaaatacaaaaatcagctgagtgtggtggcacatggctatagtctcagctactcgggaggctgaggcaggagaatcactggaacccgggaaacggaggttgcaatgagccaagatcacgccactgcactccagcctgggtgacagagcgagactccgtctcaaaaataaaataaaataaaacaaaatgattctgaaagtactcgtgtggtatgcagaattatgagatggcccccaaggtccccactccctggtgtacctgccctgtgtaatcctctcccttgggccgtgggtgggactgtgaatatgtatgtgattaggttacgctgcctgacaatggtggatgggaggtcccaaatcagtttgctgttgagttcatcaaaagggaagttctcttgggtgtgcctgacctaatcaggcaagacctttggttctgggcccttggtgaagtcccaatttgaggtgtaagaagttgtgctgctggccttgaagaagtgggctgccatgtggtgagatgcctctaagagctgagagcttccccacccacagcttgcaaggaagcagggctgagtcacacaacccccaaaatgaattctgccaacaacctgaaggagtttggaagtggatctttccctcgtaaagcttttggatgaagatgcttccagcctcaccaggatttcagcctgcagaccctgaggacaggacccaattaaaacactccagagtcccaacccttagaaactctgaaataataaggttgagctgtttgaacctgctatgcttgtggcaatttgccacataacaatagaaaactaatatatctagctaataacactaaaaaggaaaaataaaagaaagttataaacattggaaagaagaagcaaaatcattactatttgaaaataaagtgatcacctaattagaaaacccaaaggaattgattcagaagaataagaaaccataagaaaattcagtatgttacctggttacaaaatcaatatgttgaaaattataatactatatatagttgtcccttgaacaagaggggtgttaggggcaccaacctcctgtgcagtcaaaaatctatgtataacattttcactcctccaaaacttaactggtaatagtctgctgttgactggaagtcttaccaatcagataaacagttgattaacacacattcacattttggatgtcgtatgtactatatgctgtattcttacaataaagagaaaagaaaatgctattaagaaagtcataaggaagagaaaatatattttactattcattaagtggaagtggatcatcataaaggccttcatccttgtcatcttcttgttgagtaggctcaggaggaggaggaggaagaggagggctcagtcttgccatttcagggtggcagaggtggaagaaaatccacatataagtggacctatgctgtttaaacgcatgttgttcaaggtcaacaggatcaatatttattgtgccctgaatatatgccagatatacttactaagtttttatactttatcctgacaaccctaattagtatgtgtgactcttgtgcccgtgcacatatgtgaaaattaaagcacaaagagattaagtgacttgcccaacgttacaatgatgggcagggttaggacacaagctcttaaactatagacaaacagctttcctacatatgtgcaagcaaagactggttagaaaagagaatacaattaaaaattccatttataatggtaagcaaaaaggcagaatatcttagaatacacagatttaataagaggtgagcaggagcaatatcaaggaatccttaaacatctactggggaacctaaaagacttcatgactagatgggagggaaattcattttttaaacaaaaagactaaataatgtataagttccatgcaactctaattaaaataccaaaaaggggaaaagaaaatctacgcaataagaagtgctagggcaactggctagccacttggaaagaaatgaaacttaatctctacgtttcaacattaaaataaattccagagaaatcaaagagtaaaatataaattaaaacataaatatttgagaaatttgtaaaagaatcttgaagtaagccttttaaggcaccacacaattttaagacataatagaaacaattaataaatttaaaatgtatacgtttatggctaaaaaaacccacatttgtttgtggtaggaggaatctgtgttctcaatcccagggcctctctgcatctgcattagaagaacaagtctgtgcctttgacgtgtgaggtcggaggctcctgcagagtgggtggagtcccgtccccatcccagaataaacttggccatgggatatgcctggtggtgagtggaagtggcacatgccatcgccccgggccttctgatgcactacgtgctacctcttgccctcctccttgcccaggtggccactgccccttcaagcctgggccccggaatggacagatggcacagacacaaaccccatgagaagcttgcaacccaaagtggagccaccccagctgacctgcaaacccagaggagaaaataatggctcgctactgtcaagcactgcattttggtgtggtttttaatgtagcattattctgaaaagggccaatgaacacatttatggttaaaaaaaacccataaaaccaaaggctggtttcaaataggaaaaatatttataatacataaacagacaaaaggttttcttaatttacaaagagctcgtataaattaataaaagaaacaacagaaaaaaatggctgaatacgatgaataggatgtttagatttttaatgaacaataaacatgtaacagaatgcgtagacctactgaattttctaaagcaagtgaaaacaataagataagtatttttttcaacgagactggaaacattttggtgaagttttggtaaaacccagtgatggcaaagggcagaggggaaagaaagttcctcttaaacatttcttatgttggcataatttgatgtagccttccttgggaacaatttcatagcatctctcaaaataaaaactgtacatacccatactcaatggtttcaatcctgggaatttaacctgtggatatactaacagaaacaggccagcctatttacacaaggacgtttactacaaaaacctgaaccagtgagtagcaataaagggctagttaaaaagacttcggtatttacatagaacatgaatatgtgcattataaagtttgaggtagatctatttatgccactgtggaatgatctcgaagataaataactgacaagcaagacacagcccagtgtgcactgaaggatctctgtgtaaacaagaaggaatggatgaatgcatttactacataaacattgctctcttggaacgacgcacaagaaacctaacaatcggaaactagattaaggaggaggcgagggggaacttgcttttaaatgtgtaactttctgtaatattaacctttaatccatgcatgtattatgttaagcatatttaaaactctgcataccattgaacctagaattctacttctaagaattcccagtattaaccaaaggattatgtattttggaaactggaaacaaccgaggtgtgcagcaagagggaattacatatattcattgggtccttcctagttgctgccattaaatcatattatagaagaatatatatatatatacacacacatatatatgtatattgtattgtgtgtgtgtgtgtgtgtgtgtgtgtatatatgtatattggagacaaggtctccctctgtagcccaggctagaatgcagtggcatgatcacagctcactgtgacctccacctcccatgctcaagtgatcctcccatttcggcctcccgaatagcagggaatacaggcatgcatcacccggctgatttttgtatcttttgtagagagagggtttcactatgttgcccaggctggtctcgaactcctggctcaagtgatcccctcgctgtggcctcccaaagtgctgagattaaaggtgtgaaccactgtgcccagccacaggagaatatttaatgccatgtagaaacgttcacactaagtgaaagaagaagaaggaaaagcaggttgcaaaatggtgtggaaagtgcataatttcccttctgagaagcaaacaaatacataaagaaaatcagcagctgcatctcaaagttaccatggttatctccagacagtgagattttggcttcctctttatttttctgtttcccatggttgatacacaacagagaaaacgcactattaaaacccaagccagcgacagctggttctgcctcctaagtgaggaggcataacccatgccagtgggtactaactccctctaatgttcccatcagcaggcgggagaggtggacggggccagacaaattccaccacttcaatgtgagggccgatggcttcagaacaggtatggaaaggctctggaaacaatggcggccagtctgagtgagaggcagcaaaccagaatccctgcacagtgacggggtccaaggtggcaggatgaccaacaaggtgtgtaggggagggacggggcctgatctgcacagaaagtggttagccaggtggccatgtacacttctatgtgggctgctgctccttgatagagaataatgagaatttcagacataaatgcaagctacaagaataaattccaaccaggacccaaacgtattcaagagcctctgcccccctccctttctcaacccattgtcagaaaaaagtatgaagtgggaaggtagattgccctgcttgaaaaagagtattacataaaccatttgcaaatgacttttattctcttcttttagaaatctcctcatggcacaataataaaaacaatgtatttgttgatacagaacattaattccattaaaattgcattatgtgtaatgaaaagctatcagagtataattatgcaagcaaattcacagactcacatcaacttttaaatccactggaactatacaataggaactgaagctgtctggtagacaaattgctctttcttttccaaatcattatgaataaaggccactgtactaatgtcataaaccgcacactatttatgcaaactctcaaatccaggactgttccctagaggtgcctctgcctggtttttcccaggaccaacctgttctcagacccagaggctgtgctcccattcctgacttagccccaaagcaggctcccttctcggaattcttgcccagagagcccagttgtaccctgaagggagcctggttgcacccccaaagggttgcctgaatccgcacactctcagccctctgccccagcctgggagctgtgctctgctctgctgcccctggctggccgctgcagggcccgcaggctgctctccctcctccctgctgcaggtactgcacccaggtggccctcctgccatctctgctcacaccaggcagcgccacccacagagactggagtgcagagcccatctcctgtccccacgaggttctgagaggaggcagagggccaccaggacaggggaggaagggggcacgaggctggattcctgcaagggcacaggagtacatccagtgccgcccactcccgctgatgatagccccggtgaaaagacacaccctgggaaagggactcagtctatgcccctcactcatcacctatgtccatccctgggtttagacacttctaggatccccaaacacagtagggatatggacaactcgtgccatgctggtgacatgaagggaacccccccatctgactaagtggtcccagcacccttgtaatagccgtctccactccccagtcctgctcccctttcccctcactggcacaggcagaactcccctgtctggtcagttctgggtcgctgagtcccaggaacccccttcagcacccagcaggctgacactgatcttactcctgctttgcagaaggaacaccctcctgccttggccgcccccttgcttcctcccccactcacactccccagctgctcgttagtaagggctccctcggcccatcatctccccatacctcccctcccctcctcgcagtatctatcctgggagagcctgttccctccctggctccatcctccagggtaccctaagcctctctcagcctctcttcctcccagatccctgtgtccacccactggcctgatggaaacatgacggatgcctccccagcagcctaactcaatacagccagtgctcctggagcctgccctacctccacaggaggccccactcacccagatgtgcctgtcagggtcccagataccccacgtccctcccccacccaatctcactctcaaatccatccaaatcagggacatctactgaccagctcaccctgggccccggcccccagttcctccctccacctggtacctggctgccacctggcaggagagctactgtaagagccctacaaagccctccctgcctggactcctggtcacttctaacctgttttccacactgcagaatcatctttttaaaatgcaaacctggctgggcgtggtggctcacacctgtaatcccagcactttgggaggccgaggcgggcagatcacctgaggtcaggagttcgagaccagcctggccaacatggtgaaaccctgcctctactaaaactataaaaattagccaggcatggtggcatatgcctgtaatcccagctactcaggaggctgaggcaggtgaatcgtttgaacctgggaggtggaggttgcagtgagccaagattgcaccattgcactccagcctgggtgacagagcaagactccgtctccagaaaaaaaaaaaaaaaatctgaccatgtcactcgccccactcaatgacactgtgccctttaggggctttctttatcccttggagtaagtcccacatcttccagctcagaaggtccctgcctacccttcctgcttcatccaggtcactccatgggtggggtcacctctgcctccccctcaacccccaaacagctaattacccagactgggtagcaaacagctacaggaccacggggctacggcaccagcaccccacagtgccgctcactcatgcacctgcctttggctgctcagcaggtcctgggggcccagagcacgcttgtttcatctgcacagtgcccaccggagcaagggcctggtgccatggcacacatgagagtgaaggctgtcggcacgcacaaggttggccagcgcccacctccgggcgggagactttgtgcccatgctcctgaccagcttcacagccccacggaggcagcacggtcctgaggggcagtgtgctgacttttcccctttattttataaccaaaacaatgcaagttcaatatagaacaagttaggaaaggcagataagctgaaggaaataatgaaaccatctacattcacacggcttctcctctaactcctgttaacatgtggctgggttctatttaaatcggtttttataaaaattgggtcatcatgttgtcaataacctttccacattaccatataatgtgtcatgatcatgatggcacaccctgtaggtattcactgacatcaccttaatggctgaatgggactccattgtataaaaatacaaaatactcatgacctattattctataaacatttggaatcacaaacgtatgtgaaaaatatattttttaacaagcttatgaaaagataaacataagcctgtaatcccagcactttgggaggccaaggcgggtggatcacttgaggccaggagttcaagaccagtttggccaacatggcgaaaccgcatctctactaaaaatacaaaaaattagtcaagcatcatagcaggtgcctgtaatctcagctactcggatggctgaggtaagagaatcacttgaacctgggaggcaaaggttgcagtgagccaagatcatgccactgcactccagcctgggcgacagagcgaaactctgtttcaaaaattaaaaaaaagaatattaaaaaatatattaaatatatgaatatatttttaaaagtatttcattttttctgatctagtcattcttacacaatctgaagtcaaaattgttctgtagagaagctgccacttacaacaaatagttttgcttgtttcttcagtttactttcacatttctaaacttgatgctttgactgacttctgactatgaaaattgaggattctcactttcccctccaacacacagcagacacagccaaatgcacacactcgctctccctctcctcctcactttcccaatccaaatatagcaacaacccaccttttgatatttcagcattcagtattggcattattatgactacgtaaaatgtcacccataactgagccacaaggagtactacaattacagtgcctttaaaaaaaatcacatcacaatatgtaactggggttaattgcctcatttttcacttacatcttctacacagtcacacatgatttaacaacggagctatgttctgagaagtgcgcccttaggtgagtccatcattgtgtgaacctcacagaatgcacttacacaaacctagatggcgaagcccactacatacctaggctgtatggtacggcctactgctcccaggctacaaaactgggcagcatgttactgtcctgaacactgtaggcaactgtaatacaatggtgagtactttgtatttaacacatctcaacataataacggtacagtaaaaacatggtattagaatctcatgggaccaccattgtatacacagtccgtcattgagggaagcgttggtgtgtggtgtacgactgtatatctatcaaaaattcatcctagctctccaacagccctgaggtctccctcaccatgtatgagcacatgaagtctatcaaaaaatgagggagcaaaccaagaaaagagaagacatgggctcaagaaaacagaggctctagcccaggagagaggcgaaggggagtcgaagacccagggaagtccctaggagccatagtgcaccaggccagggcacagccaggtaaggagggagcaggtgacctgggtccaagaaggacatatctcagcaaaccagagtggtttgctccccatttttttgggttggggggagcccgagtctctctgtcacccatgctggagtgcagtggctcgatctccgctcactgcaacatacacctcccaatcaagcgattctcctgccgcagcctcccgagtagctgggactacaggcacccaccagcacaccccactaattttttggggttttttttgcatttttaatggagatagcgtttcaccatgttggccaggctggtctcgaactcctgacctccaggtgatccacccacctcggcctcccaaagtgctgggattacaggcctgagccactgcacctggcccacattttttgatagaccatatcctccactaactttcagagaaaggatttacagtaggtgaaatctgagggaccctacacgtttaacatgtaaggacagaaattttaggttgcagattattttgtctcagaactttttaggcaacgatctaatatgtgctgatctccatggtggctccagagtggtctgattcatcagcagatactggcaaggaccagctgtttaccaggcactgttctaggcacaggggatccagcagtttaaaaaaaagacatgcatagtgcctccctcatgacatcctggggagcagcagaggagggagacacaaaaataagagtgaaaccacatggcatgttacacagaatgaagaaaaataaggtgggaaagtgtgggctcaggagctgggaaatcctgggcttgtaggggtaacagatcccaaaaggaggaacgccctggtgggatggatgccggttcctgatggggatatacaggactctacaatggtgagacggtctttgtttttattcactgggtgaagtatgagaaactgatctgaatctgcaatctcctttcagttctgagaataactcctgtatcattttgcaatgatgattctacttcctttggtctctgcaaagcctatttatattctctggctgaccctctcatttactgtcttccctatttccaacttcctggtctttttttgttgttgttcagttttctgagagatttcccccaatttcatctttcaagcctttgatgatttttaaactttatattctgaaatttttcaaatagaaaagtacaaaaataagaatgttcaatccatctacttagcctgtcacgttaacaattttactatatttgcttcatctctttttctttgcttttcaagataaattacaaaccatgacattttaagtttttcaatatgcatacctaaaatacaaggacatttttctatataacctgtgaggccattaacacatctaaaatatactaattattaatagatcatctttgtatgatttcatacccaattcctattcaaatttcccagattgtccccagaataacttcttgcagttaatttgttcaaactagcttccaatgcttaggaatttgttatgtgcctacatggttgtaattttgttaagtagctttaaattttcagcttgttctttaacccacatgtctccggttttcagggtaggcaagggttttaatacaattatggtttcatcccttcacacatcccacatctctttctttgctagtataatctagaattttagattcaaactcatattacattgttttcatattatactcagtatcttttttcctttataaaaattaatttttcttttttttttggagatggagtctcgctttgttgcccaggcaatctcggctcactgcaacctccacctcctgagttcaagcaattctcatgcctcagcctcctgagtagctgggattacaagtagctgccaccacacccggctaatttttgtatttttagtagagacaggtttcaccatgttggccaggctggtctcgaactcctgacctcaagtgatctgcccaccttggcctcacaaagtgctgggattacaggcatgagccaccgtgcccggcctatttttctttttttttttttaaagacagggtctcaccgtgttacccaggctggtcttgaacaccctggctcaagtgatcctcctgccacaacctccgagtagctgggacttcaggcatgagccacctcgcctggctatattctgtgtctttcgatgttttttaaatttccactttccagttataactagtttcagtgttctgcattagttctgcttagccatgattccaccaactcaagctgctaacttaatagctcaaacgttgaatgacatcttcacgagactcctgtgagggtccccaaagcccccgatacctgagcatatcttcagggctcccaggaccaatatggactgctcgcctgctcagctatcatcacgtctgaagagcaggtcgccctagcgcaggtctggattcacagactttcccctcaatcactgcagatgctgcgtgcctgccctctgctttatcatagcagagaactctaaggcctgtctctttgtttgtatgtttgctttgctgaaaataaggtcccctacctagatgcttgtggaatcccattcttgaatttgcattgataatttcctttcctttctctctgaaacttttctggcatacttagttcatctccgcaagacagtgtgtttggtgttgcttgtttttgcactttacaaaaacagtgtcatagaaaaaacatagtattttttcatgtggtctcacaggcagagaactaattggctcctgcactgcaggtctcactcccctgcaggggctgctctggtggaagccagagcagggctgccccaggagcagccctggggcaacagagacttgaggcgacgggtctcggggaggcaagcctgaaatgtgctcggtaactgcactccagtcccctcaggagccagcacgatcacccgccgtagccaactgggtaacacacttggactagctatccttcctccctgcctccctctgccttcctgactgtgctctgcgcaaacaagagagattcctgctagtcctgctctcagtctgctttcagggtcatccaggctaagaacattcacgttcctaagattcctttatcatgttgttgcacacagctatagtttattcactttcactgtggtataacaacagtccatttcgttagaccacagaacttattttgtttgtttttgagatggagtcttgctctgttgcccaggctggagtgcagtggcacaatctcagctcactgcaacctccgcctcccaggttcaagcaattctcctgcctcagcctcccgagtagctgggattacaggcgtgcgccaccgcgcccagctaatttttttatttttagtagagacgtggtttcaccatgttggtcaggctggtctcgaattcctgacctggtgatccgccgcctcagcctcccaaactgctgagattacaggcatgagccactgcgcctggcctatataatttattaatatcccattcttctgctgatgaacatctgcactgtttccagtttttgctatcatgtactattcgttgatgactatcctggtgcacgtgggcaggagtttctgcaaggtatatgcttatgagtagaactgcaggtcacggtatgtgtgcatgttcagctatagaaaagaatgccaagttgtattccactgtattccagagtggtcccacccatttccactcccaccaagaattctcctgatccacattctgtccaaattggcattgtcaaacttcttaattgaggccaatctagtaggtgtaaacgatttctctccacagttgaattttacatgtccatgctgactggggcatgtgttgacacgtttattgaccctacatatgcccacttccatgaaatgcctatgtaagcattttgtccacttttctattgagttttgtgcctttatcctattgatttgtgggagttcactacatgaaatcataatcagttatgtgtattgcaagcatctccttccagttgtgtttttgctttcttcgtgatgtctttcaataaaaagaatgtttaaatgtacttacctttcaaacatatttttcagctttggcgtttctctgtcttgtttaaaaaattctttccaaatttcttacatcttacattttattctgtaaagttccaatgttttgctttcacagttaagtgtttaaaccacctgacactgattctcttgcatggatagccaatgatcccagaaccatttatggtagactccctgaattctgctcctggcctgccctgcatcgtttcatatatgcttcaggctctatcttatgttttgctgattgcattgtcttcctttgcacctacacttactgtctatagcttaaaaatgagtcttatacgtggtagcataaattccccccaaattcttcaggagcctcttgactttccttggcctatggctctgtcatataattttacaattaggttgttaagtcttaccctcccaacaaaaacatttgtcaggatttttaatgaaatcaattgaatctgatttggaaaaaaaaaacagccatcttcacagtattgagttagcttagactagctctctcaatatggtatatccctccatttatttaggttttatttaatgtctttcaataaagttttacacttttctgcatattcaaattacatattttttcttagatatagttctaagttccttatttttgtgctattgtaaataatgtccttaaacaatttacattttctctctgtggctgaagtataaagatacaattgatttttggtatattaaccttctagctaaccaccttgccaaactcattatttctaattgattgtagatggcttattcctgattttaaagggaatactttcaatgtttcctcattaagaataaaacagttctattaagtttgtatatgtattttttctataacttaagttctgttacgtttttctataaatctgtccattacatctgagttatcaaatgtgtagtctctcatcaactttttgatctcttctgtatctgtaattacatcttccttttcattcataataatggttatttgtaccttcttttttgttcttacacattcttaccatatttgtctattttgttagaattttcaaggagctaccttttggctatgtttatcctctttattgcagccttatattctatttcgttaatttctattcttatgtattatgttctttaaatttattcattcttctttttctaagtaaatctgatcacttcattcctattcttatgtattgtgttctttaaatttattcattcttctttttctaagtaaatctgatcacttcattcattttcaattgtcaatctttctaggtacctaaggctattcatttgcattacaatttcttctttgattaatgagttattaaaatctttttttaatttccaaatatattagggtcatttatccttttgttatttatttctaacttaattaaattgtggtcagagaatgtgatctccttgatattcattctttgaaatgttttgatatttactctacaaactaaaaaactgcaagatcaatttcttaaagatagtccctgtttacatgagaacatctctgaaagctgcagaattcagtatatgtaaattatacctggttgtgttctttaagttattacataatttttaattttctgtctgatagatcaacaatcaatatgtattgaaatttccttttcatgacagattgatcgatttctacctccatttttatgtgttttttctttatacgctttgcagtggtttaatcaaaagtatataagcataaaattgtacctatttgttatatgtaatgagcctctctctaacaaggctttttgactgaaagtcgattttgtctgatattaaaatggctctgccaatattcttttggttgacatctgcccacccaaacaactacacaaaaatctacaatttccaaactacattgtgaccagggttcattcatcacaacccctacatacgtacggtattttgcttgtgaactctcttcccctcttcctaccaaattttcttacagctttgaaatttgcctggacttcctaaaatgacaatgtcccagggaaatgttcaataatctgggtaaggagagacacacataggctcaaaataaagggatggaggaagatctaccaagcaaatggaaaacaaaaaaaggcaggggttgcaatcctggtctctaataaaacagactttaaaccaacaaagatcaaaagagacaaagaaggtcattacataatggtaaagggatcaatgcaacaagaagagctaactatcctaaatatatatgcacccaatacaggagcacccagattcataaagcaagtccttagtgacctacaaagagacttagactcccacacaataataatgggagactttaacaccccactgtcaacattagacagatcaacgagacagaaagttaacaaggatatccaggaattggactcagctctgcaccaagcggacctaatagacatctacagaactctccaccccaaatcaacagaatatatattcttttcagcaccataccacacctattccaaaattgaccacatagttggaagtaaagcactcctcagcaaatgtaaaagaacagaaattataaggaaccgtctctcagaccataatgcaatcaaactagaactcaggattaagaaactcactcaaaaccactcaactacatggaaactgaacaacctgctcctgaatgactactgggtacatcacgaaatgaaggcagaaataaagatgttctttgaaaccaacgagaacaaagatacaacataccagaatctctgggacacattcaaagcagtgtgtagagggaaatttatagcactaaatgcccacaagagaaagcaggaaagacctaaaattgacaccctaacatcacaattaaaagaactagagaagcaagagcaaacacattcaaaagctagcagaaggcaagaaataactaagatcagagcagaactgaaggagatagagacacaaaaacccttcaaaaaatcaatgaatccaggagctggttttctgaaaagatcaacaaaattgacagactgctagcaagactaataaagaagaaaagagagaagaatcaaatagatgcaataaaaaatgataaaggggatatcaccaccgatcccacagaaatacaaactaccatcagagaatactataaacacctctacacaaataaactagaaaatctagaagaaatggataaattcctcgacacatacaccctcccaagactaaaccaggaagaagttgaatctctgaatagacaaataataacaggctctgaaattgaggcaataattaatagcttaccaaccaaaaaaagtccaggaccagatggattcacagccgaattctaccagaggtacaaggaggagctggtaccattccttctgaaactattccaatcaacagaaaaacagtgaatcccccctaactcattttatgaggccagcatcatcctgatacaaagtctggcagagacacaacaaaaaaagagaattttacaccaatatccctgatgaacattgatgcaaaaatcctcaataaaatactggcaaaccgaatccagcagcacatcaaaaagcttatccaccatgatcaagtgggcttcatccctgggatgcaaggctggttcaacaagtgaaaatcaataaacgtaatccagcatataaacagaaccaaagacaaaaaccacgattatctcaatagatgcagaaaaggcctttgacagaattcaacaacccttcatgctaaaaactctcaataaattaggtattgatgggatgtatctcaaaataataagagctatctatgacaaacccacagccaatatcatactgaatgggcaaaaactggaagcattccctttgaaaactggcataagacagggatgccctctctcaccactcctattcaacatagtgttggaagttctggccagggcagtcaggcaggagaaggagataaacggcattcaattaggaaaagaggaagtcaaattgtccctgtttgcagatgacatgattgtatatctagaaaaccccgtcgtctcagcccacaatctccttaagctgataagcaacttcagcaaagtctcaggatacaaaatcaatgtgcaaaaatcacaagcattcttatacaccaataacagacagacagccaaatcatgagtgaactcccattcacaactgcttcaaagagaataaaatacctagaaatccaacttacaagggatgtgaaggacctcttcaaggacaactacaagccactgctcaatgaaataaaagaggatacaaacaaatggaagaacattccatgctcatgggtaggaagaatcagtatcgtgaaaatggccataatgcccaaggtaatttatagattcaatgccatccccatcaagctaccaatggctttcttcacagaattggaaaaaactactttaaagttcatatggaaccaaaaaagagcctgcattgccaagtcaatcctaagccaaaagaacaaagctggaggcatcacgctacctgacttcaaactatactacaaggctacagtaaccaaaacagcatggtactggtaccaaaacagagatatagaccaatggaatacaacagagccctcagaaataatgccgcgtatctacaaccatctgatctttgactaacctgacaaaaacgagaaatggggaaaggattccctatttaataaatggtgttgggaaaactggctagtcatatgcagaaagctgaaactggatctcttccttacaccttatacaaaaattaattcaaggtggattaaagacttacatgttagacctaaaaccataaaaaccctagaagaaaacctaggcaataccattcaggacataggcatgggcaaagacttcatgtctaaaacaccaaaagcaatggcaacaaaagccaaaattgacaaatgggatctaattaaactaaagagcttctgcacggcaaaagaaactaccatcagagtgaacaggcaacctacagaatgggagaaaatttttgcaatctactcatctgacaaagggctcatatccagaatctacaatgaactccaacaaatttacaagaagaaaacaaacaaccccatcaacaagtgggcaaaggatatgaacagacacttctcaaaagacatttatgcagccagaaaacacatgaaaaattgctcatcatcactggccatcagagaaatgcaaatcaaaaccacaatgagataccatctcacaccagttaggatggcgatcattaaaaagtcaggaaacaacaggtgctggagagggtgtggagaaataggaacactctttcactgttagtgggactgtaaaccagttcaaccattgtggaagtcagtgtggctattcctcagggatctagaactagaaatactatttgacccagccatcccattactgggtatatacccaaaggattataaatcatgctgctataaagacacatgcacacgtatgtttactgcagcactattcacaatagtaaagacttggaaccaacccaaatatccaacaatgatagactggattaagaaaatgtggcacatatacaccatggaatactatgcagccataaaaaatgatgagttcttgtcctttgtagggacatggatgaagctggaaaccatcattctcagcaaactatcgcaaggacaaaaaaccaaacaccgcatgttctcactcaggtgggaattgaacaatgagaacacatggacacagtaaggggaacatcacacaccggggactgctgtggggttaggggagcagagagagatagcattaggagatatatctaatgctgaatgacgagttaatgggtgcagcacaccaacatggcacatgtatacatatgtaacaaacctgcacgttgtgcacaggtaccctaaaacttaaagtataataataataaaatttaaaataataataataataatctacgtaaaaaaagaaatgttgatgtggctgaaatatatatgtatgtatcttgcaaatataattcatggctattttccatataaatcatctcaaatcaagatttgattttctctaacagatctggtctgaaaagtatagttatgaacaggagtggagtcatgggcattcactgcttctttaattgcattttctggaaaactctacagttctgtttttaacatttgatcacaccatcagtagagctacattccacaaagcaattatgttttgctcagcaaaatatcagaatggaataatatgctgcatattaacaactgtaagaatagaagccatttagaacattttagaataatgattgaggtcatttgttcagaatttacagcaaatgtgttttaaagacccactatcatggagtccactgtgaagtctaagttatgcacatcagaaactacaaatgcacaaggagcccagtattttatcaaaacattaatatcagcactattaaaaaccaaaccttttatccagcaccccctgcttaccagctctccccatgtacaaatgcattagcatttaatgcaatatgctttccttttctttaagggctttatccagatatctagaaagtagtaaagtggtagcatttaactaacacaggagtggcaaacaggtggcaactcccttcctcgacccagaaggacaaggctcatctatcaccacaccctccgtgcagagtacagaagccatcttagaatccttctaacacagtattccaggcaccatgacttagaatttgtgttggcatgccagatcccacctacccgaaggtgctatataaataggctagggcagctaggggaatacagttatatgtcttattcacaattctaaaaggcagttcgtggttgcacaggtctttcgcttccaggtcggatggagtagttagcagctcatcagtgtccccagtaagaacaacaggaaaagctcaataaaatatggaaatcaactctctgaaaatggctgagagtgacaaaattcaaacaggcttgagagaggaatgaacctccctccaagaagggagctaaactctgaagcttcttttatcctagaagtgttccaattctgggcacaagcagcagcctgagaactctggctatgcacctgctgaaagccagttctgggggaaaccccagcagggctatggttggagacttggggtccaagcacatggttgggttttcccctgggatagctttccaattctgagggtaagagacttaaattttaacaaaaagccactggaaggcagcctcaaaataaaaattgtaattaggaaacacaagagagaggggctgtgacaaatatagaagactctcatttgaaaaccctaaaaggcaaggacaaacaacagcaagactgaagcttaccagggctgcaaaccagctctgagtcagcacagtccttgcttcaatgaaggtgatgaacaccagataatctggacaataaagttagctggctgacttcaaaacaattatagttattacgcccaagaaaacagagaaaaagatgaataaaataaatgaaaagaagaatttcaccagataactataattggtaaaaattaataatcaaagagaaaatataaaactaaaaaatacaacatctaaaatgagtaactcaacagatgggtttaacagcaaattagatacagaagataagactagtaaacagcaagacaggtcaattaaaacgaatacccaaactaaaacctaaggaggaaaaaaaaatttaagaggattagagagacacaggacacaatgaatgggcctagtgtatgtgattcaagtcccattcagagaaaaagagaacagggtagaagaaatgatggccaaggattttctaaaacaaacaaaacagcaaatctcaaatcgttcagtaagcgctgcaaagctaagctggccatttacacaaaagaaaaagaaacctaaataaaaggaaaaatcttaaaagcagcaaaggagcagatctggacgcacatattaccttcaaagaagtaacaaaaagactggtagtcattttctaacaaaattgatggaaaccaccttttaagtcctgaaaggaagtagctgccaacctagaattctatcaccaagaaaatatccttcaaaaaaggaagctaaaataaaaatgtttctgagacaatcacagcagaatttgtcaccagcaaacttacactaaagaaaagaaaaatgacctagagaaaaacccaaataaggacgaagaaatgaagattgatgaaagggatgaatgaatatggactgcgaccaaactttggaagttatgaaaaggacagacaggcagtactgatttagccaaattaagaaagatggatcctaaagcagcaacagcagcagcagagaagagagaacaacccattgtgcacctcagaaccctcaaaagattcaggcacgagtctcaatgggcacctctggaagtggggctaatttggtgtagaaggcttgagggatttgggggctaatcaaggaagtagatatgctgaaaggaagcagtaacacatgcaagctttcttaaaaggttatgtgggaggggaagtccctcacagtatgacatccacaggcttcaagcaaggggtctatccagaaggggaagaggacaagggaactcctggggaaagggggtcagagaggaggctgacatagccaggtgacagtctgtagcagcacagcagggggtcccagggtcagagagctttgatggtagcagtggcttggagctttataaccacaaggctctatcttaccagaggccagctcaccgggtatgcaaagcagtcaggctcttaatggctaaaaatctgctaattcaggctatttgaaaaaaattagacgtgtaaaaatttgagtttggtaccagtgggcttctgagctaacagatctcagtctgctatgaagaaataaacaacctagaggccaatatatagtggccacctttggcctctatatgacacttgggaaggagggctaagataaggaatggaaatttggacagctacttgaaaacagatttcccagccctgcaccctagcagaattctgaaggactgttcccctaaaaacatcaaaacaggtctgtgctgtggactgaccagccccagaccacaatgcagcaacatgaggcaacagaaggcattctgaggctggtcccaccatgccctctgcccctgcagcatctttttaggtgaaactaatgcagaatgtgctccacaaaacaaggcagcaaagtcagaatgaggaagacctgagatgcagaaaatgacccagtggaattccagagatggcagaaagagggaacccgggctgacagctgtgtacaggcctagaaagccaccaacccaagagaagaaaatgagtcctggagaagaaaatgggaacagaaagataacctactagagctgagctgagtcagtattactgagaggctattgcaagaggagctattgattaaggcgaggcaagtactgacttcaagagtaagttagtgaaagtgaacataccactctacacagctctgcagtgaataatatctgcataggtataaatccaaatactgactaaattaaacttgtaacatacccactctggaggatgaggaaggggaaccagagagaaaatgaaaagctaaatcctcactgccataattagaaacctacaatgatatctacaaccaattaatcaaagatagcagaatttgtatcttatttagaaatgtggagacgtagtaagtcccagggaaaaaagctgaattaaaagtagttgcctctgcacaagttagagcagggaactactgggttttcctatttgctatttgactttttaaactatgttttcatttcattagatgacataaaaattaactttaaaaacacatagacatgaatatttttccttagtaatatgaaacttacaatgctcaaactacgtaacactagcatctataaaacctacaggaaaacagctgatcattttacatttaacttcttttaatataaagagagcttactctcctaaattaagccaaaactcccagatctctcaatttttcatggtgccatgggaaaaagcaaatctgatgtttctaccctcaaaataccaaaaggattaacatcagctaatttcttcaattatgacttcatgagtaacggactctaagtcctggacagcagccaacatcctgccagatgctaaagacagcatggtggaggcctgaaagagaactcagaatgaggacatggggccgggcacggtggctcacgcctgtaatcccagcactttgggaggccgaagcaggtggatcacctgaggtcaggagttcaaaaccagcctggccaacatggtggaaccctgtctgtactaaaaatacaaaaaatttagccatgcatggtggtgggcacctgtaatacctgttactctggaagctgaggcaggagaattgcttgaacccaggaagcagaggttgcagtgagccgaggtcgcgccattgcactccagcctgagcaacaagagtgaaactccgtgtcaaaaaaaaagaaaaaagaaaaaaagaaaaaaaagaatgaggacatggccactgactggtgctgagcaggttatctctcacccaggatggggaccccacataccattatctgctctcctgcctctccgggggctcagcaacactatggcagtggactttgaattacagagcagaaagaaaggttaaattcttggacttgaataaagagaacggcagggtaaactctaggagtttgtagggggaaagtcagcaagtttgcgtgttaaataagggtagagtacaagacaactatcccagtggctgtaaggccaaagaactctgaggctctgtaatgtcggaagttgctggctctctgctatgcaaggtaaccctacccccaccctctaccatctcacctacaaaatcatcagtaaatttatctggacaaagatacctttgtaagagtagaccagggtggagtgaaggtgacaaggactcacaaaggttttgagtgtgaaacttaggtaagagagaaagaacagtgctgagacagcccctgagcatgatggatccagggggatggaacttgtactccatggaattagaagtaagtatggagagagtttgggacattgtggccaatggaaccggtgtacctaagaaggctaggggatcaagatggaatctgagatgcagaatccaatgtataatttcgggataggtgagtgtgtctttaatgttttacaaaatattagtttatcaaagaacacatataaaaatgggttccacgtcaacgaggtctgaaaacatgacatagtatacccttttcatgcagagtcacggtgcacatgagaataacacagtcaagctaaaatgcacaccacaggaaagaaaatgcttcaaccctgaataaccccgcctgccccaaatgtgaccttggaatctttttaactcagaatacacatttaacatcttgtatacacagttgtttactatacatgttagtgaaaatgctggcataggaaattatagtgggaattcagagagagataagttagggtttttttccttcacaatgaaaattccttcttctgactatacatataaatagtacaccctaatgctgctaaatttagttaacatgaaaaattctagagaagaatgtaaaattcacccacaccaccatacacaaagataaaccaatggcaatgtttaaatgtattcatacctagattttttggtttacaaagtttatttgggccggcgcggtggctcacgtctgtaatcccagcacttcaggaggccaaggcgggcggatcacgcggtcaggagatcgagaccatcctggctaccacagtgaaaccccatctctactaaaaatacaaaaaaaaaaaaaaaaattagccggacgacgtggcgggcgcctgtagtcccagctacgccagaggctgaggcaggagaatggcgtgaacctgggaggcggaggctgcagtaagcagatatcgcgccactgcactccaacctgggcgacagcgagactccgtctcaaaaaaaaaatttgatttttttctaaggactccgttcacagtacacagtttttcctttaaaaatatatcacagacgtatgtggacacccatcctccaatgatgtacattcagactatctcaatgggaaaaaaaatgaggcttacattgtgtccgcaatttattcttccccgtgggttcttggtcttgctgacttcaggaatgaaggcgtggaccctcacggtgagtgtcacagctcttaaagatggtgtgtctagagtttgttctttcagatgcgtctggaactttttccttcccacgggtttgtgctctcactgacttcaggaaggaagctgcaaaccctcaatgtgagttatagctcataaaggtaatgcaaacccaaagagtgagcaacagcaagctttattgccaagagcagcaaaaatacaaaacctctgcactacctaagtggaccccatggggctcccaccgctgactgggtggcttttgttcccttatttggccccgcccacatcctgctgattggtccattttacagagcgttgattggtcccttttacagagtgctgattggtcccttttacagagtgctgattggtgtgtttttatagagtgccgattggtgcatttacaatcctttagctggacacaaaagttctccaaatccccacctgacccagaagcccaacttggcttcctcttttaatattgctattgactctattctgcccagtctgggtaggcgccaacctctcaggtgaaaggagcacaagagaaggtaaaggctgtcttgacctgtagtgacccaacaccaggtcatccacaacagggagaagaggtactgagaggggccctgcaaagtcctggtttatttattccgttggtaaccatgaggcagaggagacacaccaggcagtgccccaggaatcctcaagctcacagctttttcaacacatttccttttctttacaactggagtctttctgaaagttgtcttctgcacaaattgctaccaaaatcctcgccagtgtctctcccactgcaggcacaagaccagcaagccttatcatgtctgtgtctccaagtatcttgttcttgctgaccaagtcatggttttctaattctactgacacagtacattctatttccatcatcaaaacccatcagacagatgacagatctgcaaacaccataatggggtgattatacttttatgactagtttttgttgttgttgttttgtttttgttttttgagatggagtctcgctctgttgcccaggctggagtgcagtggcatgatctccactcactgcaagctccacctccagggttcacgccattctcctgcctcagcctcccaagtagctgggactacaggcacccaccaccacgtccaggttttttgtttttttttttgtattttttaatagacatggggtttcactgtgttagccaggatggtctcgatctcctgacctcatcatctgcctgcctcagcctcccaaagtgctgggattacaggctgagccaccacgcctggctttttatgactagttttaaatcttctttatcctgtttggagttatatttttgtattgcattctatttgatcatacgtggacagtcctactttcctttacttggccactgccagatagctctttgccaatgccctggtctgttattttaagctatttgtgtttgtttgtttgccaatagtatctatctgatttttgctttttaccccaatctaaaagtgctgtcttttaatagaggaaattaagtaacacctttagcgtggtagctaacataactgaattatttcctagcttatttactatatttccttaatttttgtttctctaattttcctgtcttttgctattttgttcaatttttgttgtttgctttttctaatgatttggaaattatatatcaattttctaaccaaaattttaaatctatgtttgaaattatatatctaataagtatatatcaatagcatagatatctatagtctctatgcaacatggcaaaattttctacctcaacctgcctcccagattttatcaaaacaaccacattagtgtcaacaattcaaacttaactttatgtttcattggtttaattgcttacttctgcagtatttataccaatgcttcctgtttatctttaataactaaatataattattaaatttatataattctataaattattgaatttatataattattacataaagataattgattattttaataattaaataattgatttattttaataacaagtaaaggtattaaatatttaataataattttcctcatttggcttgtgcactacaagtcatttcctttattcagaaatggtatgcagaaatttggagtccactgtatttctgaaaatcactttcatgtacccattcacatacatgagcttagaaatcttgcatacagaaagcctagaggaatcttgcttaacaacctgttccttctaaaatatgcaaatgttgctgcattatcttctagcatttgactttatggattaaaatctagtattaatgtgattattttctgtagcctgctttgtcttgtttaacgcttatctttgattttttttgattactgaaattcagaaaatgttctattacatgaatcaaacctaaaacaaaaacatctcctatatgcctgtctgacgtcttacatgtatcttccatgacctttagcttttctctcctaatttccccatcttgtctcattcctctcagttgaaaaatagatcccccaggtgatatcctaattcactaatccaatgttggtcatctggtttccttctcacagtaacattttcgtgtcctccgtctgcctccactgcacttgacagtctcttcttttgcaatgtggcacctctcagatctcacaggtcataagccagagttgttttgaagttttattccatttctctgtttcactgtgtgccatttactccattggcttttggagttggtatgtgatatatcctaaacattcacaaatacttcaaaatgctatgcacactgggcgccgagtggtcagtgtgatgcccaaagcttggggcagtgcattacatacagaagtagaagagaattgtccaatcagaattaaacatgatggctttgacctactgtctgcaggaaataagtgatgagagaaggccaaagaaaactgtagccatgtggcctccagatggaccttattatcttatgggtgcttggtttctttttgttctttgaccctaggtgatttattttgttatatttaaagcaaactagcaatttctgctctataattaaaagtatgtgtatgtctttataaacactgagtatatatactattaattgctgttgttatttttccattctcaaagctttccaggcctaatcgttatcctgcaacaactttcaaagaagtgagagcaatgatttcctctcctccactgttcatacgaatcatggagaagcggggttgaaaacgaagactgcctgagccccaacccccggagtccaacttggggtacctgagatatagccctatctgttagtttcctattgctgctgcaaccaatgaccaaaaactcagtggcttaaaacaatacaaaattatcacctttcagcttttgaggtcaaaagtccaaaatgggttgggttggtaggactgagctccttctggaagctccaggggagagtccctttccttgccttctccagcttccagagactgccctcagcccttggcttgtggccccactgcactcctgagttctgcttccatcctcgcctctccttctctgactctcctgcctccctctttcccttatgagggcccttgtgactaccttgaacccattcagatacccggcataacctccccatctccaaacccataacttcaccacatctacaaagccccttttgccatgtaaagtaatacattcataggttccagcgattaggaaggacgtggacatcagtggggttgggggtacgagtctccctatacacccagaaacctgcactttgaacaagaaccagcagactgcctggtgagaaacaccaaatcacacccactacatggtggctggagctttttcctttaggacactcttcagacccatcaccttaaaagtccgaaaccaacagagtgataaatatcataatataaacaaaacaccatccttgacaatttattaagataaaatattgcagtatgtacctagacctacccagaattcatttttaagtggaaagttaaatgacagaacagaaatgtctaagaatcattggggaaaaatacaagtcaaacccaaagccaagtccactttccacagcagaatcaagatgacaccctgtggagactccgatacactcaaaaaacatacttccatgtttgtttgtttgagacagagtctcactctatcgcccaggctgcagtgaagtggttcgatcttggctcactgcaaccgctgccccatgggttcaagcgattctcctgcttcagcctcccgagtagctgttattacaggtgctcgccaccacacacggctatttttttggatttttagcagagatggggtttcaccatgttgaccaggctggtcttgaactcctgacctcaggtgatccaccctccttgcactcccaaagtgctgggattacaggtgtgagccaccgtgcccagccacttccatgttttaaagcttcacttttccatctgtcttaagctcttttcccaaaaaaaaaaaagtaaaatttctgaattgtttaaatacattattaggaaacagaacttaaaaggccagtcctcttagtacatgcccaaattccaaatgtgtcactatttctataataaatagcgccagcactgacagacttcataatgcagggtttcctgtgctgccattcaccagcacacacaaaagtgagagtaatgaaaatgtcaggaaacggcatcccatttagaaaccaggaaatacaaaaatgcagctatcagtcatccctaaggctggccaaataaaaggttttaaatatagtcacggatcaccagtgtcacaagcaacaacattcactgcacagagaggcagcagaatttgcagcattgaggatttgctgggtggctgatgagatctgcccactttgaacttgctctcaactgacatacccagatctatttttacattagctgtcaaaatgataggtctcctgcatcctatgcctgcactgttaattatctatctgcctatctgtctatccatccatccatccatcttgagatgtctatctatccatccgtccattcatctatcttgagatgtctatctgtccatccatccatccatccatcttgagatgtctatctatccatccatccatccatccatccatccatccatccatccatctatcttgagatggggtgttgctctgtggcccaagctggaatgcactggtgcgatcttggctcactgcagcctcaacctttcaggctccagcaatcctcctgccttagccccacaagtagctgggaccacaggcacacgctaccacacctgggtaattttaaaaattttgtagagacagagactcactacgttcccagggctggtctagaaattctggcctcaagcaatcctcccacctcggcctcctaaagtgctaggatcacgggcataagccaccatggccagccaatatttaatttttgaatttgggactcccacgttggagctgggattttgtacttacatgtatactctctagcacatgtaacccattaaaaacatcacctgctttgctggttgcagtccttcctcccctctgtcctaattctgacaggatccggtagaagggacaaattcgtctgtggttgaaatctacggacagccatgagctgaaactacggaccccgtagttctcaaaggaatacagagaagcaggtatggaatgccaacagggctgtgcaatgcccgatccgggccggcgtgagggcacctccatgatggggtgaggatgagggaaggagtcccagttcaagaagccgttaccaaaaggcactcctagcgagccaggtggcttcattcatccacgcctgatgtaaagccacccacataccccatctatacaatagggctgggcgcagactttcaaatacctattgaacctttacttcctctgaaacccagaagcctgtgttacagacctcaaccaccacatacacattgtctctaaggagaaatcaattccgtggggaaaacctgggaatggaggaagcggaaacaagaaagtgggaagtggggaaaggcaagaaggctttctttcagaaggtgagttagagataccacctgtctcccccattgataaaaggctcctcccatggctggctccactcatcctgccagcctcatttcaaaggccacaggctcagagaggtccctgctgagccccgagtccacagcacagccctggcccctctcgatggccttgcagttttatcttaaacatgtatctctgtatgaaatggtttccttattttttgcctgtctctcctgctctaggacgtgtactcgccaggcagaggcctggtgtgtcttctccaaagcagtatctccagctcccagcacaggcctggcccatagcagggactatgatcattatgaatgcattgagaagccaggcatggtggcacatgcctgtaatcacagctactcgggaggctaaggcaggagaatcacttgaacccgggaggcaagcagaggttgcagtgagccaaggtcatgccactgcactcccgcctgggcaacagagtgagactccatctcaaaaacaaacaaacaaacaaacaaaaagaatgcattgagagatgggtgggggaaggatgggaggaaggagggaggaatggaggtacacccatcactcggtaaaacaaggcctaatctgacctagatttaattatcctggagaccacccactccccaaaaaagggccaatgaccactctgagtcggatggattgacataaggagagagaggcagtgtccaatgaaactgtgctagagatcctcatggtccccaggttcctggtcttactgacacggctccggtgagctcccaccctcccagatgtctttctagtaactcctttgtgcgtagctacccaaagctggtttctgctgcttgccctaaatataccccattccaggagcatgtattcagggtggctgaggcacactgcgggcccaaactgttttcaagctttacatctgggcactctacctgtttaatcctcacaaggacctaaagagggaaatgcaattataatctggtattctaaggataccagtggccgggttacgtaaccccgggtaaaatcacgctggcagtaacaggggagcctcggtttatacccaggccataaatttccctcctgcgatgccacgctggcccctgcacgtatggtttattgtgataagtaaagaatcctatataacttatggtttttatgaatctaaaattttgatgaaacaggtctgcttggagtaggatccagctgtgtcattttgaatcttgtacaactgttagactgctttgagtcattctcctaaaactgtaattttattttaaattatatttaaattaattaaaaatataattttataacttgccccggagacattttacagacatgcttttagcaaaaatataacccacaaaataaaagttactttgtgaaaccctctcccaaaatttatataacatatataaccatttttcttaaaattatttttagatctaagcaatggtaaactcattagtctgttcataatatgattttatactccctggcatctgcaagcacagaacatagagaactcagcttgaggaaaaacagtaagcaaattaaaaagtaaaataaatcttagcctatgttcacacactcaaaatttaaataacagtttttctaggggaaaggagtgggaggtggaggcagagagatcaatccatttgcctctcactccaggtctgagaaccctcattttctattcttcaaattaatgaaatgaacacaagaccactctgatgaggaagtctgaaataatggaaacgccgtggcatttgcattccctttcaatgtgaacaggctattttgatagttagcaaaaccaggacaaattgcctgagatttcatcctttgttgctctaaaatggctctcgggctgtaataggccatatcactgcaaaatgcacttacctttaaataggcaggcaaagtggattgtgttaaatataaaattagtgacatgttctctcaactcatggagtctaattctaattcaaaagacttctgctcacttcagacaatgcctgttccttcttgtttataacctcaattccaattttctgcaattcaaataaatcccacctacagccctgggctttggtctcacccacctctgccccagacaccaggctcagactcccaggccctctgtctgccccgcacgcctgccatgtctgagctcttgagcatgggtctgtactgcctaggaggctcttcaccaggtttccacatcacggatgcctcgtcaccatcctggcctgggcttaaacgtcatctcctcccagtggcttggcctgaagaactgctctgatgtcttcttccccacatttgcaccatgtttgatcatcttactctggctggttagtgctgttcccatcagaccctctccccaacactgtaagctttgctgggatcaggaccctgggtccccagtgcacactgggggaatccggctgcagctggtgactcaggctgcaggagcccatgcccagggcagtgcccctgaccagtggctagaaacagcatggcagcccacacctacagggcctggcagacacctctgtcccagcatagcttcacccctcccctcctcccccagctccctgctgcagcctccccagaccctgagatccacgcagctgtgaggagccctcagctctccctgcaggcctggagttggccggctccactgctggtccagccctggctcctgcctccagcctcactcctgggcatctacccccaacaggcaccgggtataatcacctattctctacctgctcatcgcacgcccacctccatctgcaggtctttatcatggtgtaaggctcccctgggtaaagttctccatgagcataagaggcatcttttttacaactgaatcccagcacaaacaggtctcaatcacaccactgccctctcatgagccaaggaacctgcctgggccagcccccgacggtcctggcactctgtgtactggacccagccccagcactggtggctgtgactgtctcctccccacagcatcacaggtgggtgagtgtctagcctaggagggtaggtctcagccaacctcagttcactgtgtcttcaggttgcattttcattgtagtgaatactcagaatggaataatgcaatgaagggctgtgtcctgtttcaaatggaccacaggtgccccttcccagtttgctcctttcctttttgaactaatggtagaaaattccctttacccttagaaactcaactccaacagtgatttagctacattttattcttaaggctgctcatagtaattcacatatccatgagagaaagaccaatttacttaatggtacaaatcttattccccatcacataacacagctggtcaaaaatgcattctttcaagccaagatgaaataattcccagaatgtcccttttagtcaaatttggctcttgacaagtctagagagaatccccataataggcttcaaaggctggccccacagcccccactggcagctggtagggattcccagtaggggaagcctccccagaccccttctctgctactggctgtccctcaaggggtctcaaggtctctcagacaccaaacacagactcctccatgggaaaaaaaaaaaaaaaaaacagctaccttctggccctaggatctgtgcattctcctttcctaaagcgaaccaccctcatcctctcataaagaaccaaaaagcacgtcattcacctgatggctctacaccaccaaccctgttactctattcccatgccctgcttctatgtatttgttgctgtaagacttcttactacccagcattacattgtcaatttgtttgtctgtctaccctctgtctatcctagagaatgtgagcttagagtgtacaacagtacctagaaacggatgaccaaggaaatctgctgaatgaactaacgactgtgtggttaccgtggctctagctggcatgccactttaggatatatcttgagttttaggaattcaggaattcctgcaatctttcaaagggatcatggggcttccctgattgcagaattcagcaatctatgagcgagtatctatgcatttcattgcctctgctttggaagagactgttgttctgtaataggtctggtattcattaagcctttcaaaaagatgttccctggtgcataggtcaacattgcaaagtgtttccttcgccttcctaaacaagcctcacataagaagctatgtgattactggatgtttgggtgattaaaaccacatccttgcctttcctcagcatcccttcacctgttcagtgtcccacactaatccacagctgtgcaatgtatcataaatcagactcagagtctctggaagggtcatgtgctgcaaattacagaatacccagatcacacagacacatccacatggtgcaaaataaaccatgaaggagaaaagaatctcactctcgcaggtttgacctgaagcatacatgacatacatacatagagcacacatgaataaccaaactacttccactggagttaaaccttacagctcatccatgctcctcaagcagagatcagaggacactggggcagggcagggcggtggcagtgcacatggagtctcacgaagcttgagaaacaatgccttagacggtgaaaaaagtcttgtgttaaaaactaacatttcaaaatggaattttggtaaaacaatcaagaagaaagcatggcagaccatggcccgagtgttaggcagactccaagactcgagtttctcaaaatgggagtttgtggctcccagggaatctcagctatgatccaggttgagaaactgctctaaacccagtgagacttgtttcctgcaactatttaactgtggtctgttttgagagtactgtacacctgttttcctttcctccccattttcccctcttccctatcactctccaggctgcgccctactaactccatcctgcttgacaaacgtgtttgcttctttcagtgacttttccctcccattttcttttttggaaagtctgcctttgtctggcatttgtgtttttaagacagcaagaaacgtgagctcagagatctgcatccactctgtgctccccactggctccggggtgggagcagtcttcccagtctgcaaaccctcaaaggggaagtaatataaatttcaaatgaggacaccctcctaaagaagcagctggacccacattttggtacatctgcctggcactcccaggaatgagcagtggggaccatgtttgaccagcatagtgcatcctgggtgatgcttggggcaaattttcagcactgcttgtttaatttttatgtttgttaatatcctttttaggggatgataaaacttacccaagccttcaaaccatctttatagtgtagttttataaattgttatttggttctaatcaaactctgtgggagggaaaggtggacataaaaataaggcccttggattctttcaagagaatgttgctgcatatatatatacacatatatatacacacatatatatgtatatatatacaatatgtgtgtgtgtgtgtatatatatacacacacaaaatgtaaatggaactctaaagatgctctttcactgtggttgaaagtaagtatcacatctgggtaagcaactcatcccagtttgccctggagttttcggttttagtgctggaagatggaagacctccatcctgggaagtccctcaggcctggttgctcatgctatttttatgaaacatgacagcagagcacaggcatctactgagggaaccattaagccctttgctactgatgagtcaaccgatgtactagagcagccaatggcaacaaagctagatctgggatctgggcaaagtagaactcaggtgtacaaggaatgatcctatctggtgatttcactcctggggtgagaacatgcagagttcctgccattccatcgggcagttcagatgtcggagatcttgccatttgtcattttctctacaatgtcaggaatcatattgtaaaacacctgacactgacctggagaagaaaaatgtagctgtttaattcatgtgtaacatactcagattatcttatatgttagcaatactccattaggtctcgtctacctgcaaagagccctgggtcccatcgctgaggaagcgcctctactcaccctccagaggacatggacttcctgaaggaaaacagcactgcccatctggcactggggtcaatcgtttttaaactttaagagaactttttattccccaaagacattcctatgcagaatctaatatataaaacagacaaaagtggtgttctgtgagcagagatttcttttataagttcagatgtaaaatatgtattacatattcagtcgagaacaaaaaggttggaaactggcattatagagggcagctgaagtcataacagcctacaaaaatcatctacttctaaatttaattttggctgcccagtatcaagaaaattctggaaacaggttttactttgtaattttaggataccctcaaatgaaatgcattcggaagcttgaaaacaaaatgcaagggaacactgatgccaatgctgaatcatgaagagaaaccaataaatgacttctccactcgtttaagtattaattacttgggagaaaatgtttttcaaacgtatctgtaacattacggaatttccaacgatgttatattttgaaatatcaatccagtctttagacagaatttcaaacggtcatatttactttgttttccatgctgacccctaacctcctgtccaagaactcagaaggcccaaaaagatcaaatggacaggaggtgggggccaaacaaaaatgacaatacaacttcctgcttcaatcttaaattgtcttttagacgttacattccacttcattagttatccgaaaccaaagtccatgaagctgtccctgacttttcctatcccttccgaacatctcccactagtgcaaaaggccagggaagaatcaggtcattgaaaagaaatgatggctttttccagtaaacaatgatttcttaaagcctaaagtctacaatggactataaagctttccctatcaagtacataagccaaaggctcacatttaaagaaaaaaaacataactgcaatattgttgcaactagctataaaatgtaaaaatttaaaaagtaaacgtctaaattactaaaataagctgatatttagattctaagaggagatcagtaaccatgctcaagatgatcctaaaaacactgtcttctattaattggcctgttttaaaagtaacagaacacttcatataatattgcatctccaacttctattcttattcaccattctgaaactagactgagaggttggataattaataaaatcacccctttcccctggctcttgattatccttcatcagggtcatgtttgtacttctcttgtcgattgtaatcatttatttgaaacagtgtctcagcagttcattagcttttcattagtgcctgtaggttggataaaatgtgcttgaatttccaaagtaaatgcaaatccccttggtaatccagcaaggacatgaattcccagaacattttcaagtaagacagctccaatcagaacttggattttagtgaaaaaagtggtgtcctcctgaatggcagagaacccacgctcccatccagtcctaaacatcaattctgaaaatgaccatcacagtttggcttcatcttcaacctgaccgtggtattcaggaatgtcagttacttaattacaaacaaggagggcaagtcaaaagaattcaacacaaattttaaaagccaatgtatcagctactcagtaagttaaaaatatggctgccaggaccccacctggacagtcaaactcagcagctccagccttgaacacaagagacctggatccgcatcctgcctccggccctgggcagctgtgtagacctacacatcacaagctgagcttggtgtctgtatcttcaaaaaaggaaagatgatccacagttctgagactgggatggagatcacagaaataatgaaggggaagtgccttgcactgtccccaacacatagcaggcctccacaaatgaccgctttacaaagatcacagatgcagcctccccagtgttaaagtatgtcctcagtggacagtcaaaatggactccccgtggctaactgacgtgtgcaaaacgaaagcagagccaggtggccatagttgggtgaggaaaaggtcatgttctctgtgttctcagaaatatattgtaaaagtgtcacaggacctccctttctaccatccagtcaaaccagttcctgttgtcagtgctgaaatagagtgtagctggaaatgccgcagctgaccacccagagaccccctgaggccagcccatgaagacagacttgtgatgtcctccttaaagaccatccaacccggcccctgtacctgaatccccagctatcctgtggtttgcacctttatgaccttctatccccagtctctccttggagtacatttttgttttttgctgaaggctgtctctcccaatcttcagattgcttttagaaaataaagttatccttttgcctccgcagatctcactggtcttttgttaacacccgtaagggaagatagaattgcaggactgaaatgcatgccatgagacagaggaacaggtcaaacaggttaaacagaaacacacatgaaacaaggttatgtactaaccagttgaggaaaatgaggccagaggcaacaggaacttaaccatgtacatgtgtatttcccctgaaggcaatggctcagtattcactaactgagtatccatgatgacttcataaaacaaaactgctgcaaatgatgagaactggcaatacatatatttcctagttctgtcccctaatagagcatagaagcaatgatacccaatagtaaggagctcaactagcaccctggttttctaataccaaggcttcagacgatccaatcactctgagctatgggaggacattctctgataaaaggagaaacacataagcagctgatggtaggggcagggaaagcatcagaatgtaagatgaaccaggagcatcttatagtgctagaaaattggaattacacacacacacacacacacacacacacacacacacacacacacacacaaacagtagagggtgggagaagatgaagcaggagccaaatggccaaaggtcaaataacttgagcaacaaaataaatacccacactattgaattacaacctaaaggccaaaataaatagacaggagtccatattaatgtcacaatgactaaattaacaatggaggaagagaccaattttccttaaaaaagaattccaaatcagaaatgtgaaaaacaaaggagggaaacagaaagtcacccccagaacaccagggtgattgctgctgggcccagatccactctagaatgctaacatcagtgcttgaaattttaagaagaaacaggacatttgcaaggcctggaagtatctcccccagaatatttattaatcactatggctttaactcacgtccactaattctttgacacgctctcccccaggaggcaaagcttaatcctcctcctcttgagtgtgggctgaacttagtgactggcttctaacaaggagtaagggaggggaaagatggtgacttcacagaggagacatctggcagacaccagcttggccaggtgatcaaggttaactcaccagtagtaagtcacatgttgacatcatgatatgatgtgatgaggggggtaccttacctctgtggtggtcttcctcatattcgtaactccagtctaacaatgagaaagcatcagacaaacccaaattgagggatattctacaaaatacctgatccatatacttcaaagtgtcaaggtcatgaaaaacaaggaaagactgagaaactgagattagaggagattcaagagatatgatgattaaatgaaacatggtaccctggataaaaagaccattagtagaaaaattggtgaaatcccaaaaaagtctgtagtttagttatttttagttttgacaaatgtatgatggttacatgagatgctgatttttgagcaactccccgcttctgtgttaaatgattaatacaggagtcccctcacttccttttcctgttctaatgccagataccagccaaagcacatcatttttgcatcatcctacatgtggggaaatattttttattctgcatatcatagaatagtatgcattgatcataaaattttctgcagtagacttgagttaacttttcacctataaaattacaaccctcactcgtttccaacattagcatgaagaaaatggttactcccaggtttccacatcttactggagaaaaccgcaattaatgtcaccacaaatatccagtttccaacgttagctcagctgccattctgtgtgttcctgttcctcaatcatactcaattcacctgtggttcccgtcctgcctctcaccacagggtcggctgggcccaggatgacaaggggcctccctgcctcttccactgtcaccatcctctgcctcagggctgccatcatcgctctccctccttttcctgaatcccagcaccactggctcctccagggcccgctccaggggttatcccctcccctgcctccactctgtctctactcagtcctcccacccatgagcaaacacagccacactgtctccccatcccaaaaaagaacgttcctcagttcctcaaaacattaaacacagaatgaccatatgatccagcaattccacttctgggtatatacccaaaagaacaaaagaagggagaggcatgtgtacccccatgttcacggcagcattactcacaatagtgaaaaggtggaggcaaaccaagtgtccatccacaaatgcgtgcattgataaaatggagtccatccacacaatggagtgttattcagccttgaaaggaaattcagacacatgccacaacatggatggaccctgaggacactgtgctgagcaaaataagccgatcacaaaaggacaaatatgtgtgactccacttctgtgaggtacctacggtagtcaaattcttagagacaggaagtagagtggtggttgccagagcctggggagaggagggaatgtggaattcgtgttgaatggtgactggatacagagtttcagttggggaagatgaaaagcgttctgtggatggatggtggtagtcatacgaaggtgactaataatcccccaaatgcccaatcccatcacccattctcagaactccatggcatttgacactgctaaccaacttctacagcattaagcccgctgctccccagctctcgttctgcaattgttgagggacagttatgcgcacgtgtgtgtgtgtgagaatatacgttatgaattatactgggtgtgcatttatgtacatatatgcatatagacgatatttttttaattccacttactgaacatctactaccattatcagaaattacacaagtatttacatgcatcatcccatataatccccccaaattgccctgtattgcttcctgactccatctacaccatcaccagttttttcttggtttctttgctggcattgtcatatggtggagtccttggggttctgtccctcctcatctgcccaggtgagctcacgcactttcatagctcaccgccatctctgtggtgatggctctgagtcttcctttccagtccaggcccatctgctgagctccagacaccacacccatgtgtccacccaacatttcccatgagcctctcaaagtcaggacagccaataccaacccagttctctctccatccctccctcccaattcctctccagcatctatgctccttgttttataacctctgttgctgttgtccccctgaagcaccaagggaaaggaaaagcctcctcactgggattcctaatggaagcgtttgcacacagtgaccctcccagcacggaccccttgttaatagatgggtaggaagcaccaggaacagagtatgttcaaaatcagataagcgttataaaaactggtatggggtcagagtggagatcattttccaaaccaactattcgaaccaccccatcgccatctgggtaaagactgggttgtgcctccagcaagctactctgacttgggaagaccgtgtgcaactatctttgggaaacacagccgcatgctccttggctggaaatgatcagaggctctaaggagtgtaaaaagggaacacaaccctgattctaatttttattcttggagaaatcacgttttatttttcatatcaaagagggggaactctgtgggcagagtactctgccgagaaccagttctgttctgcaacttgtcccaatcatcaggaaaacacatgttccagggaagcccccatcagggcacacacagccccaaatcagggcatgctgtcacttcctctcattccctcgagagcccacctggccaaagaggctccagtggcctgattggagggcacatcaataatatggagggtccccgtgccccccgacctggaaagtcagcctcagcgatggggctctcggggcctcttaaaatgggaaaaacagaagatgaaaaggctgtttgcacttgtcagcaatgctggcactgctcactatccatactttaccctccccaattaaaaccacacacttgatctgttcacataacaaagcctcccttagagcccccagaggtgcctgctcccaaaacagcactgtcagggcacagcctcagtcctcactggacagaaaccaggggcagggaccaatcctctctctgtcccagccctttcaaaccaaagacagcgtctctgcgaaggagggaagccgcatgttttcatgctgagatacagtgcagatttatgatcggcacctgtgaggtcctcaggtacctcttgctggaacagagcaacaggtttctaaaggttctggcccttggcctctacatttgtcaccactcctgtggtcactcttcagtggaagttgctcaccagcctccttgtcccacatgtaaaagccaaaaggaggggccctacagcaccactgtcattggaatccttccaacattccccacccaccttatgcagtgggaagacaaggttcctaccagaccctccaaagcccaggaacctctccctgtgctgacatccaaagatgcccggcgttccaaaacaccagaaatccagggaagaggccctaccttggggatgagtacattaggaaatagccaaggagcaggattaagtaattatacactagcccaccaggaaaccatgacactgaacatcccatggggcccacgggtctggtgggtgtttctcgcccactgggggctggataagtgagcatgagggtgtgccccaagaagtgtccgaggcagagctcaatcctttagaggtttattttgccaaggttgggatgtacccaagcaaaagaaacacaagttacagtagggtctgcggcctgggcttttctccaaagaggggtctgagaaagagcaagcaggaggggaaaaggagagaggggtgcccatgaggcaagtggttacatcctcggaggctttgattggcattcagtgaatctgcatcttacatataaaaagaaggggccgggcgcggtggctcacacctgtaatcccagcactttgggagggggaggcgggtggatcacaaggtcaggagatcgagaccatcctggctaacatggtgaaaccccatctctactaaaaatagaaaacattagccaggcgtgatggtgggcgcctgtagtcccagctactcaggaggctgaggcaggagaatggcgtgaacctgggaggtggagcttgcagtgagccgagatcgcgccactgcactccgcctgggcgacagagcaagactccgtctcaaaaagaaagaaagacagacagaaagaaagacagacagaaagaaagacagacagaaagaaagacagacaaagaaagaaagaaagaaagaaagaaagaaagaaagaaagaaagaaagaaagaaagaaagaaagaaagaaagaaagaaagagaaagagaaaagaaggggataggggaaaagccaagtatgcattcttctcaggctcagcaaatctacattttatataagcaagcatgtgaaatcacggctatccgttgcggggtgcgggataaaaaggaaagtggttttttgcatgactcagttctcaagcttaactttccctttggcatagtgagtctggggtccacagcttccttcttttttttctttttttcttttttttctttttttttttcttttctgtcacccaagctggagtgcagtggcttgatctcagctcactgcaaactccgactcccaggttcaagcgattctcctgcctcagcctcccgaatacctggcactacaggcgcccaccaccatgcctggctaatttttgtatttttagtagagacggggtttcaccatattggccaggctggtctcgaactcctgaccttgtgatccgcccacctcggcctcccaaagtgctgggattacaggtgtgagccatcacacctggccggcagatttcattttcctttcacaaatgcgtggtctactggacaagccctgagatgaagatggctagagaggctccacagtccctggaggggggcactggcaggcggtccacggccactcaggctgagaccctggctctagaaaagggaggaagtgcaggtaccaataaggtttaaggatggatgtatcagactgtggacaaagactaaaagaaacagggctgccagcccaatactgacaccttgcttcctcatagaatagcagatgtgttggggtggcaatgtgcccaactgctatggtctaaatgtttgggtccccccaaaattcctatgttgaaatcctaacacccaatgtgattgtattaggaggtggagcttttggaggtgatttggtgatgacggtggagccctcatgaatggaattagtgcgagatactgggatttacaagaagaaatatatatctgctcttcttgtttcctggcatgcagctcctaacacttggaatctccaaggtgatgtgtctttttgtgtgctaataagatgagtggtagtgaggggcttctggacagcctcaggatgggggctgattgccaagtgaaccaaccctgtgattagagcgttggaactttcaggcccacaatcccaccaccacccctcaccttagggaagggaagaggggccaaaggttgagttaatcacccaacaaccaatgatgtaatcaatcaagctatgcaatgatgcctccataaaaacctaaaataactggatttggagagcttccagttgctgagcacatggaggttcctggagggtggcgcccagagaaagctccacacccctttccacaaataagaggttaccctgtgcatctcctccatctggctgttcatctgtatcctttgtaatatcctttataataattgggtaaatgtaagcaagaatgtttccctgagttcttgagccatgccagccatcccactcctggagaagggagttgtgagaaccccaatttatagaccatcagtcagaggtacagatcacaacctgggatttgcaactgccatctagagtggaagcatctgagccctcaacctgtgggatctgatgcgaattccaggcagacagtgtcaggactgaactgacttagaggacacccagctgatgtctgctggagaattgcttgctgtatgggaaaacatcccacacacatctgggcgaccagagaagcattctaaattattgagagtgagggctggaaaaactgtgtttttctatatctcgaacagtgcccttataaattaagaggccgaagagagctagttcgccccttccaccaagtgaggacacagcaagaaggcatgatgcagaaggaagcaggccttcctcagacactgaatctgccagcaccttgatcttggacttctggctccagaactgtgagcaataaatgcctgttgtttttaagctaccgactctaaggcattttgttatagcaaccccacacggactaagacaccaactaacactcctttcccagaccacactggcttaggagtggccatgtgacccaattcagactaaagaggtgaggggggaagtctgctaggtggttcttggaaggtttttttttcctggaacaggttccccacgtttctgtttccaattcttgctgcctggaagacagacacgctacttggagaaatagaagccctgcagtaatcctgagacaatacgcacagagcaaagccaacatgccaaagttggccagcagaaaggaggaggagcctcggtccccagtggcaccatggggtggggagtgagatcatggctttttcttgatatacgtgtatactgtttcacctgtgcattagttttgtatggctgccacaacaaattacctcaaagtcagcagcttaaagcaacacaaatttatgatcttgcatttctgtaggttagaagtcccaaacaggtctccctgtggagactctagggctgaatccattatcctgccttttcccactcctagaggtgacccacattccttggttgtcagccaccttcctccattcctgacttccagagccaggagcatggtatctcttgagccattcttctgcagtcacacctccttctgattctcctcttctgcctccctcttccacttatgggactttctctcacccagataatccaggattacatcccttttcgaggtcaactgaccagcaatcttaattccatccacaaccttaattcccctttaccacataacctaacatgttccagggattaaggcatggacatctttgtggaggggggtcactattcagccaaccacaaattcttacagcaagcaaattccttttgttatttaaaacacaaatcaaataatttttaattaaaatattttaattgaatattaaaaattgggactgtaatccaataaatcaaaaaagaaagtccaacctttaaagcacaatgaatcaagaatgctaagatttccatggagaaaagaagtcattctgggattagatgagaacaggccccttctaccacctctgctgatcagtgggcatgcctttactcataaaaaacagagtacagggagctctgcatagcacagtcttcgccaggctgaggctgcttcccagctcctgtgtgtctgactgggctagtccttcacatcccatgcaaaaggttgaatttttttattttctttgagacagggtctcactctgttgcccaggctggagtgcagtggcacaatcgcagctcactgcagcttcaacctctgggcttaagccatcctcccacctcagcctcctgagtagctgggactacaggtgcatgccactgggactacaggtgcatgccaccagacctggctgatttttttttttttttcgtagagatgggggtctcgccatgttgcccaagctggtctcgaactcctgggcacaagtgaccttcccacctggctttgaatatttttaaatttactttaaaaaatgggcttggccgggcgtggtggctcacccctgtaatcccagcactttgggaggccaaggcaggtggattacctgaggtcaggagttcaagaccagcctggccaacatggtgaaactccgtctctgctaaaaatacaaaaaaaattagctgggcgtggtggcaagtgcctgtaatcccacctacttgggaggctaaggcaggagaatcacttgaacccgggacgtggaggctgcagtgagcgggattgagtgcactctagcactgcactctagcctgggtgatggagcgagactctctgtctcaaaaaaaaaagggcttaagcaatttccaattatttaaatttttttgaacttaataagcccaacaagatctttctcctttctaattaatgctaccaggtgagcatcttgaaaaacagtggcctataggtgggtcaccattctccgttgacacaagccctcctacaacagcacctcggggagggagcctcaatgggctccagtgcttcacctatgatgggattctgtggatttaaaacgaagacacaccactgaccttcaagaatctccctggcagatatctcccaaacattcagtcctgatacaagtatcttcataactggaattcacctacttccagaacgtcaggatgagtacccaggacagctctgactgcctgttgcttaaaaccatgcccaggtcataaagccctcactgtactgtaccctaaatgcacttaagcgactgttttctacagtgtcctagtactgaatgttgacactaacctatgaaactaagtgtcatacttactgtgaggcagagaaaccatcaactgaccacaaggtttgtttcaagaacaaatcgagacgaaccaataatgcagaggctaaatttttcaaatcaataataatacagttcacatgcaagagcttttgaaaactcttccatatgataaatatcacatcacatcggtagagatggaaattagattgctcaaccaggtgaatcaaatttaatccagctttttccatcctgttttctaaatatcttgtattattttaaattagttttgaaaaatcaatctgaaagtataaaagatacaaatgaaatctgggtcttggagcccctgggtctaggagcctgattccaagaacacatttcacctgcagctccaaccaggggtctcttcccaacccctggcctgaaggtctccagcctgggatggagcacctccttccttagaaacaaacactgttactgcatctacatgaaatggctcaaaagagttaagagagaatgttgcgatcactgaagaatggtctgaatgagaaagaaagagtagtggacatttaaagcttaattgccagactcagcttttcccttaatcagggaaactgacctaatgagaacagaggggtctctgtgaagctgccaagctcaaaggaggcaaggcagcataaagagacatctgaaggcaggtgtgacatccaaactaggagaagctcagagaaagaagcaaccagggacaggacaacctccatgaaacgatgtgtttgagctgaggtgctggccatggtgctgacaggggtcagcttggggaggcccagggaggtggaagatgaaggcttgatcactgactggatagaaagacagggacaggaagaagaaggagcttggcaggtgaagtgcaggcacaaatacctacccttctctgctttcggaatgtgatgaatgtgaatgatcaccctttatgtcctttataggacaaaaacctcagcagaataaataaccaacatgttagtcacactaaagaaccactctgaagcacagaagaataagcagagtaagatgaacaagacaaaaactttaatattaaagaagaaaatagaagtttgttacaacaaaattacaccaaacttgttaacagaacaatgtggcagcttaagactcaagactttatttttctcatcctcaaaggtccacttcatggttttaattagacaaacattttgtagagtactataattctctatcttttaaatacacattcacattatggtgaaattgggaaatcctaatatttacttgtattaagaagtgtttaagcagtccctttcctctacaaactcaccggtacctgttgttttttgactttttaatagaagccattctgactggtgtgatatggtatttcattgtgcttttgatttgcatttctctaatgataagtgatattgagcattttttcataggcttgttgactgcacgtatgtctttggaaaagtgtctgttcatgtcctttgcccactttttaatgagtttcttagttttttgcttgtacatttgtttaagttccttgtagattctgaatattggacctttgtcagatgcatagtttgcaaatattttctcccatcctgtaggctgcctgttttctctattgatagtttcttttctgtgcagaagctccttaattatgtaccatttgtcaatttttgcttttggtggtgttgtcatgaaatctttgccagtttccatgtccaaaatggtatttcctgggttatcttccagggtttttatagttttgggtttttacattttagtccttaatccatcttcagttgatttttgtatatggtgaagggaacgggcccagtttcagtcttctgcctatggttagccagctatcccggcaccatttattgaatagggagccctttccccactgcttgctttgcaggtgggggtgtaaattagttcaatcattgtggaaagcagtgtggcaattcctcaaagagctaaaaacagaattaccattcagcccagcaatcctagtactgaggataaacccaaaggaatataaatcattctatcataaagacacatgcatgcatatgctctctgcaacactattcacaatagcaaagacactgaatcaacctaaatgcccatcaatggtagactgggtaaagaaaatgtggtacatatacatcatggaatatgatgcggccattaaaaagaatgatgttcctgcaaaggaacatagatggccattatccttagcaaattaatgcaggaacagaaaaccaaatactgcatgttctcacttaaaagcgggagctaaacaatgagtacacatggacagaaagaggggaacaacagactctggggcctacttgagagaagagggtgggaggagagagagattcaggaaaaaaaaaaactgttgggtactatgcttagtactcaggtgaggaaataatctgtacaccaaacccccaagtcacgaatttacctgtataacaaacctgcactgaacctaaaataaaggttaaaaaaaaagaagtgttaacagctccaaataagtaagagtaactgtccactccctgcagttgttcccactgagcctctggtggccccaccccaatccctatggggtctagaaagagtgccccggtctccctggtccttcgctgatgatggggggtggcagctctctggccggccctcggccctcggccctcgcctctcgcctgttaggtaccctggacttctccacatccttccccaccccttctcgcctctcccacaggagtctgcaggaccaggccagcaggtggctcagctgagcatctgcagacacagcacaccgaccccacagagaaaaggcactcccagaccactgtcacagagagctcatgtcgggggcgcgaggggctgagaggggccagtcacaagtcaggcaagtccatacagggacacagagagcaggcagaggtcagggcagctgtggatgactcggggcgtgactgaaatgcatgaaaggatggttcaagaacagcccagcagctcccctctgcccaccacgggagggtcttcactatcagtgaggaattaagactgcaggcagcgaagccccctccccaccggaaccttgcagggctccctcgaggggccaccactcctatcacagccactgtcctgctcatcccagtgaccttaggggccccacccccctgcaagtcctgctcactggcaagcctagcttggaggcaacgctcggggcaaagccagagggtcctccccaggccttctgtgcagacctctgcgaagaatcctgctcagcagtagatatttattgtattttaatatcagggccaaaagctacagttcgcttttcagttaagtaaatgtgtattcactaaagggttttaaaacctttttcctgaaaaaaatgttctagaccatcaaatgcctttttatattgttaacttttactcatttaaaatgcatgttttctaagccacattttacacacttttctatatagacaactctcaattaattccctaagccaaacccagaaatgtttaacacacactttattgacactaaggcacaaatgatgagtggcctctagtgttacccacaaccatctgctttctcagcagcactggcacctggtgctgacagcccctcacccacccccatctcccattccccatcccagagcaggcaagaggggaagtggatattgggaatcctgagagagcagggatttggggcaagcagtaaccagagaagggaagccatagcccttcaccctcgtcagctcccagaagcctctgaaacaccaggaaggaggcctcatgccacatggtatggaatggggctcaactaatgtgatgtggcgaataagcagaacacgggctgcttggctgtttcatctgcttctgttttcttggtagtatctggcctatcagagacaattataccacaccacagtcacagtcctacctgcctctgagtcctaagtgcagattcttaagaagaacagacgggaatcctttagcgtcacagggtaggtgtgagtctgcgctccaggctccagagatgcttctgcaagcatgctgcccaaatccacgtcttttctgctactgggagctctctcatctttaaaatacagaatgcatttctcatatctgaaggaatatatttaactggtgtctcaacataacacttaaagcaaaacccaaaagcagagggtggggggttggggggagtaaagagcagccatatcccagtggaggggcaggaggaagagaaagaaggcctcaggagacctggtcaggccggctgagcggcaggggatgcaggacaagcaggcagaaatgagtggaaaagctgagagaggccgagaggaaattaaaccggaggaggcagagccaagtaacgagcaaacatgaaaggaaatgcctccctgcttcctgccctttctaaaatcacctcgaggcaactgaccacaaatagtcttctatcacaataaaaaaggagatcagaaatttcccggctgtttagtggcctgccaatgccacaccacagtcaccggccttcactgaacaccccggtgcagggggagagaatgtaataacttcttaagaatctgcacttaagcctcagaggccggtaggactgttactgtggtgcagtgatcacggtgctgcaaggcacggcaggacaatttcacagccctgtcctggaagtggcggaggggaggaggactgtgcctcacaagcagtgtactaacccagggatgaaaagcacacatttacttaactgaaaagtgaactgtagcttttggccctgatattaaaatacaataaatatctactgctgagcaggattcttcgcagaggtctgcacagaaggcctggggaggacctgctagctttgccccagcaaatacagagcatagacacccccaccggccagagtgccctgggctgggctgcacacttcctgttgatttcttgtccaattatctcaataatacatcctcaaggaaggaagtggagaacacacagaaaagaagaaaagaaataacgtatatcaccaccaggaaataaccactgctgctaatattttgatgtgtttccaatcagactttttttttgtacatgcacattgtacaaaattggaatcctactgtatagcaggaatcttgctgtgttcatttaaaataacatgagaccttctccaggccactgaatattctttgaaagcacggttttaatggccacagaatctgggaatgacatagtataaccaccctgctattattaagatattcaagctgcatccaattttcaactatgataagtaaagcttcagtgagtctctttacatacaaatgatactgacatctccgattttaatataaacccttagaaagaggatgattgagtcaaaggtcacaaacacttcttttccagaaggttccatcacttgacatttcctccactggagtatgagagtattcatcctccagcactcacccatactgagaataattatgagactgcaccagtttggtggacccaaaaacaaaaaagaattttttaaatttgcatttctctgattacttgtgaggtttggtacttttctatttgccttttatttttcttcagtgacttgccaactagagtccactgcagattttttccatttgatgttaatgttttcttattgatttatgactgcttttagtataatagggatggattggcaggtggacagcgtatgtcctgatttaccaattctgttgatgctgtttgacacacacaggatgctaatggatgtgtggtcaattgtatcaatctttccccttattatgacttccattgcaagtagagtgtcatggcccttcagcctgggatccagactcagctcccccactcactatctcagtgaccctctctttgcctcaatttccttgattgaacgtgcaggataatgagaatgcatttaatccatatagttagtatgtggcacacagcctcagagatggccccaatgccccccacctcctataatggcattcacatgtgatccctgcaggtccagccagcaggggccagggcctgcgaacagccacggagtgagcttggaggtagatactccccagtggtccctggagatgacgcagctccagccaacacttagtgagatcctcagccagaggcaacctgcaaagctgtgccaagattcctggcccacaaaactgggaagtaatacacattcgttgctgtaaactgctacatttaagggtgatttgctatgcagcaggagattactaatgcattatacacgtaaagcacttagaacagtggctgtggcagatcacacaaaaaaggcctaacacgttgacagtcctcccatggaaagaggaaatccgtctccacctggggtagctcagcttgactgtgtgatttgctctgaccaatggagctgtggcaaacgtgaagtcacctacacacaggagcctgcctcttacaactcctgaaactctgctgtctccatgtgaagaagcccagcctgctgggggatgagactacaaagcccatcacccctgctcaccccagtttacaggcagccatcctgacaatgcagcccatcacccctgcccgccccagcttacaggcaagccatactaaccatgtgaggccatcaatgcacgaccatgaatgagctcagcaaagagagccacccagccaagcccagcctgaatttccaacccaaatcacccactgagtaagtagttgctggtagaagccactatgttctggaatagtttgttacacagcatttgatacctaatacagctgccattattactactattattgtcttgggatcagttacatgatcatacatatttcttaacagtatatttatgcttttactttttaatccataggaaacttatttttgtgtatgatattaggtgaggacctaacaatgttttgccacacagccagttctcccttctccataaaactgcaacaccttgttttcacatattagaatccagagcaggggctcccaacccccaggccaccgaccagtatcagtccatggcctgttaggaatcaggccgcactgcaggaggtgagcagtgggcaagtgagcgaagcttcatctgtatttacagctgctccccactgcttgtgttaccacctgagctttgcctcctgtcagatcagcagcagcagcagattctcataggagcatgaaccctattgtaaactgtgcatgtaaaggatctaggttgtggctccttatgaaaagctaatgcctgatgatccgtcactatctcccatcatccccagatgaaactgtccagttgcaggaaaacaagctcagggctcccactgattctacattatggtgagttgcataattatttcattatatagtacaatgtaataataacagaaataaagtgtacaataaacgtaatgtgcttgaatcatcctgaaaccatccccaccccctccctgtccatggaaaaattgtcttccatgaaaccagtccctggtgcccaaaaggctggagactgctgatgtagagaatttggtgatatcatttccagtgatcatttctattggtatagtattaatagtaaatcttgacccaataccatacagctggtttgttttcattttgtcaggataatactgcatgttctttccactgaggcatggcaggagaaatgctcactaatctgactgcatggaagaggaggggtagtgaagttgctggggcaggtgcaggaggagagggagagcagcaacatgaatcaagagacagacacagtcacagtcaccaaagggatgggggtgacgtcaaggctattttttgtctgaaacagaaacaaaacctgccctaactttctaagtcagtcggctgccaaattccacaagctgattctgagcagggcactaggccctgtgaaggggttggcaaggtgcaaggagcatgtgggacagtgccccctcccaggtgttcacagccgcagaggggagacagtgccacctacgaaaccctggagaaaatatgtataaaccaagatgaacacaaattaatataatacaaataatatagaacggaaggagagcttagaagccccacaggtcaatcatggatggctacttggaggaaagttttcagatcctgaggagtaagatcagcaaagagtggtgtgtgcaaaggcaggaggctggaacacataattcatgtggactcatcagttacttggttagcgtaaaaagtctataaacaggtacactatgcagtgaggctgatgaaggcataggggccaatctgatggaagatcttcagtgttaggtctggtcttcaagagaaatgagcaaacaatgtgtgtttttaggtaataagagtaggaaactacaggttgtgcaccttcacagggccccgtgttcttgacacggttctgtgacatatgcagcattccccagtggctccagcagaaggaactgccttccctagaattctcaaaaaggagcacgacttcccaaaggaaaggaagcacagaagccggcatggttcccaggggaagatgcctgagaggccagccggaccccagccctctcacacatccagtcggaatgtccctgcccctgccatcacttggtgcagagcaggcatgggccagctaagaaaatgacgtctttgcttattttcaaattgtactgaataacagctttgagcctcaacgtttagaaatgaaaatacaagcatgagcaaggtcctagtctaaggatccatccacagctctcaggagagcaacatcttctgtgtcccttgcagagtcttccatggtgggaaggggctgcactgtgcaggaaggcaggccctggccctggtgcctgctggaaaggggcatcacgagagacaggtgctcggggcagaggctcagctgcagtcacagaagccctgaggcttggacagagcctgtcctgtcagcgctggcacccgctgccagggcccagttatactgcctgttcctttggctgtgttaatgagggcctaactagcagtggaggcctcacttccccatcagcatgaagctgctaagtgtcccccaaaacagtcgaaagtgtcacacgggagagacacactcgagagaaacttctgctgccccttgggttccagatttgcagtttgattttgcttgcctccatcaaggaccacacgaaccccaaattccaaataagaacactgcaggccagtgggaacctactgcctgtagcctgcaggatgaggcacggcttcctcacacccgaaccaagaggaccagctgtctcagcccacagagcccaggcctggcaaggagctggagcctgtatgagtcaggcctctccacagaaacaaaactgataggacacatatatcagaggaaattcattatgggaattggctcacacaattacagaagctgagaagtcttatgatctgctctctgcaagaggaagacccaggatagctagcatgtcggtcagtctgagtctaaaggcctgaggacagggtccaaaggcccaagaaccaggagcaccgatgtccgaaggcaggagaaaatgaatgtcccaactcaagtagagacagcaaatttgcccttcctgtgcctttttgatctatctgggccctccacagattggaggatgcatgcccaaactggcaagggcagatcttctttcctcagtctgctgattcaaatgtttatctcttcctgaaacaccctcacagacactatcaggaataatgttttaccagcacccctagcccaggcaaactgacacataaaattaaccatcgcagagccacgggcacggtagagaaggaaagcaatcctgagcccaccaagccccctacccaatccctccagctcttctcaaagcctccctgcccctcctcccaattttggagcttccgatccctgccctggacttggaggtgacccaggagtgatgcactagagataagccaaggtcatggtcacgcctcctctggatcctcagtcgacccaacttctccagcaccataatgtcaaacaatcatagctaatagtacatttttatatgaaaaaggaggattctctgctgaggataacacatgcttgaacacaaacgtttttttctggtttgtactcacgttcactttcagcagaatacgtctcctctgactcttcaggaaaccattccctttccttaatggggtagtattttttccacagactccttggtacattttctgtttgctttccctcacacaaaggagacttatccagagctaggacttgctaatggcaggcgtggattcagcaggtgtccggtgctgattcccacatgttcccaggcgcagagcaagaggaacagacccaatctccagggcaggcaaacttcaccaggccagctgccacacagggttgacaagggattgttctgcacccactgactctttctccgacccatccaatcaacaggggtcccaagaagctaagatttccattatttcctgctgcggggctcagccagcctcccgcaccactccatgcgtccccagccagactatcagtcctggtccttctgagcaacccagctgtttcttaagaatgcagtttcaaagagaccttcaaagatggggtgcaaggacagtcatctggcccatggcctgtggagaagtggcagctctatgaaatcgttggtgtgacatttcctgggagggtacatttcctgggaggagagatgagtcccatcatctgccctgaggacaggcactcttctctagggagcaatgtaagcaaggccagttccaccatcctcatagattatttctcacccttactgtaagaggtcctcaattctccagtcttcacaggtacagtagtttaatcaaactaggagttgtacatgatgttatataaagattatcgccaacagccagttattatccctaactccctcagagactaactacactgacattgagaaacgttaggtgactctgcagggttgtaagccaggagggagtgaagccaaggtttgcatagtgccttggccttctcctgtgagccccacatgcagcacaaacttggcccagaaagcccatggactcccttctcacactctatgtggggaatccaacctttgggaggtgactcttccattaacacagcttctaattcagttaattacttgacttgataggttagttccctttgttactacaaacaccactacctgcaagctatggtaatattatcatgcttcattaaaagttatcaagtgatctactttctaatagaggtataaacacctaaacacagctatttcaggccagatgaggtggcttacacctgaaatcctagcatttttggaggccaagacaggagggttgcttgagatgagaagttcaagaccagcctgggcaacacagcaagaccatgtcacaacaaaaaacattttttttttaatagctgggtgtggtggtgcacgcctgtagtcccagctactcaagatgctgaggcaagaggatcctgtgagcccaggagtttgaggctgcagtgagccacgatcgcaccactgccttccagcctgggtgacagagcaagactctatctcttaacaacaacaaagacagctatttcagactaagcctttaactttaaaaatatgaaacaatgtatgtgtcagttacgattcttaaatcattatgtctgcctgggtgcggtggctcatgcctgtaatcccgacactctggaaggccaaggtgggtggatcaccttgaggtcaggaattcgagatcagcctggccaacatagtgaaaccccatcactactaaaaatacaaaaattagcccggcacggtggcgcgtgcctgtattcccagctacttgggaggctgaggcaggagaatcacttgagcccggaggcggaggctgcagtgacccgagattgtgccactgcactccagcctgggcgacagagtgagactctgtctcaaaaaacaaaacaaaacaacaacaagaaaaaacacaattcttaaatcatcacatctaactggagtcaagtcattaacacatttgagaaatttagcaataacaaaaagattattaggattcttctaagctaacaattctaaattctaactacaaaaccaaatgttctggcttaccacaacagagaataacatccaagccactatcacgtcttttccaattagtaagccattggtggtgtgaataaaacctagaagtcaattttctacgaactctagcaggaagaaaagtgattcagctttacagttatcttctgacctgtttttagtcttcatgtaacaaaaagcttgtcaagttacaattttcttatagtgcctcactatagaacatttattctatacaaatgggattttctcaagacaataactacggcatcaacacgaggatgactgtaagacatcaatattttatctattttcatggatgttggacatgcccaacactatcccattttgtaaatgtattgccttgctctgtgtgatgtttgtgataaatgtagtgtcacagaaagcctccatgactgttatttcccttcattttataaatgccaagtttatttaaacctactgtcacatgactttgttaaccaaatacaactgttgaaactgttctaaaacaatgcttatatcagtatcaacacaccagaaaacatgagttgcttctcaaaaaaatttctgatggcccaaaatatcccaatattttgctcaagaaaggtaatttttcatttgatggtgttgatttttattatgataaaatacacagaaaataaaattttccattttcaccagttttttatttttttatcattttttgagacggagtcttgctctgtcgcccaggctagagagcagtggtgcgatcttggctcactgtaacctccgccttccaggttcaagcgattctccttactcagcctctcgagtagtacaggtgtctgccactgtgccaggctaatttttgtacttttggtagagctggggtttcactatcttggccctgctggtctggaactctcgaccttgtgatccacccgcttcggcctcccatagtgctgggattacaggcatgagccaccgtgcccggccatcattttcaccagtttttaagtgtatggttcagcagcattgagtacatttactgtgtttgcaaccatcaccaccacccatcttcagaacgtcttccaagactgaaactctgcacccactgaacaactccccattcctccctagccccgtccctggcaaccaccattctattttctgtctctgtgggtttgactactctatgtccctcatataaagtgaagtcatacagttattcgtccttttgtgactgacttatttcactcagcaccatgtcaaggttcatccatggtgcagcatgtgtcagaatctccttcctttttaaggctgagtaatgtttcatgacaggtgtaaaccacattctgtttacccattcttccatcaatggacgcttgggttgcttccatgttttagctattgtgaatcatgctgctatgaacatggctgtgcaaatatctctttgagcctctgctttccatcctttgagtatatacccagaagtgggattgctggatcacatggtaattctgttttaattttttgaggaaccactactctcctttgttcagtggctcacacctgtaatcccagcactttggaaggctgaggcgggcagatcaccttgggtcaggagtttgagaccagcctggctaacatggtgaaaccccgtttctactaaaaatacaaaaaattagccaggtgtggtgggccacacctgtaatgccagctactcgggaggctgaggcaagagaatcacttgaacccaggaggtggaggttgcagtgagccaaggtcgcaccactgcagtccagcttaggcaacaagagcgaaattcgatctcaaaactaataataataataataatacaattaaattcctcaagatgaaaagtggtggccaagtgtctggtgtactctgcaagttctgagaatcactaggagtcccatcacaaccttttcagcaaagcaatattctctctgggcatgacccctatgtccagaggacagtgtcaacccaaccaggctctgggcaggtggctgtagcttatcacagaaaaaagaaatcccaccagtgagaaccctctacaataaaatcagaaacagactcctaagatatgtagtttctactcctgttgatagtttttaaaaataatgaagggtaggaagttccagttaatagtgataactcgatcttgtgcacctacctctctcctgcctcctgaaaccttggacacactcggacaagaagatgaggaggtgcctccaggggcaggagagtccaacagccttttcaaagccttaacatggacataggaatggcgactgagatggcaggtacatggagggggagtgacgaggctcaggctgattcccctgcagaacttaggagcctgtgggttggagccactggggccccaggaggcaggctgcagagacacccaccaggctggaaaccaggggttggaaagaaggcttggcccaggcacttccacctgtctcatgaagcactgtgaccacacacctcagaggatactgaaacccagtccctggagaaagtatcaggaaaggttcagcggcccagggctgagttcagcaaccgatcttcaccaggtccaggggctgcttaggggatgggagttttctaaaactgggcatgtggctgcacaattatacaatgtattaaaaaatcattgagccgtagatttacaataggtgaataggacagtctgtaaattatacagcagcaaaactttaaaaatgcacagatgagagagagagacggaagtaaccaaaataccaaggaactatcaatgtggcaagtttttgatttttttttcctgctacccaacaaaatatgagtctgagaacaagataaggtgaattattttaaaaaataagaaatgatttccatgtgacacagcaattccacttctgggtacataccctaaataactgaaagcaggagctctaacagatatctgtgcacctatgttcacagcaggattactcacagtagctgcatggtggaaataacataagtgtccatcaatggcagaacagatatacaaaatgtggcacagacacaccatggaatattattttgctacaaaaaggagggaaatattgacacatgctccaacacggataaaccttgaggatgttacgctgagtgaaataagccagccatgaaacgacacatactgcaagatgccactcatatgagttgcccagagtcatcaaattcattgagatggaaaggagaataggggttccaggggccggggagaagggagatcatgttcaatggggacagttttagttgaggaagagggagtcttctggagatggattgcggtggtggctgcacagcaatgagaatgtacttactgccactgaaccgtactcttaaaaatggctaagacggtaaatgttatgttatagatatttcaccatgatactaaaaaaaaaagataaggaatgctatttttgcacagaaaagaataaagaaaagaaggacagctgagaaacgtggaagtgggtgtccctgcaactgggggcacctgcacagcatggggcaagaacagccactttcattaccagcttctcaacacaatttcactttgactctgttatatactagacagatttttaagcattaattttaaaacatgatggagagtggcggagatgaagagaaaatcaaatcatggaagctacacaccaataagcctgatgtcaatcacaggccagatctgagaggggactatcagagcagaaggctcgtgagtacttcaggaagcaagtgccaggccaaatgcatcttgatttctcttttaataaggttatgagattggcatattagagaaatgctgagcagatgagggcctttatttcagcaagaagttaacacagtcgctcgtggaccctatgaagaggaggcgatgtggaggggccccctgggcagggggcagcgaggccgctcatggcacaacctcggaaacagcaggagcagttggtccagccacagagctccggcccagcctggatgcaggacggggaacttgtttaaaacaggctgacaccatcgggcctgtaccctcagagacgagcctcccaatcaagatgagatcatctcaacaggctggaatgctaacttttaaagcgaacagatgaatttatcagtcttacaaatgttccgcaatttggtaccacaattcattaactgccatgagctgtaggacacagtggaaaggaaaaaagcatggggctttagaggaggagcagccccttcacctgaggcagtgacgatgcggttgggagctgcccaggccatagtggaaaccacccaatgtctgcccccgatataacccccactcagcactggtgccatgtccaaagtgacaagatgcccagaagccaccagatgaaaactgggtgaccagccttcaaatgtgcaagcagaaaaaagagctatgcagggaatggggtgcagaagtggttttctccatttgcagaacttcaatgttggaagggaagtaaggacatttcttggttctccaggaagagccaggcaaacagaatcattgtccaaaaatagatttggctctagttaaagctgcctgacaactgagccacgtgacactgcaagctccccatccccagctcagggaaacggagtgcccacacatcagaaatgccactgaaggactgtgcactctgcagaggattgacttaagtggaccataaacaccttctgataccctacagtaaaagagtaacagtgatgaaaataacaacttccatttgctaagtcctgaccgcagccaggcaatcctggatgtactctaaaggcttcctgactctgagtctttgattctcaaattgtatggtccattataaatacaatcaacaatcaaaccccaacataaagatatttaacataaatcattagttctttgggatgacagttataaataatttttataattctttaaaaggaagagtctatcaagtttataataaaaattgcctaacactaacatttaattagtcctaatacctgaccgacttcttctttcgagacatcagggtatacctaacaatgttcagatttgataaggtctcgaggaagcaggtagctcctttgtttgtggcctgagatctggcattgctgaagctagattgggccaggcctggctctgccaaatactgatgaactgccaggttcattcatttatccaacaaatatttactgagtgccagttatgtaccaggtgctgttctctgtaccggcagagagggcaaccagcccctgaagctggaagcatatggtttgaggatcaggaaaaccaagatgatggcatgatggagcgaggcatgagttcagcaggaagggccagtgagagcagctccgagcaacagtgcctcaaagggcaggttaaagaagaaaggaggggagagcaagaaagcagtgagagagactacacaagagaacaatgatgtctgctttatgtttctgtcatggtcactctggctgctgggtggagatggtcagcagagaagcaggaaagacagaaaagagaccagccagcaaggtagacactgcagcccccaggagagagcccaggagaggacgctgcagcccccaggggaggacactgctgcacccaggggagggcccaggtgaggatgctgatggccccaggggagggtccaggggaggatgctgcagccccctgggaagagccgaggagaggacgctgcacccccaagggagagcccaggggaggatgctgcagcccccaggggagagcccaggggaggatgctgcagcccccagggtagggcccaggggaggatgctgcagcccccaggggagggcccaggggaggatgctgcagcccccaggggagggcccggggaggatgctgatggccccaggggagggcccaggggtggatgctgcagcccccaggggagggcccaggagaggacgctgcagcccccaggagagggcccaggagaggacgctgcagcccccaggggagggcccaggggaggatgctgcagcccccaggggagggcccaggggaggatgctgcagcccccagggaagggcccaggggaagatgctgcagcccccagggtagggcccaggggaggatgctgcagcccccaggggagggcccaggggaggatgctgcagcccccaggggagggcccggggaggatgctgatggccccaggggagggcccaggggtggatgctgatggccccaggggagggcccaggggaggatgctgatggccccaggggagggcccaggggaggatgctgcagcccccaagtaaaactggagctcctccagaggaacagcagcaggggtggagggagggaatccagcctgggtgtgtcctgcggcaaagcgatgggcagggctaaaggaaaaggagaaatcgagatgcctctcaggctattggagtgaacaatggacaagaaaggaagccatgttttaaagatgtgcttaggtagtgttccacccaaagttcaaatccaagtcactgccaaaatgcaaaatgcaaactgccagacttgtggtctgttcatctatcagtaaacagggatgaataaaggcagaacatgcctgttcccttcagaaactaaatggctagaataaagtactgttccatttccagggtggctcagctaaaacgccaaggaaacggccacctgagtgttcgatgggaacacagtgtgagatgcaggttaagaggatgcttttgaaggctgcagtgctttgtggttgggctgtcctagttataggcccttccaaggctgtgtcaaagagattcaatgcacagagaccacccggtgaaactaccacatccccctgctttcatcacatcactccttagaggaacacacgttactctgaggaagttgaacatccgtagcccaattaagaccatctatggccaggcacagaaggcagtgtccagctctgttccccttccagactggcctttctgcagcatgacttaccagccttcaatcacactctgtttctgctcccctgtgcctaacttggggtacccacaacccactgcccttctctgttatccactggatgaaagccacccagcaatcatggctagctccagctctgcccctccctgaagcctcttctgattgttcctgcctccagatgccaaacaaaccgctgcctaaagaccttgcaccacagcacaaggctcacagctctttctcctgcaagtggatggtacgtgccggacagaagacaagctgcttgaaagcaagatcatcatgcattgtttttattcccccaaagaacctaggacagtgtttccaatactgggagcaccctccttccaacagtgatcgactgtaaagccataaatatttctaaatgtatactgaacataattaagaaattccaagacagcaaatattcattttataagctggttctgggggtgggatctaacttgcatcactagaccaccaatggtacctaaatgtgaatgattaagaaaagacaggctgggcatggtggctcatgcctgtaatcctagcactttgggaggccagggtgggcagatcacttgaggtccagagatcgagaccagcctggcgaacatagtgaaacctcgtctccactaaaaatacaaaaattaggcggggtggtggcgcatgcctgtaatcccagctacttgggaggctgaggcaggcgaatcgcttgaacccaggaggcagagattgcagtgagccgagattgccccattgtactccagcctgcgcaacgagagcaaaactccatctcaaaaaaaaaaaaaaaaagcaagacagataatccaaatgaacatttgcagggttgattaaactaattaaatctttaatagtgtctgaagttgcttttcaattattaatttggatgcatttttgttaaacttctgaatatgattttaaaatatagttctaatcattagccaacacatacatttttaacaattatatgataattaaatctgttttgaaactgttgaaaattttcttatgtaaccccagttttcagggcttcaagcaactgtggagctacaaaaaaaatatattaatatgattttttaaaaagttcttccaacgttaaggtaacacacacaaaacctgcacaaaggccaccagagcagccccatgcagccaaatgcagtggcctttcttccctagggctccggcttaggataaggctggaagagcatccgaggtggttccaccccatcccgatagcccccttccagaaatgctgacacatgcaacatccaccaatggatgaacctcgaggacatggtgctgagggaaatacgccagtcacagaggacaaatcctgcaagattctgcttcttttttgttttgttttgtttgtttgtttgtttgagacagagtttcgctctgtcgcccaggctggagtacagtggcgtgatctgggctcactgcaagctccgcctcttgggttcaagcaattctcctgcctcagcctcctgggtagctggaattacaggcgcacgccaccacgcccagctaatttttgtatttttagtagagacagggtttcaccatgttggccaggctggtctcgaactactgacctccagtgatccacctgccttggcctcccaaagtgctaggattacaggcatgagccaccactcccagccgcatgactgcacttctatgcagtacctggagtagtcagattcacagagaagtagagtggtggttgccatggcgggggaggggaaatagggagttggtgttgaatgactacagagtttcagcttgggaaggtgaaaacgttatagagatggatggtggtgatggctgagcaacagtgtgaacgcactcaatgccactgagttgtacacttcaacatggttaagaggatcagtttcacatatgtgtattttaccacaattaaacattttttaataaattaattttttttaaaaagcctcccttccagctccaaaggctacctttgagacagcctcctggaagggacccagcaggtcccccgtaagactctgattaaagttgtaaactgccacctccatatttctatctatagttgaattttctttaccactaaagaagtacttttgtctccttttccacattcagtgcccctgggtcatcaaaagtaagagctaaaagcactgattttttgacaagcaagccacagattcaatatcatgtatgttcaacacagccttgaaaaccgcagaatagatttctttaaatcactaaaaggagcctaagacaagatcaaagaatggatcccaaattaactgaaaaccttcacacacataccacagacagtcacggcgtgtgtgtgaacacgggcaggatccagcaaagccactcaagattggcagaggggctgctcggtgccccccactgccacgtttgttctatgtgtggttgagcatccggagggtcctgaggcagtgccagcccactgaggtcacaggtgaagcccacaggtcctgggccctgccaagggctacaggacactcatcaatcagcaggtgagagtacatttacctgcttcgtctcggggagcctcctgccagctcccttgcaaacttcattcacctcacgcctccctccttcctgccaagttcacctctgttgcaatccagggcaggcaaatactcgtcactcggacaaccagggcccatccttcaccgcggctgccgctactaatcaaccatatggtcttttccagggaagcccagacgcacttcgaaatccttcccagtcctacaaacgctgccggaagccacaatcaactgacaagcactggcagacaaggtgatgcgtgtgactcttccacagcatcctgacagtggccagctcggggctcatgagcctgaaggacgctctgccttcaagacgtctgacatgagacagtccctcaaagatatgctagccctgacagtgagcagttcctccttgattctcttcctagattaattttttgtttaattggtaattaatgttcattccttaataccaagtcacaattaaaaattgctcaagtcacagtcatttgacaaacgtcatgccttgtttcacattagcaaccactattacaggtgatctcactagaccaactcaaaatactggctatggctcgaagtgactctgctaagtaaacagaggtggggcattggaatcactccacattttcctgccgactcctgaattcattaagcagagctcagcccaatgcactggttttttatagtgccccacacagccccagaggatctaggggacattgatggtcctgggtggggagttgctaagtggagagggttgtaatgcctgggccccaccttcatccagatcaactccattttcacatactgagcttcctcataagatttcattggtagaaaaggctccatcactaagagtaaaaacgtttcccaactgttggctaatgcattgtgcagagagtgaatgtgcacatagaaaaagctccaagaaggacttctgaccacacagcggcccctcgagctgcaggggcagccagcatggactgggatgtgctacaaatagaaagtgagggcacaggtggctgagaataggcacaggagagaacagaaagacaagcacagaaaacagagagaccccgggaggcgccgggataacagagaggcagaacagcggctacaaagtggcaggaagggctggcagatccctaggaataaagggagtagcaaagctccaagcaaatgctcaccagagcccatatgcccatcataacccacacggcagcacgggggccaagggccacaaaaggcaatgcacgcatacaccggggtaatacgtaagccccgcacccgccagtaggacagcacacctctggtgcaaaggccctgggtgtttctttgaaaacaattagtcacactgatctacaacacattgtttctcaatcttttttctacctcatgccttcttctgaaaaagaagattctgaacaagctgcaggcagcccacatgcacacgtggagatttgggggccctgatccagcagccccgggagaatcagaacctgcagtccacatgcacaactctctgattcaagatcaatgctgacagtggtcacccaaggaggagtggccctgagggctggggtggagcagagggtggaacacagcagcacgcggtgggggcccagaagggctgggccaagcaacagggcagtgggcccccacaagctggggagaggagcaccccaaaacaatcttcccccaagaaatgcaaagcaggaatcatcatgaggcctcaatgtgctcatgttacagaacaaagctctcctgatggtgttgcctttgttaccttgtctccaactctggggacgcttaaatgctgaagccaggcctgtcatgcaattcacccagcatcagcagggacaattcaggaagaggtggcaccaggaggaaaacagctctggaagggcaggtctcgataatcaaaacccaccttaaaaatggcatcatgatgaactgttcagacaaggcagctctggcttcagtgtgttaatattaaatattttatacacacacacaacacacaacacacacacacacacacacacacacacacacacacacacacacatataaatttgagacggagtctcgctctgttgcccaggctggagtgcaatggcgcaatctcggctcactgcaacctccgcctcctgggttcaagcaattctcctgcctcagcctcccaagtagctgggattacaggctccccccaccacgcccagctaatttttgtatgtttagtagagatgaggtttcaccatgttggccaggctggtctctaactcctgacctcatgtgatccatctgccttggcctcccaaagtgctgagattacaggtgtgagccactgcacccggcctataatcaattatattataagttattttataaattagtgtaataatacatgtgatataaatacaagaatctcccttttatccattttttaaagattttaggtttaagcatacaagtacttacatttgactactagaaagagaataaaaaatagattgtaactatctgctgaaggatgacaaaacagccactggctggtcagtacactcagtcaccagagaagtcttcaaagtagtcccaagaggccagttaggaagggggaaaggaggcagggtaggttcttgagggtgggggaagcaggggaggggcagctcaccagcactcactgtacagctggtttacctgttggacaggacggtgtttttccagcaatctcacttgggaaagaaggaggagcaggtggcccagcttcaccctatgacaagtgtgactttcttgcagccacaccatacccaggctgctcccaccccctcctttcccctctctggctacagctctgactaacccgggtaacctgtccctgggcagctggaatgtgccctcttctatagctgaatgttggtgtctcttttcctggaaaaccataacacttccaacaaaataaggaggccaccgagggatggtggcagctgcagttccccccatgtagaggattccctgcggcaatccagacccagcatgcctggatcttccaattctgcaaaagaattcaaagtccattctgtactgtgaactctcccaagttttaagtgttatcaaataaacatttttaaacaccgcatgagctaaagaaaacatacctgggagcggaaggccacctgtggtcttggttttaggacctctgaacaaaaagatagacttcagtgctcagggtgaacagaaaaatatgtttttgaaagaaataataacttgtcagaaagacgtctactctatgtcacgtcaataccaggcacagcagcgagggaccattggacaccggctgtcctcagttcaagaaaccgcctgaggctgctggcaaattgacctcagggccccggccgcagccacggccccatctcccgggctgaatgctgctgctctagcactcattcatgacaacgaggacatctcaaagctaggaggcccccggaggctccagttcaacaacatacccaaggtcaccccgtgggccacggcagtccggactcccacatcaagctgggcctcctggaagacagcactgaacctagccatggattctgcagacaaccttcaaacccccatctacagccttcaatagcaaaccctgaagcacagtgcgtgctgccctaccctatgacctagttacagacgggcttgcgacggttactaggagtgagagcagaggccctcattgtataaagaccagtgcccatcctgctacctcactgaaatggagggagaaagcctaaatcaccaagtttagagttggtgggcgagaagagaggctacctacggttcagggaaaccagcaaagataagccatccaggctggggcgggggccatccccaccctaccccaagtctcagaaaggctgcgcccggcgtcagggcacccctcctgggtaggggccctgagatgacagttcacacagatcagcccttcagaaaacactgtcatgcttctcaaacacattaaaacacaaatgactacggttcaggttcatggtcaagtccagtccttccatctctccctgacaatctatatgtcctggtcactgcgtggggacttaggtacctccttggccacacagttcaaggtcatttctgttgttgtttttttttcctttggagacagggtctcactccgtcacccaggctggagtgcagtggtacaatcttggctcatggcaacctccgcctcccgggttcaagtgattctcgtgcctcagcctcccaagtagctgggattatagacatgtaccaccactcccagctaatttttgtatcgttagaacagacagggtttcaccatgttggccaggctggtctcgaactcctgacctcaagtgatttactcgcgcctcagcctcccgaagtgctgggattacaggcgtgagccaccgcacccggccaaggtcatttcttcgggggatcttttgtgtagatgtcgtatcttgctcattacatattgatttttcctagttttattcatagaaagaaaccccattttcccaatgtggaagcacctccttatataaggcaaatgtatgaacatttttatcctgcagaaacctgtgtgccctacattgtatgatccagaatagattctggccctccaccataaaaagcacatgttcacaccaaagcaagcaaagacatgcggcactgagcgagagtgtgtgggagggggtgacaagaatggtctgtgggaccccggacagcctttctgggcccccagtcctcactgcacagatgccaataatcactgctgcttccaaggggtgagctggagacagaacgctgagagagtacaggctcacagcaggctgcatctgcgcacgctcttggtgtcatcactactgctggcctgagcaggaaggcccaccctgccacagcggtccctgcacagggctgagtcctgtgaccacagccccattaaaaaatgctctgtgctccatccggctcccttagcaacctcacagggtcccaacctcagagcaggatctggaaggaccgttcactcaccgcaccttggaatgcattcaacttggcggtggcccgaagctgactcccaccagggcagaggaaaaaacacaacccagtgggcaagaggggctgagggaggaggagtagggggcgagggggcagtgctgggcaaaaggaaggggacaccaagggcagacacatccctggatgtccaaatggaaagaaatgaggaggaggaggaagggtcccttgaagggccgtaccatcccgcagaggggacatgaggctgtcccagagaggggtatgggtcctgagaagctagttagcacctctgatgccagccctaatgtccactctccctggtccatggcacaccctctccaggcaggccttcccgagaggagagacctccagagaagcaggatctacggaagggcgagctgacccatggtgacaggtctcctacttccctgcccaagtggttggcatctgtatcttgttcatagtaagatctgctcatgagacaagagccactaagaaatattcacagacaagatgattgcatttggggaaaatgtgacagacctgaagtgaaaacaaaggccaacttacaaaatgtcaagagtccaacaacctgaaatgcaaagcaataatacacacatatacattttagacagcaaattatactcttcaaaaggaaactttagctctaaatttttataactaaaatctgcaattcttttctatccccccaaataacaatgttttaacaggaaactggctatttacataacgtgttcaatagcgtggaaaagcattttgtgtattttattatatgtttattgtttcagaagccaccataaagttgaccacctgccactgccaccccataaaagggaaaacgtctatgtgtagttctattggactcactgggaagccattagctgacccttcattatttttaggcttctgagctaaagtgggaggagaaaatgacgttagaatgcccgttcaccaaacagctactcagtggctgctgctgcagacaccaaggaggtcagcatggggcccacaaagagaaaggacacatccctcttcgtggtccagccaccaaggttttaccaccaccaggcagggccagacctggacatgcgtccccaataccccacctctgcccctgaccacccttgtccttcctggacacttctggacctgaggacagacatttccctcgactgcaaagatgaggcagaaatgacacctggaagcaggggacgagtgagtctctcacacttccctagagtagaagccacagaggtaccaaagtgagggcggagaaacaccaagtgccagcaaggagcggccaaacctctcacatgctgctggcgggagcagacagcgatgccaccaccctggaaaaccgattgccagccacgacaacagttgaacacaggcacactccgtgccccagcaattccactctcctaggcatacacccatccaaacaggcgcgtatgctcaccaaggccacgtacgagaatgtgtcggcagcactgactctaagacccgaaactggaaactaccctagtgccatcaacagcacactggtaggtaagtgcactcatacaagagagcactctacagcaataaacatgaatgaaccactcaacaatacagatggctcttcacaaacacactgttgaaagtgtaagagatcagacactaaataatacatgttgtatgaatccatttatataaagttcaaaagcaagaaaaattaatacaggatgctaaaaatcagaagaaaggttcacctttgggggcagtaagtagaagggagcacaagggggaccttgaggtgcaactgatgttctgcctttgggtgccggctacacagagacattcagtttgtaaaaaacatactgagctatacactcaactgtttgtgcagttctctgcatgtatgttagacttcaacaaaaagtgcaaaaaaaaataagggctgaggagagaaactgttgctaggagacaaagaaatgaagattctggctttggttattagcccttagagcttggagaactgtggatacacgctgaaagcccattaaatttttcaaggaatcttaggaccagagaaacaccaaacctggccatcagtggtctctggtactctgctaccaatctccagacctgtgcctgcaagacatggctgagaaaaagctgcaggcctggagaggggaccctgtccatctcagacatggccggggaaaatggtccagggagatctctatacagaccatgcccaccccatacacaggggagactcaaggctgtacccacttggggagggggtgggtgtacttcacgtgggcatgagcgttcccgaggtgcacgtgggtaagaatggactggatggccctcactggtcaatcactgtcctgcaaatcacgttctgcttccctctgtgaatcactgtccagcagaagcacaacacaagccttgggtgtactttacaatttcctcatagccacattaaaaagaatagaaagaaattaaatttaactatatatatatatatatatatatatatttttttttttttttttttttctgagacggagtcttgctctgtcacccaggctggagtgcagtggcgtgatctcagctcactgcaagctccgcctcccgggttcacgccattctcctgcctcagcctcccgagtagctgggactacaggcgcccgtcaccacgcccggctaatttttattgtattttttagtagaaacagagtttcaccatgttagccagaatggtctcgatctcctgacctcgtgatccgcctgccttggcctcccaaagtgctgggattataggtgtgagccaccgcgtccagcctaacaatatattttcttcaacccaatacattaaaaatattatcctttcaatgtgtaaacaacataaaaaatattcagatgttgtacattctttcatgcacctcaagtctttaaagtgcgtgtgtgatgtagtttggatatttgtccccgcccagatttcatgttgagatataatccctgatgctggaggtggggcctggtgggaggagtttggatcatgggggcagatccctcatggcttgatgccgtctttgtcatattgagttcttgcacgatctggtcatttaaaagtgtatggggcaggtgcagtggctcacacctgtaatcccagcactttgggaggccgaggcaggaggatcacttgaggtcaggagttcaagaccagcctggcaaacatggcaaaaccctgtctctactaaaaatacaaaaattagctgggcgtggtggtgggcgcctataatcccagctactcaggaggctgaggcaggagaatctcttgaaccggggaggcggaggttgcagtgagctgagatcttttgagactctgtctcaaaaaaaattgaaaataataataaaagtgtgtggcaggccaggcgtggtggctcacacctgtaatcccagcactttgggaggccgaggcaggtggatcacgaggtcaggagatcgagaccatcctggctaacatggtgaaaccccgtctctactaaaaaatacaaaaaaaaaaaaaaaaaattagccgggcgtggtggcgggcgcctgtagtcccagctacttgggaggctgaggcaggagaatggcgtgaacccgggaggtggagcttgcagtgagccaagatcacaccactgcactccagcctgggtgacagagcgaggctctgtctcaaaaaaaaaaaaaaaaaaaaagtgtgtggcacctctccgacccccgctcctgctctccccatggtatgcggttgctcctgctttgccttcctctgtgaataaaactccctgaggcctccccagaagcagatgccgctatgcttcctgcacagcctgcagaaccaagagtgaattaaacttcttttcttataaattacccagggtcaggtatttctttatagcgacacaagaagggcctaatacagtgggtgttttccacatacagcagcacatcgcaatcagcaccagccacacatcagtgctccggaaccagctggacagcacaactatgggaaggagtacctgctccccactactccacccctaagggctactgtgaatagctttggctgcaattctctctctccctccctctctttctctctccctccctctctctctgtctgtctcacacacacatacacacacacacatacatacacacacacacacacacacacacatgctgggacctagaataagctgttctatccctctagccacagaggtcaagtcaatgagagatctgccaggaatcttgcagaagaaacagacacttttcccattgggctgaaggtgagagaaaggatgtgaggtctggaattgtagcagctgcttgaggccatgaggtagaggctgtctaggaatggagccacagagagaggagaacagagcccaggaagaaaggaaaagcaatgtggttctgtggacatggctggaacctctgcatcaacagatatatcccctactcttggatttttcagtctcatgtgctaaaaaatttgcttgttcactacgcaaatttgggctgcactgatgtgatctgttattaaaatagtcccagataatacacctcattattctaattatctctgctttttttcccttctagcaactttaaagtttcatattgttgttgaattcttcttactgattcaagttactagtatgcttttaataacatgtctgaatatatctaagcctcaaaacactgcatttcttttgaagctacaatttcagttttaagggctcatcctacgaaaataaccagacaagtgtccaaaaatgtgtacacaagaccattcactatagcaaaaaaaaaaaaaaaaaaaaaaaaaaaacccacaaatgcacactgagaaataagtgggtgtccagtcctaaggagatagcttccctctggcacagagggccccccagtgggcagcgttctttgttccctgcgtggacagcaccctggtagggcagggaggccacaggctcactggagcacggtcacagaaggacgtgatgcaaagaaaaagagccggatgtggtggaaggaagggaacatgcagagagttaggcagggcatggggaggcagcatggggcccactctcccatgtcccagcagagaggaggaacgtctaggagggggagcgggggcagagcctgccaacctggactgctgtcagagcaaacctgtgccagagcaaacctggtggacactggtttagaggcattgaacatcccatttcccgggcaactctgactttccgaaggtgtgagtgggacccagaaaacctcacggctgcagttggggggtgagagtctgggaggtaacagctgggcaatgtggaggcgagacaaggggaccaccatgggaaggaggtgaggtggcccccaagggccagatgggggaatgtgtcaaacactcagaaatcctgcagaggaacccaggggaactgagtcagcgagggaaagtccctagaccataccccagcatgggagaacagatgacagcagtaagcaggtggagaaggagtgctgccttgggggtccatggcaccaaaggatgctgtgcccagagtctctgctcctcacccccagtgacatcagacagctacaccatccctgcttccagatgccattctgaagacgagcctgcagggcaggcagaggctgagaaatctgagaggctcagcactacctatacgggcacttctcaattagaagtgtgcataggaatcccatgggaatgccgttaaaatgcagatcctgctacaaaatatctgggggtggggcctgagaccctgcatttctaacagactcccaggagatgcagagactcctaatggatgggccacactcagagtagtaaggccctcagggacctctgtgaatgaaacagaattaaaacaaccctcccgctctcaagtagatgtaagattcatgcagaagacagactgattatacaaaaaaatagtattaataaggaagacagacgtaccctccacatctgagattagtgtgaatactgtactctgcaactccactacacctacttataatctaataaaaattctgaaggaaacatttataaggcataaagattaaaaatattaaattatatgcttaacatagcctggctaagtgcactctgggggttgaaggcaaggataaggccataaggaaaagagcagtgccttgatcttcctctataaatcaagtcacttagtcctagacaccatttgccttgttaggactgcaatggttctctgacttcacgaataagcggatcctgccttctacccccacatactgccaaacatgacgtttttaaggtttatttaattcatacatgttattatttagggcagattttggttcacagcaaaatggagcaaaaaagggcagaaagttgccatatactccccctctccccagaagcacagctttccccatcagagtggtgtatttctttttcttttctttctttctttttttctgagatggagttttgctcttgttgcccaggctggagtacagtggaacagtctcagctcactgcaatctacacattccaggttcaagcaattctcctgcctcagcctcccaagtagctgggattacaggtgcctgcaaccacaggcagctaatttttttttttttttttgtatttttagtagagatgggatttcaccatgttggccaggctggtctcgaactcctgacctcaggtgatctgcctgcttcagcctcccaaagtgctgagattacaggcgtgagccaccatacctggccagtacatttcttacaatcaatgaacctacacactgacacatcattatcacccaagtccatggtatacattagggttcactcttggtgttgtacattctgtgggtttggacaaatgtataacaacgtgtatccaccattgtagtatcttaagagacagtttcactgctctctgtgccccacctattcatctctccctcccccaaacctctggcaaccactgttctttttactgtctccacagtcttgctttatctggaatgtcatatcttgggaatcacagcagtgtgtagcctcttcagactggcttctttcccttagtaatattaatttaaagttccagatcttttcatagcttgatagctcatttctttttagtgcttagaagtattccactgtttggatatctcacagtttatttatcaatttacctacagaaggacatttccactgcttccaagttttggcaattatgaataatgatgctataaatatccaagtgcaggcttttgtagggccataagtttttaattcatttaggtaaataccaaggagtatgactgtaggctcatagggtaagagtatgtttcattttgtaagaagctgctcaactgccttccaaagtggctgtagtgtttagtgttcccaccaacaatgaatgagactccctgttgctccacctccacatcagcatttgatgctatcagtgttttggcttttagccattctaacaggtgtgcagtggtatctcactgttgttttaatttgcattttcctaatgatatatgatgttgaacatcttcatatgcttatttgacaactgtatatcttcagtgagatgtctgttcaggttgtttgcccattttttaatcaggttatttgttttcttattatcaaggtttaagagttatttgtatattttgaataaaagtccttgatcacatataacttctgcaaatattttctcctaggtttgtcttttcattctcttgacactgtctttagcaagacagaagtttctaattttaaggaagtccagcttaccaattttttctttcatgtattgtccctctggtgttgtatctaaaaaatccatcaccaaacctagggtcattaagatttccttctgtgtaatttatgaagagctgtataattttatgttttacacttaggtctatgatctattttaaagtgcatttttgggaagagtttgcgtgttggcctctagctgttccagccccatctgttgaacacactatccttttgcccttgaattgtttttgttccatgtttcagatattagctaactatattgtgtggtctaactagttagaaataaattgtctattatttaatcaagactacactatcctgattaagtaagtgttgaagtcgagtattgttagtcctctaatttggttgatctccttcgctattgtgtcaactattctgaatcttttgcttttccacataaatttcagaatcagtttattcaaatcctcaaaatcacttgctgagatttctgattattacattttttaaataactacaaaatgattgattttattagtttgttggaaactgcctatctggctatagtctacgtttcagctgttataaaatctgcaagtcctcatacaaaaactttcacactatgatgacacctcactgctgacagcctcctctgcagtcctggagctcctgcaggatacacgctgcatgcacaggtagacatgtgcaacccaggagggcagccagggttttcccaggatgtcaaagctcagaaggaaccaaaaattttaaagatttttaaaaatattttaattttttacaatataggttgaaagcaaatagctccttcaagagctagaacaactgaacttcacatctaataacaagaatgttcaattaaaacagaaagctaccctatggcccttccattcataatgcccatccatgagcctcagcatggactacaagtggatttaggggtccctttcaagatcttcaattgttcagagggcactccactgccctagcggaaggaataaatctgtcacaccacccacaacacagctagttctggagggccaggaccatggcccagaagcagtactgcatgaagattaaacttctcttccttttaagtgtcagatcccaaactgtcaacagtgtatacatgcattgtaacaaacacaaacactaccaacagaaaataatcattcacatgccataggtacatgcatgtgtacacacacacacgcacagactctcacacacatacttcatatttgcttgtcttttactgagaaaaaagggattataatatgcaaaaaacagattttttaaagtaatcatgataacagaaacactcagctaagatgctattctattcatttataaacaccttgcttcctaagggcctgccacaccttaacccatagaactcacttgtggaataaattctttactgaatgaaataagaacttaagtcacaaagtatctattgactatgatatggaaaaaagccttttaaaagcacgtattatcatatataaatacagaatatgaactaagggctacagcaggaaaacgttaactggttatgaattagaatttttatttgtctattgcttgcagggttttattgggcacctagcctgtttgaagcatgaaagctttaaccccaagactcaccctgcaagccaaaagcatactttgttggcaacattaaagcatttctggcttctggcctgggacatcagcaaaaaggcagagtaggcagctccaagggtccatcctccacaaaaccattgaaaattcaagcaaaaactgtcagaatcaactttgtcagaataatggaaacagtaaatggttcgcagcaaccaagcaaaaatggaatggagagaaaggtaaaataaaagcaggaggaaggccctgtggtgttttcatctacccaaatccaccctcctctccagctccacagtgcaggacctggcccctgtcttgaagacagcagcagcattcccagtgcaggacctggcccctggttcccgagggtgcagagcagacttgattcacaaagaattgtgtttgctctaacctgtctggaggctgctgaaggactgattcaaggggctcctctctgttctgtgtaactcagaatgcactcagggcagaaaagtggcaggcactcctggaaaacactagaaggcaaatgagcaacctgcagtccctgggacagaagattaccattgaggcacacggtagagtgccaaaaccatgaaaggaaaggctggggacagggtttaagaaattcaggcattcaacacaaggaactcaaacatctcaacagcaaagaacaaataatcccattaaaaagtgggcaaaggatctgaatagacatttttcaaaagaagacatacaaatggccaggagatatatgaaagaatgctcgacatccatcaccaatcatcagggaaatgcaaatcaaaaccacaatgatatataccatcccaacccagttgcaatggctattatcaaaaagacagaacgtaataaatgctggtgaggatggaaagggaactcttatacactgttggtgagaatgtaaattagtatagctgctaaggaaaatcgtatggagatttctcaaaaaagtaaaaacagaactaccatatgatccagcaatcccactgctggctgtttatccaaaggaaaggaaatcagtatgttgaagagatatccatactcccatgttcattacagcactattcacaatatctaagataggaaatcaacctcagtgtccatcaatggataaagaaattgataaaatgataaattgatacattgttaaagaaaatgggagacacacacacacaaacacacaatagagtactattcacactttaaaaagaaggaaatcctgccttttttaataacatggataagcctgaaagacatcacaccaagtgaaataagcaagccagagaatgataaataccatgcggtgtacgtatgatatactatttggccataagatagaatgaaaatggaatactatctggccataaaaaaagaaaaaaaagaatgaaatcctgtccgggcacagtggcgcacgcctgtaatcccagcactttgggaggccgaggtgggcagatcacttgaggtcaggagttgaagaccagcctggccaacatggtgaaaccccatctccactaaagacataaaaattagcctggcgtggtggcgtgcgcctgtaatccagctactcaggaggcagaggcaagagaatcgcttggacctgggaggcagaggttgcagtgagccaagattgtacatctgcgctccagcctgggcggcagagcgagactctgcctcaaaacaaacaaacaaacaaaaagaatgaaatcctgtcatttacggcaacacagatcagcctgaaggatattatgttaagcaaagtaagtcaggcactggaagacaaataccacatgatctcaaccatatgtgatggctgaaaaaaaatgagctcatggatatagaaaattagaattgtgggtgcagagtctgggaagggtaccagtgaggggaggatgatgagaggttggttaatggatacaaagttgcagctagataggaagcatgaattctggtgttctatagcactatagggtgaatatggttaactacaatttattatatattctcaaaaagctagaatagaggattttcaatgttcacaacacaaagaaatgaggtgatggatatgctaattatcctgattcgatcattacacattgtatacacatattgaaatatcactctgtatcccataaatatgtacagttattatttgacaactaaaaataaaagggaaaaagaaattcaagcattccaaagcacctatgcatatgggtgggaatgtagacagccatgtgaatgcccagagcagaacgcatgctcagaagaagcctgagaagaccccagtctttcacctctggatgagctccaggttcagtataaacaagaaatgaaggtcaaggcatagctgtaaaaagccaggctaagtgttaaaggaggactccaccacagagccactccatacagataagcggtcagtctcttctctctctgtttttctctgcctctctctccaaccccctcgctctctctatcatgttttggcatctggtgctcaaggaaatctctttgacagcactagctgaacaaacaactaaacagagacttcagagaccacacacggtaaggaattacagatcttgcaaaactctacagtctatagcaagcaacaacaaaccctgaggtgggggaagaatctgatctccagagttacctctgtttaatatgcaaaatgtccaggcgtttgttcgtttgttttgagacagggtctcactctgtcacccagggtggagtgcagtggctcgatctcagctcactgcaacctccacctcctggattcaactaattatcctgcctcagcctccagagcagctgggattacaggcatgcaccaccacacctggctaatttttctatttttagtagagacgggattttgccatgttggccaggctggtctcaaactcctgacctcaagtgatctgcccaccttaacctcctaaactgctacaattacaagtgtgagccaccatgcctggcatgttcagttttcaacaataacttatgaaccatgtaaagaaacaagaaaatatggctcattcacataagaaattaacaaacattgtccctgaagaaacacacacactggacttactaaagactttaaatcaactgccctaaatatgctaaatgacttaaaggaaagaaaggaaaaggagctaaaggaaatcaggataagaatgtatgaacaaataagtgaattgaaataaagatatagaaattataaaagggagtcaaattctaaggtcaaaaagtacaccaactgaatttttttaaaaatcactagagcatctcagtaacagacttgactaggcagaagaaagaacccgcgaacataaagacagggcaatgaaaattatccagtctgagaggaagaacaaaaatgataaaagattaacaggtatgaaatgccatcaagcataccaataccaagtacataacaggaatcccagaaggagaggtgcgagtgaaaggaacacaaagaatatttggagaaataattgccaaaacttaccatacctgataaaagatacaaatctacacacacaagaagttcagtgagtttcaagtgagatgaatacaaagaaatccacactgagacacattataatcaaacagtcaaaaagccaagggcaaagagaaaaatcttgaaatcagcgagagaggagccactgattcacatacaagggatcctcaatcagattaacagctgacttctcatcagagaccaggggaccagaaggcaatgaaatgacattttaaagtgatgggcaggatgggggtgatgcttccaaccaagcattgtatgatacatcctacaaaaatacccttgaaaaatgaaggagaaatttacacccacatattgaatggctccaattgtataaaatatcagaaacaggtaacaatccacagggacataattcagactgatggcttccaggggctaggagaggggaaatagggagaaacaatttaatgagtatgggatttcctctggagacaatgaaaataattttggacttttatagagggagtggttacacaacggtgtgaatgtactaaacgtcaaagaattattcacacaaaaattattactgttaagttaatttcacctcagtaaagaaaaataaaacatgggaaaaactggcttctgacaaactgatcaaagttctgaatcacaggcagtagcagaagcagcatggattaccctgagatctcttccttccttccttacctgcctggccgagagaaatatggagcgagggtactgatttaagataatatgctaactgggtgcttgtagcaatatcaaaaggtaatgtaatatagactaaaccatatggaaccatgaactgccaaggacatgagttacctgccaaagtaagacgttgcccttgggtgcagacagaaaacatggtggggtgatctttatcaacagtcagcaacaggataaaattccatgtgtaaaggccacctgaactttgattctgtatgtgcgtattttacaagaatgtaagagcagtccaaaaactattttaattgaattcattctatacataggtgcatcccaatgccaattactggcatcaattctaaaccaataaataagaacatatgtattttacgcacaaaatgtcatgtctctctggatatcccatgcacaaccccaacagtacccgtccatcagagcctgcagctctatgaaggagaacttaacagcactctaggtgaacacgcccctgcctgatgccgtccacaaagctaggcacatttgcacgtctgggtaccatcgctcagctacacaaccacaggccatgacggcgcagttcttccaactaggctgtgctgacacaggtctcgagatggctgatgcttttgatgcatcctgaagttttgctacaaagatcaccacaaaaatgttcaagcatcaaaatgttttaattcttctgaaatgaaactgtctctaaatagctcagcaataaaattcaataattctattgggttcaaagcagtttaacaatggaaaatgaattatatagtcaaaggtggtccattctcgctctccagtaaacatttctgtatgtgcggaattggtgggttctcggtctcactgacttcaagaatgaagccgtggacccccggtgaattttacacttcttaaaggccggtgcatctggagtcgttagttccttgtggtgttcggacatgttgggagtttcttccttctctcccaatgggtttatggtctctctggcctcagaagcaaagctgcagaacttcgctgtgagtattacagctcttgaaggtaatacagagcctaagagtgagcagtggcaagatttaccgcaaagagcgaaagaacaaaacctccacaacatggaagagaacccaaacagtttgcggctgctggctccggcagcctgcttttattcccttgtctgaccccacccacattctgctgattggcccattttacagagagctgactggtccattttacagagagctgattggtccgttttacagagagctaattggtctgttttgacagggtgctgattggtgcgtttacaatcgctgacctagacacagagtgctgattggtgtatttacaatcctctagctaggtgtaaaagttctccaagtccccactagattagctagacacagagcactgattggtgcatttacaaaccttgagctagacacagagtgctgactggtgcatatacaatcctccagctagacataaaagttctccaagtccccacctgactcaggagcccagctggcttccgctagtggatcccgtgccagggccgaaggggagctgcctgccagtcccactccaggcgcctgctctcctcagcccttgggggtctatgggactggacgcctatggagcagggggtgatgcccctctgggaggctcaggcaggaggctcgggcagcacgggagcccactgcagggggcagcatggcgggctgcagatccccagccctgacccgtggggaggcggctgaggccccgcgagaattcgagtgtggcacaggcgggccagcagtgctaggagacccagcgccccctccacagctggtggcccaggtactaagcccctcactgcccagggccagtggcaccagttggccactccgagtgtggggccgctgcctgcacccacccagatcttgggctagcccacgagccctgtgcacagccctggttcctgcccgcacccctccctccacacctccccgtaagcagagggagctggctcctgcctcggccagcccagagtggggctcctacagtgcagcagggggctgaagggctcctcaagcgtggccaaagcagacatcgaggcccaggaggtgcagagagtgagcgagcgagcactgctagcacattgtcacctctcatctagacttgttgagtgtgagtacctgccctttctggaacaaaccatcaattcttttgctccctacaattttaagttccaatctggtgagccctagggtccctaggtttcatattgtagaaggctttaaatctaaagagtccttggataaatggaagggcaaagtaaatctcaggaagtttcacacagtagctatctgactgcattcaagaaagaaatctctgtattttccttcaacttctctcacacagcccaaagttgttgggagaaggtaaaggaaaaaacatgaagatttatttcatggagatagccagcataggggaaattatttaccttttcgacttagaacaactagaaaacaagtttccaatcatggtcatctcctgcctcacagtagacattaaagttaagttagagaattcacaaccacacccttctgattgacactatacatatcaatctcgttactcaactgaggggaaaaaactatttccatcagctagaccttttcctgcactccatgaaaagctcaaacactcaggatgtcaaacttaacttttttgcaatcacacagcaaggcccaatctgtcaaagccatacgattcactgcctttatttctactgttggtttgatttttttttttttctagcttgtgggtttcagggcagacaaaggcagctaaaagtctcagggagaaaaagaatctccagtaggctgtaccatagacatccccatttattgcatgtaacttacttcacttctcaaccccacagtttaatcacctgtataaaactggcgcagtaatactcagactgcaaagtcattgtaagaattagcagtagcatgaggaaaacatcagctcatgttaggaatgcactgattattacctggcattatttagattgattaataagttcatatatgcatagtgggaaacaccttggtctaacattctttggttctaattatgattacgatatcatgtgatttccatgtgttagagagcaagtcataattatcaccattgtaaaaggagaagtacattctacatcagattgacaaattgtgttctataaaactctaagaagccaggcagatacctcaagagccatgaggactcaataggaaggttgctaaattctatgagctatcggttatgaccttcaagtgttaaacatattaatatagaggtataacttttcccgataggaaataaaaggcaattactattttaacatgctgccaaacacactgcctattgttaaaataattgttaaaatttttattgaggctgggcacggtggctcatgcctgtaatcccagcactttgggaggccaaagcaggtagatcacctgaggtcaggagttcgagaccagcctggccaacatggtgaaaccccgtctctactaaaaatacaaaaattagccaggcgtggtggcgggcacctgtaatcccagctattcaggaggttgaggcaggagaatcgcttgaaccctggaagcggaggttgcagtgagctgagatcacgccactgcactccagctggggcgacagagtgagactccgtctccaaaaaaaaaaagtttttgttgaaataaattattttaaataacagtgacttcagttaaaatcctaattagtgaacttattagtaattcaataatagtatttccaatgcttccctgacaacccttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgacaactctttttacctcataaagagaagctatgtaaatcctgaggcaaacagcacgcttaatgctgagcatttaaaagcattctcaggcagaaggatcacttgagcccagtaattcaaggctgcagtgagctatgataacaccactgcactccagccagtgtgcagagtaagatcctgtctctaaaaataaataaatagttcagatagaaataaacagaatatagatagatagacagatagagataataaaagcattcctggctaggcatggtggctcaggcctgtaatcccagcactttcggaggctgaggtgggcgaatcacctgaggtcaggagttccaagaccagcctggccaatatggtgaaacctcatctctactaaaaatacaaaaaattagccagggtggtggctcacacccgtaatcccaggtactcgggaggctgaggcaggagagttgcttgaacccaggaggcagaggttgcagagagccaagatcacaccactgtactccagcctggccaatagagtgagactccatctcaaaaaatttaaagaaagcattcccaatgaagacacagcaaaaatgctctccttcactattactattcaatatttaatgggaattcccagccagcacaattaagaaaataagtaacaaggatcgaaaagagacaatattatcattctttactgacagaatgattacatataaaattcaaaaacatatacaaagtatcagacctaatacgagtttggaaagactataggaaaaaaaaaaactttaaaaacgctttccaatatttcaataacaatcaattaaaaaccatttttagaattagcaataaactccaccaggtacctagaaaaaaactaagacacaagaactttatacacataaaattgtgccaaaatacgttaaaatgtattcaactcttccagctttattgtggtataagtgacaaataaaaattgtatatattttaggtgaacaacataagttgatacacatattcactgtaaaatgattaccacaatcaggccaattaacatatccatcacctcacatagttaccatttttatccttgtggtaagaatatttaaaatctactctcttagcaaatttcaagtatacaaaacattattattttagttatagccacattaggtctccaaaactaactcatcgtgtaactgaaagtttgttcgctttgaccaacacctacccatttcccacaggcccagcccctgcaaccatcattctcctctctgtttctatgagccacgtttttagattccacatataagtgagaccatgtggtatttatcattccctggcttgcttatttcacttagtgtaatgtcctccaggcttatccatgttgttcaaaaaggcaggatttcctttctttgaaggctggctaatactcctctgcctgtgtgtttgtgtgcatgtgtgtgtgtgtctggatgtgtgtttgtatgtgtgtcacattttatcagtttatccactgatggacattaggttgttcccattatcttggctattgtgactaatgctgcagtgtacatgggggtgtagatttatctttaaaacactgatttcaattactttggatatatacccagaagtagaattgttggatcatatggttgttctataattttttgaggaacctctatactgtttaccacaatggcagtaccaatttacattcccagcatcaatatataagggttcccttttctccacaacctcaccaactcttgttatctgttggtactttgagaatagccattctaacaggtgggagatcacatctcattgtagttttgatttgtatttccctgatgattgatgatgttgagcactttttcacatacttgttgccatttgtatgtcttctgtgagttgcctttacatttcattgtttcctttgctctaaagaaatattttagtatggtgtagtccaattatttgtttttacttttgttgcttctgtttttggtgtaatattcaaaacatcactgctaagatccatcttattgagctttctatgttttcttctaggagttttgtggcttcaggcctttcctttaaatctttaaacaattttaacttgatttttgtgtacagtgtcagataactctccaattttgtttcctttcatattttttctttttttgcatgaggatatccagttttcctaacaccattaattgaaaacaatgatccttttcccattgtgtattcatggcacctttgtcaaagattagttgaccatatatgcatgggtttatttatgggctttctattctgttccattggtctatgtgtctgtttttatgccagtagcatgtttttttggctactatagctttgtaatataatttaaaatcaggagatgtgatgacttcagttttgttcttcctgttaaaaattgcttgggctattcggggtcttttgtggttccctatgaattttaggattgttttttctatttctgtgaaaaatgccaatgaaattttgatagactgcattgaatctgtagatcactttgggtattatgaatatttttataatattgattattctgatccatgaacatgggatatcttcccatttgtgtatcattccatttcttttatcaatgtttcatagtttttggtgtatagatcttgcatctccttatttaagcttatttatgttattatttttgatgctattgtaaatcagactgatttcttaatttctttttctaatactgtacactaatgtgttattagtgtacagaaacacaactgctttttatatcctgcaactttactaaattcatttatagttctaattagttttggggtggtgtctttaggaatttctattacaagatcacatctcctgcaatcagaaacaatttcctccttcccaatttggatgactaataaaataaataaataaaataaaataaaataataaaattatttttactgcctaattgctttgactaggatttccactactactttaaataaaagtggtgagagtgggcatccttgtcttcttcctgattttagagaaaaagctctcaaccatttatggttgactatgatggtagcttgtgaaatatgacctttattgtgttgaggcatattatttctatacctaaatttgtttagagtttttgtcataaaagattgttgaattttgtcaaatgttggtttaaatatttgagataatcatataatttttgtccttcattctttctgttaatgtgttgtaccacacttattgattatattgaactatctttgtatcccagggataaatcccacttatttgtttaatatgctattgaattcagttttctagtattgtgctaaagatttctacacatatattcatcagggatattggcttgtaattttctttccttgtagaatttttgcctggctttgctatcagggtaatgctagcctcataaaacaagttggaagatgttccttcttgctatggtttgaatatgccctccaaagttaatgtgttagaaacttaatccccaatgcaacagtattaggaagtagggcctaatgggaggtgcttaggtcatgagggttccatccttatcaatgcattaatgctgattataaaagggcttgaagctgtgagttccatctcttgctctctcgcactctttttctcttctgccttctgctatgcaatgacatagcaagaggatcctcaccagatgtgggccctagatcttggacttccccgtctccaaaactgtaagaaattaatttattttctatgtaagttaccaagtctgtggtattttgttacagcaacacaaaatagactaagacattttctcttcaattttttttggaagcgtttgagaagcactggtattaattcttctttaaatgcttggtagaattcatcagtgaagccatcggatcctggacttttctttgatagaaagatttttgttactgattcaaacttcttactcattattagcctgttaagacttctttttcttcacgattaaatccaagacttctttttcttcatgattaagtctttgtaggttgtgtgtttctaggaatttatccattacttctgggctaatttattggcatataagtgtttgtagtactctcttaggatcctttgtaatcctgtggtatcaattgtaatgtcttccctttcatttctgattttattttagtcttcttttttcttaatctaattaacagtatgtcaatttcatttatcttttcaaaaaaccaactcttagttttgctgatcttttctattatttttctaagttctatttcatgtatttgttctctgatctttactatatccttccttctgctaactttagtttgttcttctttttctagtttctcaatatgtaatgataggttgtttatttgagatctttcatttttcttcatgtaggcatttttcactataaactttcctcttaaaactacttttgctgcatcacctatgataagatttggctctgtgtccccatgcaaatcttatctcaaattgtaatccccatgtgttgagggagggaactggtgggaagtgactggatcacagaggtggtttgccccatgcttttctcgtgttagtgactgagttctcatgacagctgatggcttttaagtgtggcacttcctcactctctcctgctgccttatgaagatgtgccttgtttccccttcaccttctgctatgatcgttaagtttcttgaggcctccccagccatgtggaactgtgagtcaattaaacctcttttctttataaattatccagtctcagtatctttataacagtgtgagaatggactgatatacccaaagttttggtacactgtgttttcattttcatttgtctcaagatattttttaattttcctactgatttcttctgctccattggttgggagtatgttgtttgatttccacatatttgtaattttcccaattcccttccattagttatttctagtttcatgatactatgatcagaaagaaatattacataatttgatatataattaaaatataatttcaatctgcttaaatacattaagacttgttttgtggcccaacgtataacctatcctgaagaatgttccatgtatactttagaagaatctgtactctgctgctgttgaatagaatgttctgtatttctgtatatatctgttaggtctacttggtataaagtgtaaaatctaatgtttccttactgattttctctctggatatcctgtctgtagttgaaagttaggtaatgaggtccctcattattactgtattgctgtctatttctcctttcagatctattaatatttgctgtatattatttacgtggtctgatgttgggtacatatatgattattgtgtcctcttaatgaattgatccctttttcattacataatgacctttttgatctcttttaaagttttgtagtcaaactatattttgtctgatataaatatagctacccctgctctcttttggtttccatttgcaagaagtatcttaattccttcacattcggtttatgtatgtctttaaagttgaagtgattttcttacggcagcatatagttgagtcttgtttttaaatctattcagccaatctgtcttttgactggataatttaatgcatttacattcaaggtaattattgataagaactttcaattgtcattttgttaatttgtttctgggtgttttgaggatgccttgatcctttcttcctctcttgctgtcttcctttgtgacttgacaattttctgtagcagtatgctttgattcctttctcttcatcttttctgtatctactatatgtttttgctttgccattaccatgaggcttacataaagcatattatagttataacagtttaagctgataaaaacttgtttgtttgttttgagacagaggcttgctctgttgcccaggctggagtgcagtggcgtgatcataactcactgcagcttctaactccttgagagatgatcctctcacccaagcctcctgggtacctaggactacaggtgcacacactaggctaattttttttttttttttagaaatgaggtctcactatgttgcccaggctgatgtcaaacacctaggctcaagcaatcctcttgctttgtcctctcaaagtgctgagattacaagtgtgagccaccatgcccagtcaaaaacttaactttgataacatacaaaaactctacactactttctgatagtgaagtgtaagtaaattcttcctaattggtaattacatattgtgtaaatgaactaaactctctaagagaaaggcagagattggcagaataaattagaaacttgtggaactgtatgctgtctacaagagactcactttagattaaaagacaaaaacaggttgaaagtaaaaggaaagaaaaggatatttcatgtgaacagaaaccaaaatagagctggagtgtatacactaatatcagatgaaatacactttaagataaaaattgctactaaaaacaaagcagcacaatatacactaataaaaaggtcaagtcattaagaaaatactgcaattataaatataccacacctaccaacagagtcctaaaaatacctgaagcaaaaaattgacagaattgaaatacaaaatagggaattcaacaataatagttggagaattaaatacctcaatttcaataatgaatagaacaaatagaataacagcaaggaaacagaagacttgaacaacactataaaccaatcaacttgacatctatagaacactcaacccaacagcagcagaatacacattcttctcaagcatacatggaacattttcctgatgaaacatatattgggccaaaaaacaagtctctgtaaatctttaaagattcaaataatgcaaaacatgttctctgatcacaaaagaataaattaagaaatcaatcacaaaaggaaaactggaaattcacaaatacatgcaaattaacaacacattccattggccaatgggtcaaagaagaatttacaagagaacttagaaaatactttgagataaaataaaaataaaatacaatatactaaagcttaatctttcatatcagagtttaatccatttgaataaaagcagtgctcagagggaaatttatatctgtaaatgccttcactaataaaataaaaaactctcaaatcaataatctaaccttccaccataagaaacttaaaaaagagcaaattaaatctaaatcaaacacatacaaaaaagagattggagccaaacagagaacagaaaaacaacatagaaaatcaacaaaaccaaagttggttctttgaaaagatcaacaatattgacaaactttagctaggctgagcaaagaaaaaatagaagactccaattactaaaatcaggaatgaaagagagaatatcataattctaagaaaattctatgaaagctggataccatcaaattagataccctagatgaaatggacaaattcttagaaacacacgatctaccaaaattgactcaagaagaaacagacctgtagctaataaagaaatgagtcaacttttctaaaaaaaaatctttcaatgaggaaagcctcgaccagatggtttcattggggtattctacaaaatgtttaaagaaaaattaacaacattatttctcaaactcttacaaagagtagaagagaagggaatacttcgtaattcattctgtggaagtgaaacacatcaaaagtaaaaactacagatcaataaccgttgtgactacagatgcaaacattctcaacaaaacattagcaaatggaatctaacagcatatgaaaggggttattcaccatgaccaagtagagtttatcccagaaatgtgaggttggtccaacatataaaaatttatcaacataataaagcatattagcataaacccacatgatcatctcaatagatgcagaaaaagtatttgacaaattccaacatcttttcatgataaaaattctcaacaaattagaaacagaaaagaaaatttcttaacctgataaagggcatccatgaaaaaccaatagctaacatcatacttaacagggaaagactgaaagctttgctcctaagatcaggaagaagacaaggatgtctacctctcaccacttctattcaacattttactggaggttatagccagggcaaaaaagaatgctgtaggcaagaagatgaaataaaatgcatccatactgaaaaggaagaagtaaaagtatctctgttcacagatgacctaattttatatagagaaaaccctaaataataaacacacatacatattaaagctaataaatttggcaaggtgacacgatataagttcaatgtataaaaatcagttgtatttgtatacacacaatgaaaaattttaaaatgaaatgaaaaagacaattccatcaacaataccagtaaaaagaataaaatattcagaaaaaatctaactaaagaagtgcaagacatatacactgaaaaccataaaacattgctgaagtaaattaaagactgaaataaatgaaaatatatctaatgttaatggacagatcaaagcaattcctatcaaaaatctcatcgagaatttttttttgcaaggatcaacaaactaatcctacaattcatatggaaattcctgaaacccagacaagtcaaaacaatcttgaaaaagaacaaagtgagaggaatcacactttctgatttccaaatttactacaatgctacagtaatcaagacagtgtgatactggtataagacagtcaaatagatcagtgaaacagatctatggccaagtaactttcaacaagagtgccaagaccattcaataaggaaagaataattttctcaagaaatggttctaaaactagatatccacatacaaaggaatgaagttggaccccaccttataccatatacaaaaattaatgcaaaatgaatcaaaggcctaaatgtaagggctataactaaaaatcctagaaaaaaaaagcatagatataaatctgtgcaactttgagttaaggaaaagttttttggaaaggacactgaaagcatgtgtgaccaaagaaaaaatagatgaattgaacctcatcgatatttaaaacttttatgtttcaatcagccctatccacaaaatgaaaagacaacccatagaatgagggaagacatttacaaatcatatgtctgataaaggtctagtaaccagcatatataaaggactcctagcattcaacgacaagaagtcaaataactcaactaggaaaagggctaaggatttgaacaaaaatttctcgtaagaagatatacaaatggccaataaatgcatgaaaagatctttagggaagttcaatatcattggccattagaaaaatacagatcaaaaccacaatgacataccaatttcatacccactaggatggctagaataaagggggaaaaaaaaaccagaaaataagtgttggcaagaatatgaagaaactggaactcatacgttgctgataggaatgtaaaatgttgcagctgctttggaaaacagtctggtagttaaacactgaattaccgtgtgactctgtaattctacccttacatatatacctaacagtattgaaaagatatgttcacacaaaatccagtacactaaatgttcacagcggcaatcataatagtctaaaagtggaaagaaaccaaatgttcatcaattgataaatggttaaacaaaatgtggtatatacatatggaatgtcattttccacaaaaaggaagtgctattgcatgctataacatggatgaaccttgtaaacattatgctaagtaaaagaagccaaatacaaaaggccacatattgtatgattccagttatgtgaaatgtccagaagaggcaaaatcatagaaacagatagtagatttgaggtgccaagggttagaggattggggaattggaggtgactgctaacagttatgagatttctttttggggtgatggaaatgttccggaattacgtcatgatgatttaacataacactgtgactatactaaaaaaacactaacctgtacacttcaaaatggtgacttgcatgttatgtgaataatacctcaataattaaaagaagtaaggataataaaatcatcttaatcagccagctatgctagagcaagtaaagctaaatatctttttaggatctagagaaaataaaattataaaattatcatactaatagacaattaatgaatatgcagcaaaaaactattacaaagatgggtcatgcaattctttaacttgtaaatgttatttttctcaactgtgtggtatatttcatgcatttaaagcatttttaagtttataattcattgtgatttgttttttcattccaaataaatatccactgtcatgactaaatttgtatttacaattttgtattctttctgttaaaagaactgagatgggccctacaaaacttgaatcctccactggagataccttttcacaaccatcacagtagctaaaattaaaaagtctaataatacttggtattggagagaaagtagacgaatgttaactctccttggccctactaggagtacagattgatttaaacaatttgaagagcagtttgacgattatagtgacattaaggtgccccaggaattctacttctagagacaggctctaccaacatgtttctacctatgcacccctgcagcatgttgtaaaggcagaacaccagaaacaggctaaacggtcagcaacaacacaacacagaagattgggatatgttctcagaagggcactctatagaggagttaaatgactttatgcagatcaacccacatggaagtggaaaacaataccaactgtgaaaagcaagtttcagaatgacatcacagttaaaaccatttgtgtgatgttttgaaacatgcacacaagtactacatattgattccagaaacaaagaaatgaagtaaaagagaaattcctctttgtttacagaggaaatagacaggttggaaaaggacacgagagactgtaacttgatctgtgatattttgagacaccatgaagaagaactgaagcgtgtgtttccaagtttaggcatccatgaattctgcctcgtgcttttatacttaggattcttaggctcactctctgaccttttctatttgaagctggattcagactatttacctgagtggaggaaatacttgaatcttaaagatcaaactcaccaacaaagaagtggggaaagcagtcatgagtaattcatgaaatgctaagtaaaataataatgcattcataacatttttcatctatcaaactagaagctctggtgtcttccatgatgatacccagggctggcactgtcatgttaggtcattagaaagccttgaaaacatatttatccctttgcagaagcaggtctgttctcataaggagattcttctgaagttgtgcaaagattttgatacaaggatgtacaatgccaagtcaccttgtagatgacaagagaaaaaggagaaaaaatgtccaacaactgtttgttaaattggaatatcttatacaaaccataaacatagagtggatacttataaagacaataaaaaaggcatggagaatgtttaagtgtttagaaaacatgctccccctgggcagagcccaccccagtgccacaaagccactgtagccagactgcctctctaggttcctcgtctgtgggcaaggcatctcggaaagaaaaacagcagcacccgtcaggggcttatggataaaactcccatctcccttggacagagcacctgggggatgggacagctatgggcgcagcttcagcagacttaaatattcctgcctgctggctctgaagacagcagtggatctctcagcacagtgctcgagctctgctaagggacagattgcctcctctagtgggtccctgaccccagtgcctcctgatggggagacacctcccagcaggggttgacagacacctcacacaggagagctctggctggcatctggcaggtgcccctctgagatgaagcttccagaggaaggagcaggcagcaatctttgctgttcagcagcctccgctggtgatacccaggcaaacagggtctggagtggacctccagcaaactccagaagacctgaagatgaggggcctgatgaccgttagaaggaaaactaacaaacagaaagcaatagcatcgacatcaacaaaaaggatgaccaagcaaaaacaccatccgagggtcaccaacagcaaagaccaaaggtagataaatccatgaagatgcagaaaaaccagagaaaaaaggctgaaaattccaaaaaccagaatgccccttctcctccaaaggatcacaactccttgccaacaagaaaacaaaactggacagagaatgagtttgatgaactgacggaagtaggcttcagaaaatgggtaataacaaactcctcctagctaaggaagcatgttctcatccaatgcaaggacgctaagagccttgaaaaaggttagaggaattgctaaccagaatagccagcttagagaagaacataaatgacctgatggagctgaaaaacacaacacgagaacttcgtgaagcatacacaagtatcagtagcccaatctatcaagcaaaagaaaggataccagagattgaagattaacttaatgaaataaagtgtgaagacaagattagagaaaaaagaatgaaaaggagcaaagcctccaagaaatatgggactatgtgaaaagaccaaacctacgattgattggtgtacctaaaagtgatggggagaatggaaccaagttggaaaacacacttcaggatatcatccaggagaatttcaccaacctagcaagacaagccaacattcaaattcaggaactagagagaacatcacaaagatactcctcgagaagagcaaccccaagacacataatcatcagattcaccaagattgaaatgaaggaaaaaatgttaagggcagccagagagaaaggtcgagttacccacaaagggaagcccatcagactaacagcagatctctctgcagaaaccctacaagccagaagagagtaggggccaatattcaatgttcttaaagaacagaattttcaacccagaatttcatatccagccaaactaagcttcataagtgaagttcaatagaatcctttacagacaagcaaatgctgagggattttgtcaccaccaggcctgccttacaagacctcctgaaggaagcactaaatatggaaaggaaaaaccagtacagccactgcaaaaacaaaccaaaatgtaaagactatcaacactatgaagaaactgcatcaacaatgggcaaaataaccagctaggatcttaatgacaggatcaaattcccacataataatattaaccttaaatgtaaatgggctgaatgcccccaattaaaaggcaaacactggcaaactggataaagagtcaagacccatccatgtgctgtatttaggagacccatctcacatgcaaagacacactaggctcaaaataaagggacggaggaagatttaccaagcaaatggaaagcaaaaaaaaagcaggggttgcaatcctagtctctgataaaacagactttaaaccaacaaaaatcaaaaaagacaaacaagaggattacataatggtaaaagaatcaatgcaacaagaagagctaactatcctaaatatagatgcacacaatacaggagcacccagattcataaagcaagttcttagagacctagaaagaggcttagattcccatgcagtaatagtgggagaatttaacaccccactgttgatattagacagatcaatgagacagaaaattaacaaggatattcaggacttgaactcagctctgcaccaagcagacctaatagacatctacagaactctccaccccaaatcaacagagtatacattcttcccaggactacatagcacttattctaaaattgaccacataattggaagtaaaacactcctcagcaaatgccaaagaacagaaatcataacggtcactcagaccacagtgcaatccaattagaacttaggattaagaaactcactcaaaactgcacaactacatggaaactgaacaacctgctactgaatgaccactgggtaaataacgaaattaaggcagaaataaataaattatttgaaaccaatgagaacaaagacacaacgtaccagaatctctgggacagctaaagtagtgtttagagggaaatttatagcactaaaatgcccacaggagaaagtgggaaagatctaaaatcaacaccctaacatcacaatgaaaagaactagagaagcaagagcaaataaattcaaaagctagcagaagacaagaaataactaagaccaaagcagaactgaaggagatagagacatgaaaaacccttcaaaaaatcagtgaatccaggagcagattttttgaaaagattaataaaataggccgctagccagactaataaagaggaaaagagagaaaactcaaatagacacaataaaaaatgataaaggggagattaccactgaccccacagaaacaaaaactacaatcacagaatactataaacacctctatgcgaataagctagaaaatctagaggaaatggataaattcctggacacatacaccctcccaagactaaaccaggaagaagtcaaatccctgaatagaccaataacaagttctgaaattgaagcagtaattaatagcctaccaaccaaaaaaagcccaggaccagatggatttacagccgaattctaccagaggcacaaagaggagctggtactgttccttctgaaactattccaaacaacagaaaaagagggactcctccctaactcattttatgaggccagcatcatcctgataccaaaacctggcagagacacaacaagaaaagaaaatttcaggccaacatccctgatgaacaccaatgcgaaaatcctcagtaaaatactggcaaaccaaaccagcagcacattaaaaagcttatccaccacaatcaagtcggcttcatccctgggatgcaaggctggttcaatatacacaaatcaataaatgtaatgtatcacaaataaacagaagcaatgacaaaaacgacatgattatctcaatagatgcagaaaaaggtcttcgataaaattcaacaccccttcatgctaaaaactgtcaataaactaggtattgatggaacatatctcaagataataagagctatttatgacaaacccacagccaatatcatactgactgggcaaaagccggaagcattccctttgaaaccagcacaagataaggatgccctctctcaccactcctattcaacagagtactggaagtcctggccagggcaatgaggcaagagaaagaaataaagggtattcaagtaggaaaagaggaagtcaaattatctctctttgcaggtgacatgattgtatatttagaaaacctcatcatctcagcccaaaaactccttaagctgataagtaacttcagcaaagtctcaggatacaaaatcaatatgcaaaaattacatgcattcctatacaccaataatagacaaacagagagccaaatcatgagcaaactcccattcacaattgctacaaagagaataaaatacctaggaatacaacttacaagggatgtgaaggacctcttcaaggagaactacaaaccactgctcaaggaaataagagaggacacaaacaaatagaaaaacattccacattcatggacagggagaatcaatatcatgaaaatggccattttgcccaaagtaatttatagattcaatgctattcccatcaagctaccattgactttcttcacaaaattagaaaaaaattactttaaatttcatatggaaccaaaaaagagcctgtatagccaagactatcccaggcaaaaagaacaaagctggagggcatcacgctacctgacttcaaactatactacaagactacagtaaccaaaacagcatggtactggtaccaaaacagacatacaggccaatggaacagaacagaggcctcagaaatgacaccacacaactacaaccaaatgatctttgacaaacctgacaaaaataagcaatggggaaaggattccatatttagtaaatggtgttgggaaaactggctagcatatgcagaaaactgaaactggaccccttccttacatcttatacaaaaatcaactcaagacggattaaagattttaacgtaagacctaaaaccataaaaaccctagaataaaacctaggcaataccattcagaacacaggcatgagcaaagacttcatgactaaaacaccaaaagcaatggcaacaaaagccaaaattgacaaatggaatctaattaaactaaagagcttctgcacagcaaaagaaactatgatcagagtgaacaggcaacctacaaaatggaggaaaatttttgcaatctattcatctgacaaaggggtaatatccagaatctacaaggaacttaaatttacaacaaaaaacaaacaactccatcaaaaagtgggtgaaggatatgaacagatacttttcaaaagaagacatttatgtagccagcaaacacatgaaaacaaactcattatcactggtcattagagaaatgcaaataagaaccacgatgagatgccatctcatgccagttagaatggcgatcattaaaaagtcaggaaacaaaagatgctggagaggatgtggagcaacaggaacgcttttacaccattggtgggagtataaattagttcctccattgtggaagacagtgtggcgactgctcaaggatctagaactagaaatactatttgaactagcaatcccattactgggtatatacccaaaggattataaatcattctactataaagacacatgcacatgtatgtttattgcagcactattcacaatagcaaagacttggaaccaacccaaatgcccatcaatgttagactggataaaaatgtggcacatatacacctgtaatccagtactttgggaggccgaggcgggcggatcacgaggtcaggagatcgagaccatcctggctaacacgatgaaaccccatctctactaaagataccaaaaaaattagccgggcatggtggctggcacctgtagtcccagctactcaggaggctgaggcaggagaatggcgtgaacccgggaagtggagcttgcagtgagctgagatcatgccgccactacactccagcctcggcgacagagtgagactccatctcaaaaaaaaaaaaaaatgtggcacatatacaccatggaatactatgcagccataaaaaagaatgagttcatgtcctttgcagggacatggatgaagctggaaaccatcgttatcaacaaactaacatgggaagagaaaaccaaacaccacatattctcactcataagtgggaggtgaacaatgagaacatatgggcacagggaggggaatatcacacactggggcctgtcggtgcggtggggggcaaggggagggatagcattaggagaaacaactaatgtagatgacgggttgatgggtgcagcaaaccaccatggcacatatatacctatgtaacaaacctgcaggtctgcacatgtatcccagaacttagagtataattttaaaataaaagaaagaaagaaaaagaagacatgctcccatgtgttaagcgggtttcctgcagaggagggctcatttttacataagattcccaaagcagcctccttatatccagagtgtcagagattttacttttcttcttcttttttcttttcttttttttttttttgagatagagtcttgctctgttgcccagtggcgtgatcttagctcactgcaacctccacctcctgagttcaagtgattcttcctcctcagcctcccaagtaactgggattacaggcgtgtgccaccatgtccagctgatttttttttttattttttgtagttttagtagagttggagaggctggtctcccaactcctggcctcaagtgatctgcctgccttggcctcccaaagtgctgggattacaggcgtgagccaccacacccgactgagagtgtcagagatttgtcaaagggcctgcaagtatcctggcctgaaacctcacaggctgcttctgaatgataaaaactgacctgtcacttctgcaccattggtttctggtcttccatcacttccagcctcgaagggtgctcccacagcttagtacctgcataacaaaccccttaccccagcatatctaggatgccaacaactgtaaggcacaccacaagagaaaatgtatgctgccaataaatgctgacgtgttatctattgtaaagaagcatgcaggccctggcagtgttgaaatgtgaaaatatgcacatccagcaatcaaaacacctcatgcatactacaatattaacagagattgttttagaattatgaaatcagggccggtgctttggctcatctgtattttctaaactttctatggtgaacgatattactgccaatatttgaaaaatggtaaataaacattattttaaacaaaaaaaatgaaatgagccaaccagaactaccatgaacctaatgaaactaaagctttgtggccttccaaaggcccctggaagaagccctagtttgtttatatttgtattttttgttatttgtcataaaacaacccctcaaactacacatgcttcaggccccataaagctatgagctgtcttggattcaacaaatatggagtacctaacaagtccacgtggactgctttaaaagacagacagaaatagaaacatttcagcttaagtgaggatacaagcaagcccagataaccacaccaaggcaacaagaccaataatccctctccctttcctaattatcactcctgctgctatggactgaactgcgtcctcccaaaattcgtatgttgaggcactaaccccaatgggatggtattaggagatggggaggtgatcagggatagatgaaaccatgagtgtggaggccccatgttgggattagtgaccttataagaacaggaagaaacaccagagctttctgtctccaccatgcaaggacacagcaagaaggtggccatctgcaaaccaggatatgagccctcaccaggaactgaatctgcaagcactttgacctgggacttctcagcctccagaactgtgagaaataaatgtctactgtttaagccacccagtttatggtatcccattagagagcagcccgagctgactaaaacacctccatactccatctctagtgattataactggtgatgcacaaatccactggtaaactgtcagatattgaagccaccaccacgctctatagtttggttctgttgaagttttataagtaaataatgaactgccaatgttgtataaatgctatggggaatattcacccaaggattctttcttttctctgaaatctctcatattctttaaaaagtcagcctcttttcatctgcagtgagattttctctctaaatccttctttaaacactctttttgtgtgacgtcttagccttaagtactgagccttaaagaaaagctgttttccactcactgccttgttttacatatgctctccctgagctttcaaaatggcaaaataaagcatcttagggaccacaagggccgcctgctttgaactacccagcagtaaaggggccaagtgacaaagctagtcggtacacccggcccaaagcaccctaaagccaaacacaacacaacactttgtcaaattaattattaggctgcatcaaaatatgaagccactaaaagtggatgtactctatttgaaaaggaattttaaaaccctaaggttccacggaacctagtttgaaaaccattggtcaacattagcaagaagcaaacaaaatgaggaatttttccctctgcaaaaccatgtcccctccaccttctccgtggagggaagacacagtgttgatacacatacctgccatgatacaggggagagtgcatgacacacatttaaaaaggcgtggggtgaacaggcaattctcattttagcaagactgttagaacttcattcagccaatgatgaacatgtgctccactttgaaaacaaaaggcagccttgtctcacccatgactctctgtccctattccacaaggagcattcccacccaaatgcaagctctcagcttcatggacacgctaaggaggctctcaccaggagcacctccgagtccatgtccacatctctgcagtatggccccagccagatctggagcacattcttgtattcaacacatttataaagtgcctcatcaatacctggcgctgttcttgaccatccgtgaacaaaagaaacaacaatctcacccttgcagtgtctacattctagaggggagagacctcctaagtaattaaattgggcacaaaagaatgatgagtgctccgggggaaaaacagagcccagatagggggagcagggagtgctggggcaagtgttttgcttctgtttcggtttttatgtggtaaaaaacatgtaagatttaccatcttagccatttttaagtgtacagtactatagtgttaactacatgtaccctgtttgacaacagatctctagaacttcttcaccttgcaaaactgaaactctatatccaatgaacaactctcctttccccctccctccagcccccggcaaccaccattctgctttctgtctctaggtgcctcgtatgagtggaatcattcagcatttgtctttctgtggctggcttatttcacttagcataatgtcctcaaagttcatccatgttgtagcctgtgtcagaatttccttccttttgaagactgagcaatcttccactgtgtatacagaccacattttatgtatccactcatctactgatggacacttgggtagctcccaccttttggctattgtaaacaaggcttccatgaacataggtgtgcaaacatctgttcgattccctgctttcagtgaagacctagttttaaacagagctgtcagtgtggttccatgcctttcctttcctctgcagccctctgtccaccttctctgtaggggggaaattcccactttagtctatttcctggcactatttcatcagtagctatgcaacccacacctgcattttcagaacaactcccacaaactgcagaggactcaatatcacctattttctaaagatggatttcttcaaagcacagggctgttgggaccagagtgcaataaaagagtgaggaatggagaatgaaaacatgaatcatgaacgtgagcagctggctctgttttcagaggcacttgtcagttcccccaaaagacagcccctcatcatgtccttcaacacggcaggatagacaggacaatgtcacccatgctcccaagggcccccctgtccttactgcctaggaaagaacggccccttgatggaatctctgtctgcatgaaaacctaccacgaacactttcttcaaagttctggaaagaaaagttttgacacctgttaaaggaatttcaagaattcaaaattaagtggggacttcccaaagtctcaaataatcatgacacaacctactcaaccatggaacaaatcctgactgcggagcaggacccccagctagacagtgcagagcagccagagtgggtcagacctgagtcctgacccgaggactgctttctggaggtagatatgagaccccaaatatgaacaagatgcactagggacccaggaaccaggagtgctgatatccaaaggtcggggggatgatggatgtcccaattcgagaagagagacagaacgcacccttcctctgactctctgttaagactggcaacaaatcggatgatgaccacctgcattggtgaggatgatcttctctactccgtctactgattcaaatgctcatctcttccagaaacaccagctatctgggcatctgttagcccagtcacataaagttaccatcacaaaccacaaggaatgaattctgctggcacctgaatgagcaaggaaatggattctccccaagagcctgcagaaaggaacaagaccttgactgtaatccagcgagtcctgtgttggagttctaatctactgaactaaaagaaaataaatgtgttttgctttaagctgttaaatgtgtggtcatttgtaacagcagcagcaggaactaatacagccactttaatgagcagcccaggtggctagtacaactgatggggaatgtatcccctggccatatccccaggtgtgtgcccgagagtatcactgtccaaccaaactctctgcagtggtagaaatgttctatacctatgccgtcaaatatggtagccacttgtgaccattaagcccttgaaatatggctagtgcaactaaggaaatgaatttataatacaggtcatcttaattaccttaaacttgaatagccatgggtgatcagtggctcctacaatgaacagcagagcctcaagcagaggttcttaaatgttgctgcatattaggatttcctggagagatttttttttaatgctgatgcccaagctgcctcccagatcaattaaatcagattgcacttaggggatgggacccaggcattggtatttttaaaagtctccaggggttctaacatgcagccaagtttgagattcagtgacccagggaaacggtcacacagggtacacacagtcagatacatggatggtaactgaacccctgccttggaatgtcaacaaatggcaaacgctaaggtttccattcatgcaatggaatagaatgtccacagcaattaaaataaatgcatggatctatacataccaacaatggtaaatacagaaaacacaaagttgacttaaggagcagaaacactagtaacaatacaatatcatgtctatgaactttgaagtgtacacaacaatactacctgttgactataaacacatatagtaaaaagcataaaaacttggacaagaagaacacacaccaactgcaggctgggggaaacctgctgggaaatgagagcaaaggaggggatgggggggtgcaggtacaaagagcttcacttccatgcagcaatttatttcactttagaagatgtgaagcaattatggtaaagtggtattatttgctgtagctccatgttatgaacacaagtgtgttgtcatattttctctattcttttctgggcgtataacatttttcataataacaaaagagaccaacatatggatctccaggcaggaagagtttatccctgggcgggcagcacagaggagggtggttctctggggtgagttaggctatgtcatattgaggaatttattcctagtaggttttccttcaaatggaaagccaattgtcttccagaatttaaggaaataaaacaattatgagccaaaaaaaaaaaaaaaaaaactactggacaacaaaatctggccaaaggtgagtcaggcaaaataaagaagttagaaatggccttagtaaaggcagcatggcagcagctcaggaggaggagaggcaggttggcagggttctctgagcacttaaacataagactatgaggaaataccacaggaagcgggggagcagcggagagcaaatgctatcaacctcatcccacacatgcaacaatttgcaacaatctagccacgggagggaaatgataatattagtgtgccagacactgccctaagtgctttacattataaattataataactcaactgttagaataattctacaagatactgctattacttctatcttagacgtaacagagggaaactgagtcacagcaagtttggtgattagcctgaggtcaagtggccaagatgggatttgaacccagctgtctgggtcccaaatgttaacccctacattataccgttctttgaaattaggtatgcctgcactaatgtcctctgcgcttctacacttgaacttcccgttgtaaaaaaaaggactctaaccacttaaaaaattctatagccttttctacttgactgtgaagcatattcatattctttttcttgttaaagtaaatttcaaacttaccatttatcctgaaagtaaaatgtataatatataactctttggacacacatcctccctttacatccatgaacagcgtgatgtcgaagtcccgctcaccaatgtctatgaggggttatttgtgaaaggtgacattttatgtcatttttcttcttctgtttttccctggctttactgaggtacacttgacaaataaaaattccatgtatttaaggtctacaaggtgatgtttttgtattcaccttgcaaaataattaccataatcaagctaattaacatgtccattacctcacatagctctgatgttttgtacatggggcgagaaccgcactgctgggtgcggtggttcatgtttgtaattctaacattttgggaggctgaggcaggaggatgggttgaagccaggagtttaagaccagcctgggcaacacagcaagaccctatctaattaggcatagtggcacatgcctgtagcagggagacagaggaaatgggtaacttgagcccaggagttggaggctacagcgagctatgattgctacactccagcctgggtgaaagagtgagacctagtctcaaaacaaaacaaaacaaaacaaaacaaaaaaactactctcttagcatatttcaagtccacaacacagcattctcaactatagtaaccatgccgtacgttagatcttcagaactcattcctcctgcataactgatacttagtatttttattctttctacttttctgtattgctggaatgttttatagcaggtattcataaattttcacaacaaatgttcagttaatgacatttctaaaaaaacaaataaaaaagaaaataccaataaatgcacctcctatagaaacacaaggaaaaggaggcgtgccatggacatgaggagggagaacacacctctacatctgtaggacccaggacagtccttctggacccgcaacccagaggactgcaggcaggcagcacctccctgaatccagggtagacagccgggaagggcaggaggaaggccacaggcatggagccagatgaggtcaacaggaatgccatggagacaacagctataaccacagggggaaacccacgctgaaggaagtaaaaatcagaacctacaccctggaaaaccaaactagtgacacaggggaaagcttcagaaattctcccagaatgtcaaaatgaaaaagaccaccacctgacaaagcctcttatggcaagaacagagaggaaggtcacagatgacaaggacaacagagatcaagggcgtttcaagaggaactgctaactcttttccaaagaaaggtgtgcactactgcgacacaaaagcagacccttgctctatggaagaaaatccctctccaccagtgagtacttcagagactgcctgaaatgctccccaagctgttctcagtaaaagcaccaagtcctcttaccaagtcaggaaaacaagcctgcatatttatttggagcactacatttcttggtattctaaaataatatacacctctttctctctctctctctctctcacacacacacacacacatacacacacagagtagataaaaagtcccctttaagctaaagttgggagctcaagtacaacttcaggattatcaataaatatacagctgaccttggaacagcacaggtttgaactgggcgagtccacttatatgtggatttttttccatcaaagttacactgagtgtgcctgcctctcctgctgcccctcctacttcctctgcctcttcctcctctgccaccccgagatagcaagaccaagccctcctcttccttttctactcagcccactcaatatgaagactacaacaaagatgaagacctttatgatgacccacctccacttataaatagtaaatatattttctcttccttatgattttcctattaacatttcttttctctggcttactttattgcaaaaatacagtatataatgcatgtaacctacataatgtgttaattgaccgtgtttattagtaaggcttccagtcaacagtaggctattagtagttaagtttgggggaagtcaaaagttatacatggatttctgactgtgagggaggttgggtcccatcagggctctgagcccaggctaagccatcatatgccctgtgacctgcagtatacatccagatggcctgaagcaactgaagaaccaccaaagaagtgaaaataggcagttcctgccttaattgatgacattccaccattgtgatttgttcctgccccaccccaactaatcaatcgacctagtgacattcctcccctggacaatgagtctcaaaatctacccaccctgcaccttgtgacccccgcccctgcctgtaagagataaccacctttaactgtaattttccactacctacccaaatcctgtaaaactgccccactcagcccacttgcattcaagtaaaataaacagccttgttgctcacacaaagcctgttggtggactctcttcacatggatgcgcatgacgggtcccctaacccctgcactctttgaagggccaaatgtgcattatgtgacatggataaaaattaatgtttttctaaatggcaaagtctacaacctacaaattgaagaatagttctagcttcatctgaagtgttattgaagaacaaaaataatattctccataaatatagcaggcagatatacatttttaaaagtctcaactaaagctgaccaatgcaaacaattatttatttaggtgatcaaatagcaaactgactgtcagagacccattcaacctgtgatatgtgacctatgaattcactttctaccttcatgcttccaaaattatctagattactcactatcaatatttttcaccaagaaacaatggaatcctgagtctggtcacctgaccctatattaaattgtacccatcaattctacaaaacactgcccatgtttcctataaaaaaaaaaaattagaagaataaaagagtaatccacatacaatgtaaagctaaaaaactgcattggaataaaaaacaaaattgaagtattttatgaaaacctacaagaactaataagtgagtttaggttagcagggctgcagaatacaagagcaatatacaagatgcaactgtatttctatacactagtagtaagtaatcagaaagttaaatttaaaaacaataccatttacaatagcatcaaagtctgtaaaataaataggaagaaatctgacaaaagataagtaactcctgtacactgtaaactacaaactactgtagagaaagattaaagaccaaataattgggaagatataatgtattcatagggcagaggactcaatattattatgacatcaactctccccaagttgatctgtagaagtgcttttcaaccacgggtgattttgtcactccgggagatatttggtaatgtctggaggcactgttggttgtccctacttggtggcagaaggtactgttgccatctaatgagtaaaggatgggatgctgctacccaccccacaatgcagaagacagccccacaacaaagaattatccagcccaaaatgtcaacactcccagtgccgaggtggaaaaatcctgatgtacagagttagtgtaattccaatcaacatcccagcaggctttgttctaaaactgacaaactaattctaaaattcgcacagaaattcaaaggatatagcatagccgcaacaactttgaagaagaggaacaaagagaattaacataacctttcaagaggtttcaagaattaagtcaaagtatgttaacagacaattctccatgaacttctgcatatgtggtttttctaaacaagcagcactgtaaaaataaggatagaggatttgaatgccttgaaagctagaagtagtataacgcccaggagagatttagagacatatctgtcttgcaaccatttgctacctttcagtaaaataaaactagggaactttcctcctctccccagagaggatttgtttagattgcagagtaagagtctctccctctttgtctctggggcagaaaaagggcaaagttattagacaccctatagcaattcaggggcctctcctgaacagcactgcacgcacaggggagtaagtggcactgaccacactgtcccttggggaattgacactagttggcactgtgaatataaaatatttcctctgatccagagacattgttcctcatcagaatatatacatacacttaaacacacacacacacacatttttaaaacacattaattaagacagtgtggtgttggcatcaagacagacaagtagaccaatacagtataatctctactgcagaaatagatccacacatatacagaaaaaaatctttgatagaggtgcaaaagcaattctgcgaggaaaggatagtcttttcaacaaatggtgctggaaaaactggatatccatctggggaaaagatgaaataaacctcaatccatatctcataccacataaaggagttagtttcaaatgaatcacagacataaatgtaaaacatgaaactataaaatctgtaaaggaaagaatggaaacaaatctttataactctggattaggcaaagatttattacatatgacaacaaaattttaaatgtggcatcttcaaaacacactgtaaagggaatgaaaatacaagacacattccaggagaagatatttacaaagcatatagctgatacaggtcttgtacctagaacataaaaagaatcctcaaactttaataaaaatgatgtcaacaaaaatgccagagttgaagaccaatgaaaattctctcttccataaaatcaatgagaaaactggcagaaagtgtcagaatcaactttttcagaaccctaaaaattaaaaacagattgcagcaatctgatgagtgcttcctcaagaaaaatgtctgaatctcggtaagaacaggtgagctttgtggcacattagcttggtgctattcccttcccacctacccgtctcggcaggagccttgcaaaccaatagcccacaatcacagtgcatgtgagaaccctggcaaaacatggctggagctccttcaaattctcattcccagagaactgacatgaaatgacctgtctgatgtttctctagaagaaaccacctagaaggctgtttttatttgacctgactcagaccttgctcagtgtgacatgtctttagcctcggggcatttgctgaaaacagttgaaggtgatcattaaccacaacagctgctagaggtggtggttaacaaaaaggcaaaaagaggctaaccaaaaagcttaaaggaaaaagccatggaatgaaacgtctgtaggtcctttgaaaaactccaataaagtgctgaaaattaaaaggccacatgcacacaggctgtgtacatgccaagcactgtgttcatgctcaggaaaggcctgggaaggccctaagctctcatctccgactgaccttgaggctttgcacaagcaggaagggaagacgaaggtagggctgtcaactgcctgcctggctgagtagtaaagtaacatttgcagatgacttccttagaaaatcttaaggaatccacaaaaatactgttagaggtaataaatgagttcagcaaggtttcagggtacaaaaatcaatacacagaaatctgagattcctgtacatgtgcaataaacaatcaaaaactaaagtgaagaaaacaattccatttataacagcataaaaaatacaatacttaggaataaacttaacaaaagagatataacttgtacactaaaaactagaaaagatcattgaaatgaattgaagaaagcttaaagaaaagacatcccatgcttctgagctggaagacaatattgtttggatggcaatattctccaaaatgttctacaaattcaacacaacccttataaaaatcccagctagatttttttttttttttttttttttttttttgcaaaaatggacaagttgatcctgtaattcatacggaaatgcttggatccagaatagccaaaacaatcttgggaaatcaaagttggaagattcacatttcctgatttcaaaacttactacaaagctactgtaataagcccatacatttatagtcaattgattttcaacaagagtgtcaagtcagtataatgcaaaaggaacagtcttttcaacaaatggtgctgggacaactagatagccacatgtgaaagaataaaattgaacccttgtctcatatcatatacaaaatttaagtcaaaattgatcaaagacctaaatataagaggtaaaactatgaaactcttagaaaaagatatagatgtaaattttcatgatgttggattaggcaatgttttcttagctatgataccagaagaacaagcaaacaaaaaaatagatgggatatcatcaaaattacaaattttgtgcttcaatggacaccatcaagaaagaaagacaatctacaaactggaagaaaaaaattgtaaatcatatgtctgtacaggtctagtatccaaaatacataaataactgttacaactcaataataaaaagacaactcaattggaaaatgagccaaggatttgcatagacatttctccaaaaagagatttgaaggaccaataagcacatgaaaagatgctcaacatctctagtcaggagggaaaagcacatcaaaaccacagcaagaaagcacatcacaatcacaaggatggctgtaataaaaaaaactagaaaatacatgtgttggtgaggatgtgaagtagaacccccacacattgttggtaatgttacgggcaggtctttgttcttagagctcccaagatgtggcagaccactcccaagatggcagcaagccttttgttctctgacctggggttcttggccttatggattccagagttttatagctctattagaagccgtaggtcacggaagagaaccatggaacccagcgactagtgttcagctcgattaggatgaacctgggcactcagccgtgcaggaacaatggcgagcctttagcccagtcggaagcagcaatgggcgcctcgctggatcaggagcacagcagacaccctgccagatctagaggggtgtcagtcagtggcaggtctgcaatggcagccaacagcagtggtggacagcgagcgaaagctcagctcaagccataacaaacatggaccagaagagtgtgcagttgcaagatttaatagagtgaaaatagagctcccatacaagggaggggacccaaagggggttgcccactcccggctcgaatgcctgggtttatatcccgatcattgtccctccccctgtgctctcaggcgatatatgatttcactatttctttacctcttgctttagcctagtttgtattttagtgagccctctttactacctgattggttgggtgtgagctgagttacaagccccgtgtttaaaggcaggtgtgatcacctttcccagctaggcttaggaattcttagtcggcctaggaaatccagctagtcctgtctttcagtaagaatgtaaaatgaagacactttagaaaacaatttggcagttcctcaaatggttaaatccatagttacatatgacccagtaattctattcctaggtacatacccaagaactgaaaacatgtgttcactccaaaacttgtacaggaatgttcacagcagcatcacgcataacaaccaatgtccatcatgcgatgcatggataaacaatggaatatacaactgtttactggaatactattcagccataaaatgaaataaagtattattagatgctcacaaaatagacgaacctcaaaaacattttgctaaatgttaagaaaatagaccactaccaaaattctttcaagaggtaaatgagtaacaaactgtggtgtagccacccactgggatactaccaggcaattaaaggggctaaactaggcacatgaaacaacatggatgaatctcaaaggctttatgctgagtgaaaaaggccagtctcaaaaggttatatgcggtataattccattcacataatattccgcaaaagacaaaactatagtatggagaactggtcagtagttggtggctggcatgggtttgagaggggtatcacaagatgaagccattttacaaggtaatgaaactggtctctaacctgattttggtgatggtaacaggaatggatacatgtattacaattctcagaactgtatacccagaaaacaaaaataaaaacctaaccacaaacagaaagtaaaaacacagaaataaggccctcctttcctgacatgcacattctttagtaactacgaaagtaatttcttcaacttcaaaaagcacaagtttaactgatttatttcaagaatgagctaatcaattctgtatttattaaatgcaaatgtttccaatgggtagatttaatatgctatggcaggagaaaggtacattctataccctgaagtacaagaattgattgtgcaagcttggatgcaaaaagtaaaattaaaattccatgtacgtgatatagtgctacacctggcaaaaagcttttctgtagagtgaactgaaaggcacttgcaaacaactcaatcatctggttaaaaaagaaaagaaaaaataggatcacaactctctcttgttacagggaaagtgtccatcttccaaaaaccaaggctcccctcacgcttctcaaagatggtgtccctcttggacagcctctgactctccacatcattccctctttcctccaacccccactgataaattcccaccttagaggcaagccacagcccacagactgctacttcttaatctccccctgtacagagtattttctttttttcagagacagggtttcattccatcacccaggctagggtgcaatagcgtgatcatagctcactgcagcctcaaactcctgggttcaagcaatcctcccacctcagcctcctgagtaacagactataggcacatgtcaccacacctggctactataaaaaaatttttttttttttaaagatggtgtcttaacgatattgcccaggctggtctcaaactcctgggccatagcaatcctcccgcctcagcctcccaaagtgctgggattacaggtctgagccactgtgcccagcctggaaaggatcatgtttgccccataccttcccatctttccagtcgtgccaacctaacacccccagagaaccatgtctgcctccacactcccactctcccttccatcactcccatctggcctcctcactgattttccacaaaacctgtcctcaaatggtcactaacgatctccatgctgtggaatccggggggcacgtgtttgtccatttgctcagcttctcagttgtcaccaacccatttggccacactttccttctgctgatattttctgctttcaacatccttgaaaccacaccctcctgcttttcccccagatctggccacactttcttggtttcctgtggcagctcagcctgctctcctgagcttctaaatactgaggaaattcctcatggccaggccatgcccccgtttctccacactcttcaatttgttgcctgcctgcatccaatgccatccgtatgcacctgctcgctctgtttcatcggcccaacctttgctgggtttcaggacattttctaattagtctgtgagatctaagtagatgtcccattaaaaagggggttccatgggaaaatacctttgagaaacactgcttcacatgatgccccccagccaccccacgatcagctgatgagtctttaggaaaacaaatctgtctaaaacattcctagaaaaataatcccaacaatcaatagtttgtgtccctgttgtaggctcaggtatttcacaaaatccttctcatcttccccactgaaatttagtctcgtgtgaaatgaaacacagaatttactactttactcctaggtaattcccaagatcacctgcctcacttcctccccagggcacaaaatcagagatgtgccaacagaaggcatccactgcagaccctgtaatcttgccaccaccattcttcatgagccatggagaagcttatagaagctggactcctctccccagaaaaataaacacacacacaacacacaaggatctgtatgtaatctcaaggtctcaccccaggaaattcaccccagggtccatgaattcaaagtaagcccccctcagtaaggatgcttcagcggacccctctgattcacaggggtctccattctcacgggcttgctggtttcgctgctaagattatgacaaactagggctgatgagaccttgcttcactccagcaacacaccagtgcaccataactgaggcctctctgcacacatccgccctgcagacaccgtgcattcatccatttggcaaacactcactgagctcccctaccttccaggtgctgtgctaggtgaaggtgacaaactccatgatccttgccctggggagcagacctcctggtgaacagacgcaaacaataagcacaacaaatgacaggttgtgatggcattataccaaaattcaaggggtcatctgacggggtcagatccttgatattgggtggtccgtagtatcatgtgacagcatctgagattgcattccataaaaatcccatcaagatttgtaaaacctcaaagtccttcaaaataagaagatacagtctcaatgttaaaggctgaccaaaaaaaaaaaaaaataggatgagttggaagagaagctgcatgtccttccaaactaatgaagtgatgctcctcctcttggctccccactcccagtagaaatccagccgctagtacccaagtgagagtgacacattcctgcctagcaagcctacagtacagaccatctggtccactggccttgtgcccacttgaaagataacaagccagtttccaatgataaaggaacccaaaaataaagatgtaaaaacagagcccctgaaatgagtcaaatgatacttcctcaccaaacacatcttctgatagcaaatcaagtccaaaggtctcattacaaagaactgtaattctagatagtaggattagctccaccatgaaatctatatgccaacgctctttcgtaattcacttaaaggcccactcacaggtaattcacttaatttcagatctctgcacttgaaaatcacattttttgtgtttcaaatggaactgtctaaactccatccatcgcagaacagttatatagattatgttcataaaattttgtatatacaaccattaaaaataactgggtaaaactatgttactcaagtgatatgtattgttttatctgcgtaaaactctattcttcttgtaaattctcctttgtcccatgtgattgtacttgaaacttccaattatactctttctagcccctccccagccactgtggctagtccagagataggaccatgacatgaaaccagcctatttgagtcttccctgggattctccaacctgcaaaacaaaagcctcttgcatgtccggtcaaggagctgtgggcacataagctcccaagagctgcaagtggcagagggtccacataaaggtggggttgtgagggcgtggaggggtgtgtgagggtgtggaggggtgtgtgagggtgtggaggggtgtgtggtagctaatccagtaaaggcacaggaaggctacgcctcactcagtttctgagtatcttctctatgaagtcaaaagaagtttgaggatgattggtgccattggtgaggcaggttaagcatggttaggactggctagtttgaagaatccagcagcctctgggctggaggggctgtcatgagttgtctggtacctggctctgaggtgtttagggctggtggaccgtggcctagaaggtgagagccagaagaagtgctggggaactgggctctaggctggctggtttgcattctgaaaggctcactcacaggtgagccattaccacctgcaggaatcagctagcctgggagggacagtccctccagcatcagcaaggccccagatgccagagcacccaaatatacagaataaaagggcacaatgaacacacaccaaaaccttgtctcacagagaatgacacctagagtggctgattgacttgaccaagctcaaatgagctaataaaatttctaccttagggtttacacagcacttacaaactacctcattttagatatagcaaaaactctaaaacatcacaggtttatggccattctgaatctcaggaaaaccgaaggtcagagaagttaagcggtgtttctttagtcatctgactaaagacaaacagagctaaaatgaagctacatcttcttgtctagccttttgcatggattcttcaccacacggcctctgcagacctcaggccccacctaaagctccattctgatggatgaagcccagggcccctcgtgcttataagtcttggttggggtggtctttcccgctcacatctcccatgctcggatgtacggaaggcgcctaggtggggaggggacgctccagaaaatgcaaagctcttccgaacaaggctttagtatccacctgcagctgccttctcaccctagggaactggactgaacaacttagtgctccctgagcctcgcccagagcaatggttctctgggaatctgtgcgggtgctgggttgtcataatggctgtgtagttcctgacctatggggaaaagtggccagggatggtagccatccatctatgcaaggagtgttaacctttacgtgttaatgtaggtgaaacaccaacttataataatcacaacctaaaacttgcttccacttttaacctccaggagttttctcattgtttttatatacactaaggtgcccggcactgcaactaccagatcgatcaagcgaactccaacgtgtctggaactctaccaagagcggttcaccactttggaaaatcatgtccccattgacaaggacactccagtgcaacatcctgtcctgctgtgcggctgccgtcatgtctgtggtgatgggtggaggtgcaagcacccagtcgttccctgtgtctcccagtggtcaacatgcctaagcacagaaacatacattattttcagtgaaaattacatttagggctttgtaatgctttttggaatcgtaagtgagaatacggtgcactttctatgacttccatttggggatatagcaaaaacatcatgacaaagggctgtggatctgacagagttccaaccacaggcccagagcagactctggccagacacctcctgtagcctttcctttgagccctgtccttgatctcgatccagttagcatttcaaggttcaaatgcagacccatcccaaaacggtgccgcacccaagtctgggaccaatgacggagagaagagggaggcacctgcctgcattcttcccctcagtggctctggccacacatggagtcgtgggctcccctgtgcactgttctcagcctcaggtaggctgtgttctaccttccccccagttttcttcttacctacgagggctcttgatttctcctgactttgcaaatcctttatgcgtgacagtctcgccttgagaagacagggaggtaggggacgggaagccagcaattttacccactactgattcattcaagaaacacaaatctgaatgcctactattcattttaccagggctctttgcagacacgccagactttcaaactagccatcatcatttaacatctttcaggatttcacattagaagcttttggtaactgaaagtggactggtgtgggggagggccaggtcccactctgacaagggcctagaagacaggccaactcctgtctgaggtctgaaactgggcagaacatgaagggcagccctggggagggccaaccatggggacggaaggcaaaaggctgtgggaaacccatttttaaattttttaattcatttttaattgacaaataaaaattgtacatatttattgtacaatttgtacaactgcacgtacttcaacatgttgtttgaaatatgtaaacattatggaaagcaaaattgtttctgaggcagggtctcactctgtcacctagactgcagcgcagtggcgcaatctcggctcactgcaacctctgcctcccaggttcaagcgattctcctgcctcagcctggggagaagctgggactaaaggcacccaccaccacgcctggctaatttttgtatttttagtagagatggggtttcactatgttggccaggctggtctcaaacccctgacctcaggtgatccacctgcccctacttcccaaagggctaggattacaggcgtgagccaccgcacccagcttgaaaggctaaactgagctaattagcatatgcattactttgcatccttattttttgtagtaagatcacttaaaatctactcagcaattttcaagaagacaatgctattaactatagtcaccatgttgtacaagagatctctttaacttcctcctcctatcgaactgaaattttgtatacctcagattctaatttttaccctatattacacagagcaattttgaatttatttcgctaaactgtgacctagagaaaatattttattcagaaaacatcactggtaaacaaacagctcaggaagtgatctgtgtttactaaaactttgaaatatattttacacatattctgcattaaaatctgattaaaatgtagttatacaaagagacagtgttttctgatttgtagcattcatggccgagatacactatttaaaaatgcacttgatttaggcatttattcaaaatcataagcataaaacatgatcataccttcctactggcagacacaaaactggtgcatcccacacacttgtttgagtaattacaacaccagctgttctagcacctaccaagagaagctgcaactcagactgactcctggtcactgatgtgccaaacagcatcatcttctaaccaaaaatgaaaatctcactttgataaatgggttgtccaagttaaattagctaaaccaatgcttaagtctaagttccaatttttaaaactttctgtatatgctatactagcaaatgtggatttatctgattttaacacaaaaaggagagactgccaatagaattgatttctgctagattttaaaatctacaaaacctgagatctccccaagaattaaaggcaattctcaggttgaaatatttatgaaacatacaaatttcaatggcatttcacagaaaataaatataaagcattaaatagcaagacaaagattacagccaagactctcaactatccaactgaaactcacttccatatttaccacccaaagacagcagaccctccatgtgctggagcctctacaggaggaaggggaaatggccatgtgctcagtgtgtgttccaatccagggattgtacacaggctactttattcaattttctctgactctggatttcccacaggataggcttcgtagcagcactctacagttggggaaactgaggcctggcaactcccctaaaggctgcccagccaggaagcacccgcccagcaggtctgacgaggcctccattctcttgcagtgcgctatgtctatccactccaaaagccacagcacacacaacttcaactctccagaaaatgtccagtcaccctgtctatatttttcttgtttcataaaaattacgcattttggttggagtagacttatgaccagaaagaggctctctgcaaagcagatgctgcacttgcaatggtgggatgaagggggatggaatgcaatagcttgaaaagtgaccgggacacagcagctggactagactcggggataagaaatacctctctatttttccccaaagttaaatatttctaagcttccacctgttcacctggtgagaaatagcatttcttcatggagtacaagagtcttaagtggtatatgcaacccagaaaatttggcaaacggtccatgatgatcaccattgagctccctgcccataaggtccattgtagaggccctgaccctggaaagtgttctgtctgcagacatctgtggccatcctcaccttggaatttccccttcttagacgagccagtctgacatcagtaaaaaacagaagtcaggcatttctcccctgtagaaagggaacctcccattctggcagaccaagattcaacactctcttggaaaggaagaagggaaataccactcatgcctgcaatgagccaacagcagaccccagtaggcccaaacaatgagaaacaggacagagtttgggtttgctttacatctattccattgtgaaatgccagggccccaggactccccacggctcaggaacgtatggagacgcattaggtggcaatatgtgctgctgcctatagaaacgatatgtgacccacagaaagagtgtcatatgtccaacctaacaccacaccagtgggtcacatctgcaagtgccccttggccaaaaaaaaaaaaaaaaaaaaaaaaaaaaaaagaaggatatgtagccttgctctccttcctaatcaggagctcaccggaacgtgggagccaaccaaaccaaactgtggctccagcttttacaaccctaactactgggaatctattttctcgctggagtgtctgagaggatggagaaatacacactaaaaagggttccgtggagatattggatttagactttataaatgtggctcatgaattccaacacccaaaatggaaaactgggcttccaggatattatactgttttgtacttagctactttatttatacccctcctggttctgaagaatatttaacaggttttatttcaccatgaaaaaaagggttgctttagcaacagggcaaacaagtatacttcttaaatgtctataaatgacccagattagtctccaagtttgtaaaatacttaatctctttcagcaatgaaatgccaagataagagtaaattccaaaaattcttttgagggcatgagggcttacttattgttaagtaggagatgagctaagcctctggtactctcggtccacagaggcaccctataaaaacgtggcaagcccagggcgaggcatcatggaatggaccctgaattctacctcagtggtgccaattcctgagaccttgttaccacaatgtggccaggcacaaagttttcactggccaagacaaaaataagaatagttcccagcacaaaaaaaggcaccaataagtatctgtagactgatggactgataagtgaatgactgatactgtatacttttcaaaagtcaagagataatttattacatgtgaagaacaatccttaaaaataaagctggggccaggcatggtggctcacgcctgtaatcccagcattttgggaggctgatgcaggaagatcacttgagatcaggagtttgagacagcctgggcaacacagggagacctcgtctctataaaaaaaagaacttaaaaactagccgggcatggtggggcaagcctgtagtcctagctgctcaggaggctgaggcagcacaatcgcttgagcccaggagttcaaggctgcagtgggctatgactgtgccgtttgcactccagcctgggcaacagagcaagacatcatctctaaaaaaataataataaaaataaagtaaaaagctaaagttgaacctgagagtgtcccttataacattctcctaataaaatctttttctttgtataataaaatggtgtgataaaagacaatagtttcagtgtgaataaaaactaaacagtaaggccaggcatggtggctcatgcctgtaatcccacaactttgggaggctaaggcagggggactgcttgagtcttgagcccaggagttcaagactagcctggtgagaccctgtctctacaaagaaaaaaaaatttttttaattagccaggtatggtgataagcacctatagtcccagctagtcgggaagctgaagcaggaagatcactcgagcctgggagtgcgggatgcaatgagctgtgattgtgtcactgcactctagcctgggtgataaagcaagaccctgtctcaaaaaacaaactacccaaaaagttagcaactttatgtctgaaccccaaatattcttttttttttttgagacagagtctcactctatcggccaggctggagtgcagtggtgtgatctcggctcaccagaaccccaaatattctcgaactttcattttaactacaaaatctgacagtgtgagaaccactgcttgaagcactggctacaatcccaggaagaagagtggaaatccaagacacaggggctagtcggaaaacattccccaaaggcagggaggcagacccaggcggcagaggagcctgcccaacagccacgttccctcttccctcggacagatccccagctttgttagaggatccttttcccatgtgactcaaggtcaagtgaatctacctcccactctaagaaaaggtcagtattagctaattccccttgccagtgattggttcagggatgatcacatgacttaggtctgaccactgaggggaagtctggtggggggcttctaggaaagatttccttgccactaagaagagacacagggatcagtaacccctcttcttttgtgtacatgtgtcctctgattctggtgcctaaaactacagcagccttctagctggattcaggttaaattaagatactcttaccagcagagcagaaagatggaaaacacatgggtacttgataatgtcaccgaggcactacattaaccaactggaaacctgttatggttgaattctgtcccccataaaagatacatcaaagaattagccaggcatggtgacatacgcctgtaatcccacctactcaggaggctgaggcagaagaatcgcttgaacccgggaggcagaggttgcagtgagctgagatagtgccactgcactccagcctgagcaacagagcctgactctgtctcaaaaaaaaaaaaaaaaaagtcaaagttctaaaccctagtacctcaaaatctcagaatcggagtttatttggaaagaaggtctttgcagatttaaccaaattaagatgaggtcattgggtgggctctaatccaagatgactggtgtccttataaaaaggggaaatttggacacacataccatagaaggatgtggtgaaaacacacaggagagccccaggtgaagacggaggcagagactggactgctgagactgcaaaccaaggaatgcccaaggactgctggccaccaccagaagccaggagaaaggggaggaagggatctatctacctggagtctcagagggagcacagctctgttgatgccttcaggttggacttccagcctccagaactgtgagagaagaaatttctattgttttaagccacctaatctgggcagctctagcaagctaatacaccttctttcttctggacctttttatgtatacgtaacataatatatgtatactatgtaaattaataaattttccttctgcttaagccactttgagtgatgatgtcagtaattgcgattgaaggcaactcgatcaactggtcccaagggaggggactaccaagcagagaaagggtcctaaaggagccaatgcccactagagtccacgcaccgctttaaccagccagcaccaacatccttccttcatcccaaactcacaccgccagacacaaacacaaattgctgctccacacagcatgccgttatccttatatatacaaccaaaagcacacaccacaaattctagaacaagtgcaggacctcaggagaggtccacttcccctttggtttcctcctgattcttcttttagtctaatgtagagattaaactgtaaagctgaggaccagccacgcaccctatatacagtacatgcaaatccaactatttctcctcaaacccttggcctggcccagggccccaccatctctctctggatcattgcattagcctcctaactggaatctccactttgcgaccctggccctccttcaaagcactctacagagctgccaggatgatccggttagaataagttaggtcaggtcactcctctgctcaaaaccctccagtagctcctgtttcattcagagaaaaagccaccgtcctcccagtgactcaggaggcccctactgatggggatccctgtcccatcattgtttcccattgctccccctcttcctcactgcactccgctggcctccttgctgtcctgtgaacaacccaaggcggttcctgccttggcctctgcacttgctctgcccttctccacacttctgcaggtcgctactgaaaaatcacctcattaatgagggcttccctagccatcctttctacaaaggggccttcccaacccctttccactgacccttcacaccccttctcctggatttaacaatacgttttatttatgtggcatgttcattgtccactagaatgcacgctgtaggagggtggggatttttgccaaccttgctacatcccacagcagtgtctgggatagggtctgccacatgcttgaatgagggagagggaggaaagaagaggtgggtgactatgcatgtggttggttaggtcacttagcacggccttgtgttttgtcccagtcatgttcagctgggcagctacaggcctggaggaagcagagagttcaattcagcagggctggagttttgccaacagagtataaggaaggagagaagagccagagagctgaagaggcaaacgatgactgatcataatggctgaactcggaaattattataagttaggtaaagaaggaagtgagggcatgaagagaggacaacatgaaaagataatcaaaggtttatagatcagtgtggggtttaagatcttttgggccgggcgcagtggctcacgcttgtaatcccagcactttgggaggctgaggcgggcagatcacaagatcaggagatcgagaccatcctggctaacacggtgaaaccccgtctctactaaaaatacaaaaaaaaaaaaaaaaaaaaaaggtaggggcgtggtggcgggcgcctgtagtcccagctactcaggaggctgaggcaggagaatggtgtgaacctgggaggcagaacttgcagtgagccgagatcatgccactgcactccagcctgggtgacaaagcgagactctatctcaaaaaaaaaaaatctttctggagtaggtgcacctacattgataatttttgtgtaatctaaaattgtgtttgttcctccttggtctaacaccctcagattccaccagcatatatattagccaagtttgcatccatgtatattagcaaaaattcagttcaagtggcacgtggcatgtaagctttctccctgtggactttataatggcagctgcaccttccctgctggggactgacttcagtctggatatgacaaggggtggtgagggagaaacatcgggagactgccttcccaggtgagatactggggccgggtggaaacgctgcacccgacagaggtcccagcctgcctgggttggcaagcacagttgagagggatcctgagtctcccaatcctctccccaccccccacccccaccagcatccaccagagtgtcagacctcatgcttcctaaatcaacgacagtgttcgggaaccaggcaaggccatgaacacaactgctggtgtgctcagcaaccagaaggatcacactctgaaaccctctgctcctttcttgttgcccccgccttttgtttcagtgcaatcactgcaagttcacgacatgccaggagctgaaagtttcagaatctgggctctgcattctttttctttaagctaatcagcaggagcccctgaatatccaattccccactgcctgccatggacggtgaggagtccaccactcaaccctggctgtactttcactagctctgcccttaaactgggcaaattaccagtcccacatgccctgcccctatttcctggagggtctaccacctgcctccactccttattccaatcctgccttgttctgggttttgacttccaagcaacagaatcaagttggcagagcaaggtggaaaatggcatttacctaaacaatgttggagagggcccagaatcgctaggagggcaaaaggaaaggctgaaggctacagagccaagaacagtgccccacatcctgcccagagcagccaaaatcccctgagtgacaaatgacagatgacggatgacactccaagccaagccctggcgagccctcacaccatgccagggctgcccaggacgcccacctagctgcaaacgtggccaccaacagctctctcactctgtttgcctcactgcctcccaagagacaaagtctaggcagatgtggcccaggcaggccagtggctcccgtgcacccaggatgtatggggatcactcagtttgggtcatatcacagcccattgcctccctgcaccccatactcctgacaccccagcctttctgggacccttatccacagtcttccagtttaaatgaaagaaagtagacctcaaagacaggccaatgtattgaatgtataataatcaagccagggtatccatcaccctagtgtttcccatttctatgtgttaggtacgtttcaactctcttctcgctatgttgaaatgtattatacacactgttgttaactatagccactctactctgctatcaaacattagaacttatttttttctatccaactgtatgattataccccataaatatgtacaaatataatgtatcaaaaagaaagaaagaaagaggccagtggaaggcattcaaaaacaacacacaaacctgacaactctgttttcgcccaccagggctcagtgaaactcttcttaggcatcacacaagagagaaggaaaactggcaagttcacaacataaacacgccgagacaggtagacataccgctaactttatggtgatctggctatctgaatagaaatagaaagagtgctataccatgtcaggagacgaaaacctaacactttgcctgccatctataattgcttgacagcataattgatcatgtaactgacaactgtcccatcatcctattctcaagcactgataaagtgatgtaacactaccaacggcacatgggatcttccctaaacagtgtgatctgcaccaaccagggatcacacagttaataccactggaattttaaaaagctttctctaaacaaaagcatcaaaaagctatcttaaaataaatgaaaagcagacaagttagtcctatagccttgagtatttatcctagatgatgtcctagtggctagtgaactagaaatagactctatctgtggaaatgagggaaatattttttaaaataacaacgcccattagaagaatccagctgccttctcaaaatgacagagccagagcagttctttgtcatcgctatggctcggggcctggggatcacaaacctccaggtattcaccgggtctgcactgaccagaaagcatcactccctccctatgtcaggcatttggacataatgtggatggttaataaaaggcacagcaagctgagaaagactcaccagacccaccttggaggacccaacaactgacccggagcacactgcggaaatttcaactcatctcatctgttcactcgctccttccgtaaatcggtactgagcacctgccgtaggccaagcacggtcctagaaacaggatggacacagctaccaaggcctcagcctcagcctgagggagcccatgttccaggagggaagacagatgagaaacagaatttaatttcagatagtgaggagcatgtaacagaagacaagagcaagcggggaggacacagggcaggaatgcgggctgggagaggggccagccatccagaggagaggcggggagagccttctctgaaagggactgctgggtgagacgtgaagcataagaaggcattactgggacctcggagtcagcttaagggcagaatctcacacccttgtcttagaaaaaaggaatgagaagttttctagacagggaagaaaaggcacccatgcttaaaatgggagggaacaggcagagttcaggtgactgcaagaggccactgtggctgggcacagagagcacacaggagctgcacaagacaggtctgctggtggccacagagccaggacagcgaggtcgtggggaagaaagggaagggctttaagctgctggggctgacacagtcagaactacaacacacacagaaaagcgtaacaggtctttcttcttccaaataagcctatcttttacgcttttctgaattagttggtcctcctgttttggcttgaagtggtagggtttactctattttttggcttgaattggtagggtttattggtttggtttggtttggtttgagagtctcgctcttttgccagactggagggcagtggtgcgatctcggttcactgcaacctctgcctcccaggttcaagcaattctcctgcctcattcagcctccagagtagctgggattacaggcgtgtgccaccatgcccagctaatctttatattttttaagaagggacggggtttcaccatgttggccaggcttgtctcaaactcccgacctcaggtgatccacctgccttggcctccccaagtgctgggattacaggcatgagccagcacacccggctgctttacggagtctcactctgtcacccaggctggagtgcattggcgtgatctcagctcactgcaagctccacttcccgggttcacgccgttctcctgcctcagcttcccgagtagctgggactacaggagcctgcagccatgcccagctaatttgttgtatttttttttttagtagagacggggtttcactgtgttagccaggactgtctcgatctcctgacctcgtgatccgcccacctcggcctcccaaagtgctgggattacaggcgtgagccacggcgcccggccctccttagccatttttaagttacggttctacggcacaacgtacattcacattgttgtgcaaccatcaccaccaaacatgcacagagctctttttatcatgcaaaactgaaactgctcccactgaacactgctcccctgctgtccctggaaaccaccatcctacttcctgcttctatgagtctggctactctgggtacctcatataagtggaatcacacagtatttgtcctttggggactggcttatttcacttagcataatatcttcaaagtctatccatgtcatagtatgtgtcagaatttccttcctttttaagaatgaatagtattccatggtatggagagaccccattttattgatccattcatccaaggatgggttcctgggttgcttccacctcttaactattttggttgatgctgttatgaacatggataaacaagtatctcttcaagtccctgcttttaattctttgggtatatacccagacttgcttttaatgagactctctacatgttaacttcttgcttttaatgagactgtctacatgacatgttagtcacatgtgatttacaacaggaggtaagagcaggctgggtgaatcataatagtgtccattaatgctgcacgtacacagaggactcctatggtgccagtgaacaaaggagcagacacctgctcccaggaccacacaaaactcaccactgcagacatagatgactacctccattctaacacataacataatttggtctcaggtacttagtgaggagagtttccatttttcctccaaagatacctagcagagaaagaatgtcatgtttgatgggagaatttttaaattagcttcagaaaccaattacatacctcaggcttaaaaaaagacagcaaaattggacaggtgcagtggctcacgcctgtaatcccagcattttgggagctgaggtaggtggatcatttgaagtcaggagtcgagaccagcctggccaacatggcaaaaccctgtctttactaaaaatacaaagattggccaggtgtggtggcgggcacctgtggtcctagctattcaggaggctgaggcaggagaatcgcttgaacctgggaggcagaggttgcagtgagccaagattgcgccactgcactccagcctgggcaacagagcaagactctatctcaaaaaaaaaaaaaatcccccaaaaaactttttcaaacccacaatctgactttaaatttcataaagaaggtgatcaacaaagattggtcttggtctattaccaaaatgatgtcaaattttccattctctttctttgttctttacatttccactccgattttatgtaaatgaaattgaacttttactagagctgtttaaacacattctattgaatacaactgtattttatattttcttttatttttatattatataaatttgtatttataaaacagcttttattaaaagtatttttgctctgaataattgtattccatacatgtaaatataaaaaattgctacatggccctttaaggcatttaataattttacaaaatacagtaacactgcagaagaaagacataagaagttttactgttaggaacattctccaagccagaaaaataggcattagagtaaggacatttccacattcaatattaattgatatttggagcagaataattcacagttagtagtcagattgatagagacaggaggtataacagtggttgccagcagctgggggcagacaataggaaaatgttgaaggggtacagagcttcacttttgcaagatgagaagttctggaggtgtatgatgttgatggctgcacagccatgtgaatgtacctactactgaactgtacactttaaaattgttaacatggtaaattttatacatgtattttaccacaattaacatttttttcttaaggttttcaaataaaaaattcggtagttatttgaataactaatgctaggcaggactggtcagcaggaaaaagctgctccaaaggtggctgagggtaaggaaagccttcgtaacccctcaggcaaatcaacaaagagatcttttactacaggaaggtgctacatctgcctcagagcagaagtggtgcagcactgatttaggttctgaatttcttaaggtctaacactgacattcttcacatgctaacagttccgatgttcaggtgcctcacagaagcaatgtcaaaagaaatatgctatctgccaagcaaagaaacaaactgagaaacagctgtgtctgcctgtgcatgcataaacttaaccaggcataaagggttcctagtgacacgtatctgcatggcagtaccacagagtactgccatgtagttgaatttgaattgtcccgtaaatgcctccaaaaagatttcatgatgatatacaactgagactgcacactactgtgtggacagaaggttgccttccatcgggctaagctccacaattaagtaaaaactgccaaatcttttgggcagatcataaaatgttcgaagtcaggacaagctggtgagactgactcacacactgtaaggactatcactgaacatttttctgtcctaagtcccagctgactttccatgacagttgtttaatttccacagatacataatgcaattatggaaaaagtgaaaatccgatatttaccaaagaagaaatgcagacatctggtagtttttaaaatgctttgaaattatgctgtcaatgctaagaggacacaaaaggtcaagaacatgagcatggaatatgaacagtattaaagctgtcaggcaaagctatcaatggccaaaagagataacagaaaacattatcctatgaatgaaaagaaagcttaagagtccagttttgtgatcttgagtaaaacaacagtatgatgtgtgggataaatgtagctgccactgggtagatattttatgaaagctttgtttattatagtatttcttttttctaaaacaatgctgcttagtggagggtaggctttataagagtaggtacatgactagtcttttgctgcagtgatttagtttgtgatgatccacgtcatttttgccacagtgtacaatagctgctgaaggccacccttgtctctcacttttcattattaaaccaaagcaaactcttctgatgaagttagaatacatttttttaagttagtcaaatgtggacactataaatctaacctctagtactatggataggcaatggaaaacatcttgaaatgttaatcctaaataaacactaagcaatgtttaatgtttaagattgatgtcattgactatgcttagctgagaagaaaacatgtgattaaccaagggaaggacttaaaggatatgtaataattctatatcaccactagacatttaaatttcacaaagaggttcaacaacttgaggaagctactgctgcctttgccacagaaccttctatctcaacaatgaaactctatctcattgccctctatctcaacaatgaaacttaggagacttctgatatgacacattgggagatcactttatgttggacactcaaaatagaaagcctgaaatggtaccaaaattgacagctctaatacacaagggaaagccctaccctgtgacactgtaatattaaagcaagcatcttttttaagataaaagtaccacacagtggaaggaaagcaatgaaacatctgcagaccctgagaacaaaagaactccaaaatcgccaacagataatcagtgcaaagtgctggagccagtataaaaatgcagagtccaatttgcaaaacaaaactactgggagtagaaaccaacttgggaagaagataggtaataggggtaaaaaaaaagaaggaaaaggatgatacaagtggcagactagagaagaggagccagatgtcaaaaagtacatggccaaaccaatcgccactttgtgaaaataacgagaatgtgtgctagagctatgaaactagaaatctatcctatatataaacagataaaattggccaggcacggtggctcatgcctgtaatcccagcactttgggaggccgaggcaggcggatcatgaggtcaggagatcgagaccatcctggctaacatggtgaaaccctgtctctactaaaaatacaaacaaattagctgggtgtggtggtgggcacctgtagtcccagctactcgggaggctgaggcagaagaatggcatgaacccgggaggccgaacttgcagtgagccaagatcacgccactgcactccagcctgggtgacagagcgagactccatctcaaaaaaaaaaacaacaacaaaaaaaaaaacggatacaattagaagatgaaaagatagaaaattttaataataaaaaataaagagatatggagcattcaagagaaagggataaagaagacaggtaaagagggctcaacatatgtataaaaggaattctgcaaagaaagaaacagaacaaccactgaaaactacatattgactcaatttttttttttttttgagatggagtctcgctctgtcacccaggctggagtgcagtggcgcaatttcggctcactacacctccgctcccaggttcaagcaattctcctgcctcagcctcccaagtagctgggattataggtgcatgccaccacacctggctaatttttttttttatttttagtagagaccgggtttcaccatattggccaggctggtctcaaactcctgacgttgtgatccacccgcctcagcctctaaaagtgctgggattacaggcgtgagccaccagacctggcccacattgattctatttttaaaaatgagtaaaagacttgaatagacatttctcaaaagaaaatataaaatggtcaacaagcatatgaaaagatgttcaacatcattcatcattagggaaatgcaaatcaaaaccacaacaaggtatcacctcaccctcatcaggatggctatcattaacaacaacaataacaaaacataataacaagtgttggagaggatgtggaaaaattcaaacccttatagactcctggtaggaataaaaaatggtgcagccactgtggaaaacaatttgtctgttcctcaaaaaattaaaattaggattgccatgagatccagcaattccacctctggatatatatcgaaaaaatggaaatcggggtccaagagagatatctgtacacccatgttcatagcagcactattcacaatagccaagaggtggaagcagcccaagtattcactgttagatgaataaataaaatgtggtatagacatacaatggaattcagcctttacaaggaaggagattctgatacatgctaaacatggatgaatcttgatgaggctaagtgaaataaggcagtcacaaaaggacaaatactgtatgattccacttctatgaggtatgtaaaataaccaaattcatagaaacagaaagtagaaggggagttatcaggggctgggttgggggtaaaagtttctcaagatgaaaaagttctgggggttagctgcacaacagtgtgaatatacttaacaatattgaactgtacacttacaatggataagatggggccgggtggctcacatctgtagtcccagtgctttgggaggccaaggtgggcagatatcttgggtccaggattcaagaccagcctggtcaatatggcaaaacaccatctctactaaaaaactacaaaaaattagccaggcattgtggtgcatgcctgtaatcctagctactcagaggctgagacacgagaattgcttaaacttgggagacagaggtgcagtgagctgagatcatgccactgcactccagcctgggcaagagagcgagattctgcctaaaaaaaaaaaaaaagttaagatggtaaactttatgttacgtgtattttaccacaatttttaaaaattgaattaagctgaatatactgaaatatactgaaaaatactgaatatactgaaaaggtacatcacatacctaagaaaaacaatccagagaagccataacaagacatattctagtaaaactattaaagaagaaaggataatgggaccacaaaatcataagagacttccagcactatttgttatgcttcaatcctttagagggaaacaactgtaccatgaagcacataagaaaagagttatatttttcatcataagaggtgcataaatgaggatttgttatattatcctctatactggtctatacacttgtaatatttgatcacacattcccacaaacgattcagggaacctactggctctgttaaattaaactaaatttgggctgaggaggtgcttgtgtaatgaactgcaacttaacttagtatgcaaactaatggaaagcctaactcaggaggatactttgggaacaaattgctgagtctcaggcaatcatagcagctgagctccagttaactgcaggcagcaggacaactgttccaatcctgttcatgtaagacgaacactgagccattaaccatcagctgtctctctacctcacttctgtttctgtacctcacttccctgctatccacaaatgcttttagaccacgttgcagccctggagttctctgaacctgtccctggttctgagggctgcctgattctagaatcacaaataaaaggcgattaaaatctgcaaaactagatttgttatacattttttttttttgagacggagtctcactctgtagcccaggctggagtgcagtggtgtgatatccactcactgcaagctctgcctcccaggttcacaccattctcctgccttagcctcccgagtagctgggactacaggcgcccaccaccacacctggctaatttttttgtatttttagtagagacggggtttcaccgtgttagctaggatggtctcaatctcctgacctcgtgatccgcccgcctcggcctcccaaagtgctgggattacaggcatgagccactgtgcccggcttcattcatcttttagcagtttccataattcaagagttcacagactagtgctgttgttggggcaaaacttgagccaggagctcaatatcacctagtcccaattcttcttcaccttctgctctgcccagttcatccctggactcctcacagaacccctcaggctctcctatgaccatgattaaatgtctatagcagtcccagcctaaatcctcataccagagtaagcaagggcattgcttctagaaactcccattcaggctcctggaactccctctctcaggctgactgaaattggctcctgaaacaatctctgtgtcaagacagtgagattcaatgattcagagtcagagtgagttggggtggagtcaatcctaagaatggaaaagggaaactgaggtgaatgaaggagaaatggattctgtgaggcacccacaacaaggacagcagagaccacagttctggtggctgtttcttaccctccagacactgtccctctgctgagctccttcaaaccctccagacatgatcagactcatctggacttactgtggggacatatctaggccccgactctgtcaaatatgtatagtgacttccatctaaaaggcacaaggttctttacagataggacaaccttgatagcactcatctgagaaagagaacaaattagaaataatcatccttcacttcctaacactcacacaaaaaaaaacaaacctaagggaaagcaagtgcatattaaaacagagttgatcaccaatgagcaagtcctaccaaagatggcagagaagctgaaaaggtcctctaggaactcactcaataaatgctcatttattccatttattgcaaagccaagaattgtaaataatttaactcacttaggaaaggatcttctccattattttatctgaatgttatctgatcttgatgttctgaagtctgacagttaccaaagcgagtaaaaatcctcatgttttccatgctaggaaaatcattaatagtttatccaaactgaaactttcttggcaactgttgcttccttgttcttgccataaattaactgtttttaaaaagctaaaatctaaagaatttccaggaccttaaaaccattagaatacaaagacactctaatttaaataaaattcataaccaaaagttaactcacctaaacacaatgtttccttgtgtcatttatcttctttgaagcccaatcaataacagattcattcattcactcacgcagcaaacatttagtaagtgctctaaatatacctgaagggacctcacacatcatctttcctgagctcttcctttacagattaggagattgaggtcaaagagagcaagtgatctgcccacagtcacacagcaaatatgagaatccatgggtgcaatcagatttcctcacctctggcctgacacgttatccaccctgccatgtttccttggctacagcaggccaatgatgcaatcggcctccagcagagaacactactgtagtaaatatcaatagctgtcaaatttatggccacacaacatggtttgaacacccttcctacaactggaagatctcccatatgagttccttctcctgaaatgtagaggcaaaagctcatccaatcctccctgcagctagagctcaggcatatggcttggctttgccaatcaggggagcagtgtgacgtagtgggcacaagcagggtaggcagcagtggcaaagcttctagtgtttgacctgcagggagctggcacttccatgctgagcgatggtcacagagctgtcttcacttgtcactgcccatcggtgagatttgggcactgatcctggctatatagaattctgtgaaactggctaaaatggactctggggtggggattgcatctaagaaccctgacctctgtgcttcattattacgtgctcaatacatatgcctggagctatatacaaaataaagggagcctctgctcaaaacttcactgtgcatcataagataccagttctcagctatctatctgagtcttaagactttttaaaaactaaatggttcttttctattaaaaaataagacaatgatgggactacttcacttttaacaatatatgctgaattatcaaatgcctatttaaaaaaaaaaaaaagatcaagaaggtggcagagcaaaccccagtattaaaatactccttcaccaaaatccaacagcaaagcaaagctggtcctcgtggctttttggaagcaagaagcaagggagaagcaagtaaacaaaaccctgaaccatttccctaacagctcccatcttaaagaataacagaagggaaagagctgaaggcagcctccagagaataagtagcattttccccaaaaccttcatgtcatctattttttccagagatggaaaaaatgctgtgactccctgctggaagaaaagcaagaaacccttccctgtggttacagatggtaaatgcttaaacgtgacaatgtcaaaggaacagtctcctaaattggacagcatggagtgggaaatggaaagacacataagggccttcctttcctctccccatcttgatgagcagtcctcaagatatggcctaaaattcataaacctagaaacagaggcggcctgagatttaaagtgaaaatgtagccaacaacaaaacaaaaaaactcgggagacagaaggggaaatgtgataattttttcatttttcatagcaagtgaacaatagatataatttaagagttgctaaatcaagaaacagaaggttatacataacaaatatacagagttatatgagtaaccactggaaaaactaaaagtagactctaaaccgtccaaagcaccagaagggaaacagtacacgcacacactcaaataacaaaaaggaaagcagggcaccagagtgtacacctgtagtcccagctattcgggaggccaaggtgggaggatcacttgagcccaggagttcaaggccagcctgggcaacataacaagaccccatctctaaaaataataataataacaaaaaacgaggaaaattggcaacagaaaaaaaccccacaaactagattataaagaattaggacttaaaacatctatgataacaatagatgcagatgagagaaattattattattattggaaaatgatatgttacacgtctacaaaacaagagaatccaatttttaaattattagaaagaattagaatagttagcaagttgactgtttgcagaattttaaagtacctttttcctataaacaagcaaaaccattgagaaaacagctgaaaagaccccactcacagtaactcctgaaaagaacggcacatctgaactagatgtgggcagaacctacatgaagaaaactggaaagttctccaatgaggcaaaaaggagaaattaaaagtagcaccatgtgcttggattggaatgtttcatactgtaaacttggccgggtgtggtggctcacgcctgtaatcccaacactttgggaggccaaggcgggcagatcgtttgaggccaggagttcaagaccagcctagccagcatggcgaaaccccgtctctactaaaaatacaaaaattagccacttatggtggcacatgcctgtaatcccagctgcttgggaggctgaggcatgaaaattgcttgaacccaggaggcagaggttgcagtgagctgagatcgcaccactgtactccagcctgggcaacagagcaagactctgtcaaaaacaaaaacaaaaacaaaaaaacctgtaaagttgttaattctccctaaatcaattcataaatttactgcaaaccaattaaaataccaggaggatttgggaacttactttggaactcagcaaaatgatactaatagtaatctgaaaaaaaatacacgagaattaccaggtgtggctgtttgtattttccacatgcttttctgcagtgtgacccttgtcttcctcccatcaagaggtagggcctatgtcccctccccttaaatgctggcaggtctgtgactgcttcagccaactgagtacagaggaaatggccccatgagacttgtgagcctaggctggaaaaagcaagcagtttccacctagtgttcttgggatactagctctgggggaagcagccatcatgtaggaagtccaactaccctgagaccacagtgctggaggagctacaagtatacacgtggctgaggccccagctgccagcaggccacaactgccagccatgtgagtgggacgtctgggatgtcccaccctgtcgagtcctcagatgagttacaaccccagctgatatccaacacaatcacatgagacctcaagcaagaatcacccagcagagccgttccaaattcctcaccaacaagattataaacaaaataaaacacctgttttaaactgctaagtttgaggataacttgtgatgttacaacagtaactggaattccatttaaaaggaaggaagggggccgtgcacggtggctcatgcctgtgatcccagcactttgggagaccgaggcgggcagatcacaaggtcaggagtttgagaccagcctgatcaacatgttgaaaccccgtctctactaaaaatacaaaagttagctgcgtgtggtggcgcgttgcctgtaatcccaggtactcaggaggctgaggcaagagaattgcttgaacccaggaggcagaaggttgcagtgagccgagatcacaccactgcactccagcctgggcgacagagcgagactccgtctcaaaaaaaaaaaaaaggaaggaaggaagtgaggaaggtaaggaaggaaggaaaggatggagggaggaagggagggagagagggaggaaaggagggaaggaaggaaagaaaggggagggaagggggaaggagagccgaaggggattggccctatcacatttaacaacataatgaatcaaaatccattcataaattcattgaacaaatattgaagatctacaggtccaccacaagctaggcattagagagacactgtgttgtgcaaaatctttgtctttatgggatttagattttagtgaaaaagaaatttcagatagtattaagtgtgctgaaggaaaataaaaatcaggataagagaaagtgctgcttaaaatagagtgctcagagaggcctcttggaggaggtggctgtggcgctgagccagggaagggcccgggtattctcacctactgctgtggggttttgcaaacggttcagcctgtccttggggcaatttgaaaaatctatttccatctaaaaggcatggacctcttgacctagaaacctcttggctaggaaattaccccatgaacattcttacacacgttagcaatacttccaagtatgttatgacaaaaatgagatacacaaaaatgtcagctcaatgggagcttattaaataaattacattatagtcattcaatagagcaccataagactttttaaaaattacatgagctatatccactgacaaacagctacatgagacactgttaggtgacaataagaaaggctggaactgtgtgcacagtatctcctcttctgactcacagagagagaaggaaccggggaagagggaaggatactcatctatgatctggaagaaatccccctttcctcggggaacacctctggggagaggagagagatttgggtttttcatttggtacctctccgtagcacctgaattttctaacaagatgctgtacaacttttacttttgtcctttcaatgcccgctagggttacctggaccatgagtcagtgtttgacagcttctccccaaagaaagaattggggctactagaccggacaaggttggttttctcttttggtactctgtatttccaaaaataactgaatggtatttttttaaataaaataatttgaaagaataaagccctataacaacaaagtattaaactgttaaaatattttcattctattgtaattataagaaagcctgcatggtcccactgcagcagccaccatgacgagcagcactctctgtaaatgcagcccttccacgctgctcagggtgacccaccccagtgagctggctatttgcatattcccagatcccccacctgcgccaggcaggcatatgctagatcagctcagaactagaaaagatgggcaccaggaagaaaggcaccaagccctccctaactcccctctgagagttgcatccttctttcctacctctttcctttttacagagcccactgtgctctgggtcccccatgacctgggggtcagagtcagacacactcctgtgcacaaatggaaccattcgttcttcaccaccacctgtgcccacacccctgtcaaagctcccccgcacccacctctgaatctcccgcatgggtaggacagcttcttcccgaagaaggggaattcctggccaggcacggtgctcacgcttgtaatcccaacactttgaaaggccaaggcaggtgggtcgcttgagcccaggagtttgagaccagtctgggcaacataacgagacctcctctctacaaaaattaaaattaaaaaattagccgggagtggtggcatgccagtagccccagctacttgggagactgaggtgggaggatcgtttgagcccatgaggttgaggctgcagtgagccgtgatcctgccactgcactccagcctgggctgtagagagagaccctgttggaaggatctctccgacagttatctcctggataactgcaatgggtcaagtgacaactttctctagctctcctaagccacagtgcagtacggtttggaaacagcaataagagtcaatcccccttttcacaaatgatcaaatgaggctcagagagattaaagaattaggcagtcattcttcacaaggaaggaagggagggagggaggaaaatttcttgtgaaattcccaaggaacagagaacatttttaaatgtttccttactcattagttaactcagtattttcatgcccaaaaaatgtcaacaaccagttttgccaagaataataaaaacagatactgactctgagcctttcttgcaagatctctcagggtacacacccggctgactcccgcacatttctgtctctcctgccttctcaaatctcgctgtctccatcagtgtctcttcttccatgcaaggctctgtcctctgaagttctctctcccctggcttcagccccatgcaggtgccccccccccgccccacatgtggattcagttccccacctgtggtccccatgattgttctactccaactccggctctcatcacccaccgccagtgtgactggggcacaatgtgactgggtgcaggatggggcagccacctcaggccccagagcgctccatcccatggccaaaggggtggatattccgccctgaaacacctgggagtgcataatgctcaaggtattccttcttcgaagctgataagtttgtctatgagcaaataatccactagttcctctgcaaggggactgcctgacttagaaagaacacagatgtaaaagattagtctttctcaaacactgccggtcatgtgtcagatatctagaacagcccctcaccagcaaacctggctggccccagccctgtctcaggcccttgtgttaatgctgggtctctggcccaggctcccctccctgcctgatgagttcccactgtgctttcaagggctctttcaggtgaagagacttagatcaataccaccttaggtgacccgaactttgactctccctcagggagcagcgacggggttttagtgtcttctctctgacagcccaaagcgcagatgccagctgctccacctcattcccagggacgagctccacagttgaggatcccagggagcagagcaggggttgagatgcaaacaattctgatcacaggcccctctctccaccctccccaaaagtgccacctgctgcatctacataattctgagagcccattcaagagaccgctgctggaaccaagaagctagttatctggatgatgtgggtccccatcggagacacgggaggggagaagtggtgggactgcttcatacccacacccacttcatgtttgccctagcaggcactgtgtagcactcatctggggccaaaaaggaataaatgacaacttgtttacagaaactgtgttgtaaaaatacctagtgggaccttgtttcaccacctggatctttagggaggtgcccgttctccccttcgagctcagcctgcccttaccaagttcctctgtttcccctcactgggaactctcaggaattgtcccccaacattattcccagaaacctgtgccaaccgctcatgcctatcttggagcatcacactatcagatacctggataactgcaatgggtaaagtgacaattttctctagctctcctaaaccacagtgcaatatggtttggaaacagcaataagtcaatcccccttttcacaaatgatcaaatgaggctcagagaggttaaggaattaggcagtcattcttcaatcattctacaaacttttcttcaacacccacctgtgccagcggatacctgcccctcataaaatactcccctccccagagatctgggggtggggtttcttgctcctggaaacaagggaaaaaggagagaaagaggtgtgagggcactcagagaggagcagcctgtcatcatgtgaacactgcccacgctgcctagcaggcctctgaagccaccccacgggagaatggctctgctgtttcccacgcctggggtctccctctcccactccagcatcctagcccaccaggtaggatgagtgatgctacatggacttccaaacatgcttaatctctgcagaccatggcacaggcccgaagctggcccgcagcacccaggctcagtacatgcccgccctcttcacgacctcccagaccagcccggccggtcacccatcttctgcacacatccctccccaacctcccctcaaacccttcacccaggtggggcttcccaggcaatctccaatctacggctgaccctgaaaaacccaggtttgaattgtataggtgcatttatacatggatttttttcagtcaaagttacaccaagtgtgccagcctctcctgactccctctgcagttgaaaatccacctcctccacctcttccttctctgccaccctgacacagcaaaactaagtcctcctcttcctcctcctcctcagcccactcagtgggaagacgacaaagatgaagatctttatgatgatccacctccacttaatgaatagtaaatacattttctcttccctatgattttcttaatgatattttctttcctccagcttactttatggtaagaatacagcatataacgcatatacaaaagatgtattaatcatctatttacatttccagtcaatatgaggctattagtagttacgttttggaggagtcaaaagttacacgtggattttcaactgcagagggagtcagtgcccctaaccgtgtactgttcaagggtcagctgtacaaaatgaggacaagacgtagtacccattccccagggtttactgctaggcttaaataagttgatatgaaacactgttagaatcgcgtctggcaaaaaaagtaagcactcattagttcttgtgatcgatccagttacagtttcacatacagatgactgtacccacccaccagcactcaccagagggggcccttggatctaaacagtgtggaagccacgcctgttcccctcacctcacacaggcctgtgtgcaaggtgactgagcccccctggatttctgactaatcatctttggaccaccagcaggtaaacaactctcccctcctgtgtccccagaatgcctcagcagcattagtttcctattgctgctgtaacaaattgccacaaacctggtgacttatagcaacacacagctatcatcctacattctggaggtcagaggtgcaaatcagtctcactgggctaaattcaaggggtcacaagcctcgatcctcctgggggctccaggagagaatctgcttccctgcctttccgggcttccagaggccacctgccttcattggctcataactctcttcctcacatcattccagtcactgcgttcatcatcccacctcctactactgactcagatcttctgtctccctctcaggaggacccctgtgattacacagggcctgcctacataatccaggatagtctccctctctcaagatccttaaccgaatcacatccgcaaagtccctttttgccatgtgagacacagattcacagcttctagggattaggatgtggacttctctgggggaccacagttccatctaccacattgacctaacccatattcaacctacccagctttgctagctcttagacgttgggttagtcccaatacctggtccacaaaactggaactgaatatgacatttcacatttgcatcataaagattctccggatgctgtgtgaaggggaaattgagaggacaagagcagaagtggagaagccacttacggggctaccagaataatctgggtaagagagacacagcaggcagaagtctgtatttttgaagaagaatcagtaggatgacaagaggctacgttaggaaggaccactggtgtctggttggaggaactgggtgaatggtggttccactccttgaaaacagagcagaagacacttatttggaggggaaatgagcaacttggttggggatatcctgaattttaagtgtctatgacttgtccaagtgcagatgtaaagtcagcaatagggtatgtcaagaggagagaggtaacagcttcaaatgcagagacctgtgtgagtgacagaagtgtccagtggggcagagagagagaagcctgggcccaggaatgtcctcctgctgaccagctgcagtgaagctccgctggccccatctctcagtgtcagccctgcccttgctgtgtccactgccagggtgtcccttgcaggggcactcactgcacagtcatcattcccagggagcatggccacttcaccttgctgctccgccacacctctgttttgggcggccctgaggatgctctgagactgggctacagtctccacaggttccagctatggatgtctgccccacagcctcatctagggaggtctgtttgcccaccattgagggccctgtggcagcacctggctcttccctctctgctatgttcaacatgtcccacagcaacatggaaattagcaaatgtctttattccacacactgtccatgggaaatttcagacccaatcttgtagaccagaggtcaacaaactatgatccctaggccaaatctggcctgctgcttttgcaaacaaagttatactggaacacagttatacccattcatttataaatggtctatggttgcctccacacaatgatggcagggttgagtagttgccacatcactaatcatcagggaaatgcaagtctaaaccacaatgagatatcatctcacacctgttacaatggctattctcacaatgacaaaagacagcaagtgttggcaaagatacggagaaaggggaacaatttctctgctggtgggaaggtaagttagtacagccattacggaaaacagcatgaaagctcctttaaaacttaaaaatagaactatcccatgtagcaattccacctttgggtatatatccaaaggaaatgaaaccagtatgaatgaagaaatatctgcacccccatgttctaaaatgaattcataaatccatacatatatacatacatacataggagagaatggaaaagctcttcctacagtagaataacaattaataaatgtagaaggaatgggccgggtgtggtggctcacgcctgtaatccccgcactttgggaggctgaggcaggccgatcacgaggtcaggagatcgagaccatcttggctaacacggtgaaaccccatctctactaaaaatacaaaagaattagccaggcatggtggcgggtgcctatagtcccagctactcgggaggctgaggcaggagaatggcgtgaacccagcaggcagagcttgcagtgagccgagactacgccactgcgctccagcctgggcaacagagcgagactccatctcaaaattataataataataataataaaataaataaataaataaatgtacaaggaacggaaatataaaattatgacttggcaatcatcgtagaggaggctggtttgggtggcaatcatcaacggatgtgaagttgaaagagagaggtttgaccagaaacaggatattggcataatctgagacttccttacacaaattataattaaaggggaaatggtgaatttaaaatgataacacctggaggacagcaataatgttaggtgatcaaggtgaatatcgccaatggtgagaagggctgacatcaacgcctcctgatgcgatgcactgagaaaagcatggcatcaactttgggattgtcctgccaagaatgcatgagccaagtctgcccatgaggataatcagatggatccaggttcagggtcatcctacagaatgcaaggcctgtgcccttcaaaactgtggaaaacgtgaaacagagaggaaggctgaggagagtgaagacacacaaggaatgctcatgttcctgggtaggaccctgggccagagaggaaaaagaaacactacttggtcaggtgatgaaattggaatggggtctacagattggataacaatgttcttccaatgttgttttcctaatttggagaggtttatgatgagtacataaagagcatccatgagtggtgagaatatacactgagttttttaggggtgaagcaacatcatgtccacagctttctcccaaaacactgagaaaaagactaatgataattgagaatttttttaccttgagaaagacaatgtgcacaagctcaagccatggggtaaatgcaataacatgtttacaattcgggaatttaagagaagagacacaggaattcttggttctgttctgtaacttttctataagttagaaattatttcaaaaaatttccagaaaacaatattaagacagagtttcattgtttattagcatagaatttggctatgagcattccagtgtactatatcttcaaatgactaggactttttacccgatgcccaagggagggttctgtctatgtgtgtgtgttgttgttggttttttttggtgtttttgttttgtatttgtttttgtttttgtttttgagataggatttctcgctgtcacccagactggagtgcagtggtgcaatcgaagctcactgtggcctcaacctcccagactcaggtgatcctcccacctcagcctcccaagtaggtggaactacagctgtgtgccaccatgcccagctaattttttgtattttcagtagaaacagggttttgccacgttgtccaggctggtcttcaactcctggctcatgtgatccacctgcgtcagcctcccaaagtgctgagattacaggtgtgagccaccacgccctgtcaagtttttctccttatctttaaaatccattattttacagggaaacatgtcaatgctgactattctacattgatttttcccagttacacaatgtaacctttcaaatcttattttaggaaggttttcttgcattatagttctaaatatttatgctattctattgctttgtttttctgtccctggacactaattatacatatattgaacctcctttgcctgtgtcctacattcctttaattcactatatcaccttcttttttttattatttttctccttttcaccctctatttttatttctgtgcttcctaagaatatctatttgctcccatgttccttctaattaagtcttcatttttgaaactcatttttccaaattcttttctgacatctctctgttctcctttcataatttcctgtcatctagccatatcttttgtagtttttacaatttctgattcaggatgggagcagtggctcgtgcctataatcccagcactttgggaggccaaggctggtggaccacctgaggtcagcagttgaagatcggcctgctaacatggcaaaaccacgtctctactaaaaatacaaaaattagctgggtgtggtggaaagcacctgtaatcccagctactcaggaggctgaggctgaggcaggagaatcgcttgaacccgggaggctgaggatgtagtgagccaagattgcttcattgcactccagcctgagcaacacagcgagactctgcctcaaaaataaaaataaataaataaataaataagtaaaataaagtttctgattcatactactcttaggaaactttattttcttttagcttatattgaaatattaatttataatttttctggtgtgctctcattttcagtagtaccattatgttcattttcatcatgttttcactgaataaatgttgcatgaggctggatcgtattccttttttgttgtccatgattaaatgaggtggattttcctgatctattaggaggaagttcccaatagatcaggaaagttcctaataaagggatggactaggatacctttcccatttggctctactgatctgtgaaagactcaaaataggaattctccaggtacccacttgtttcccagcatcaagtccagaacctttgtaaagctcagaaagatctcttgcctctagtcctttgctccagctctagaactttgaagtccttcttttccaaggctatatgctctcagcttttgatgttatctttcactgttaaagcagtttttgagatctttttccttgggggtccccttccatatctccaccatctgaacctattttctctcgccatctgtcttctgcttaacttggtgtatgtttccagtaatttctgctcaaggtgaggtgcttagaagggaggacttactgtacgtttctaagattctccaaggcctctgccaccacatcgacgctgattctcccaggtccacacacagttagttgctctcacctgttgccagaagcctgggagcccctttccagttttgccagttgctctcaggtctgcccaccagacttccatcctactttaaagggtgagcagctcatggtagtttttgggttccaccacctgtcaatagtttctttcatttcccatcactcccctgaggccactgcggctcttctccaggtccttctgatgctggtggtttggccaaacccacccagtcctgggaataaaggagtggggagagagtccccaacacttttgttgacatatcctctttgagctttatctatggctgtcttgctgattggtttagcttccaggaagagttcaggggagactgaaaaactactttgccaccatgaatacatccccataaaacatgttctgaagggcataaaacaaggaacaaagaaatgaagagacatactctgtttctgaattggaagatttaatatgataaaactgtcagtactcccaaaattgatgcactatattaaaagttttaaagttttctatctggcaagacatcaaaaattaagcaaaatgagaaaatatttgcaacacataataaagtatccatggaaattcagatccaatgaaatatctttctgcttctatgaaattaataaaaatgctcagccttgctaatatcccacgctgcaagaggacagaaaaaggggcacacactgtaggcttctgtgggtggatgtgcctacattcttttgtgaaaattaatccagaaatagctaacaaaactcccaatttgaatactcatcagctagcaattccactttggggaatctatcctcaaaaaaaaaaaaagcagtggcatctcaggctggataagcagcactgtttgtagacacatagaactggtagagattattcccagcaggagaataactgaataacttgtaataattcatactttggactactccacagccattaaagataatgtgttaaaaaataataataatgagttatggctgggaatattcgttatacattaaatttttaaaagaagttacagagtaatatgggtggtataatgtcatttttgtaaattgtttttaaaaagaaaagaaacattttccggccgggtgcggtggctcacgcctgtaatctcagcactttgggaggctgaggcaggcggatcacgaggtcaggagatagagaccatcctggctaacacggggaaaccccatctctactaaaaatacaaaattagcagggtgtggtggcgggcgcctgtagtcccagctactcgggaggctgaggcaggagaatggcatgaacccgggaggcggagtttgcagtgagccgagatcacgccactgcactccagcctgggcgatagagcaaggctctgtctcaaaaaaaaaaagaaagaaaagaaacattttccatacatatatatacaaattctaatacattttatgattgtaaagggaagcatggaaggattgcattaaacaacactggtaatgttggtggtctatgggtagagaattggggtaggcgaaagctatacattgtttgtgtgtatgtgtgtgtatatatattttttgtttgtttgtttgtttgttttctgagacagagtcttactccatcgcccaggctggagtgcagtggcgcgatctcactcactgcaagctccgcctcctgggttcacgccattctcctgcctcagcctccagagcagctggaactacaggcacctgccaccacgcccagctagttttttgtattgttttttttagtagagacaggattccaccatgttggccaggatggtctcgatctcctgacctcgtgatccacctgcctcggcctcccaaagtgatgggattacaggcgtgacccaccgcacccaacctattttttttgagatggagtttcactcttgtcccccaggctggagtgcagtggagtgatcttggctcactgcaacctccgcctcctgggctcaagcaattctcctgcctcagcctcccaagtacctgggattacaggtgcccaccatcacacctgactattttttgtatttttagtagagacagggtttcgccatgtgggccaggctggtctccaactcctgacttccagtggtccgcccgcctcagtctcccaaagtgttgggattacaggcatgagccaaccatgcccagtcacttttttatcttcagttatttttactttttatatattaatttcagagtatgaaaaaaatccagtggagttgctttttaaaggaaaaatacacacacacacacacacacacacacacacagagtcagcttccaatggctacgtctttaccaacatatgtaactggtaatgtggataactcacaatgtagctgtttgtccctgagttctgggcattaataaaatctccaagaaaaataacaaactactctattaaaggataactattcaagacctccatccagctctcttagtcttctaaactatgaacacagctcattacctctcaaaatgggcaggacatctatccacaagggaactgatccacctgctgactcactggctggcacagcccggcacaggaaaaccacctgcagggggtcctcaaacaatggaaactgcacagctctgtattcatcacagacctccggccaggcctgacacccacccctgtctccaaccttgccgagtcctcccctttcaaccttaaacttcttcaacttggtccagtggaatggctccttaaatttctcttgtatcttcacctttccaggcatgttttatgcttttcctaagaaagagagagcctccttgctaaagtggacccctttaccagcatgctttatttcatccccttctgcctaatcgttagcaggagtttggcctctaaaaagtcagagcaactaagttcaaagctacttcatagctgagtgaccttgggtaagtcactcatccctcttccccttagtttactcagcagaagcaccaagatttcttgaggctttggcttggaacagagtcaggctcagttctgctgtgttccaatggctaaggcaaatcagaggcccagtccaaactcagggagagggaaccacacaaaaccctgagcaccagcaggcagaggccaccagagtaacaggctattacacacacaataagtaagtgctcactaagcatgggctgtctgtcttagctaataattttgtttcttaaatccaggagagttgtttctacaatgggttttcaccatgtgcaaaccacagagagggcctagaaagccatatgttgctaaagagcacataggtctcattttagaagatttagagaaaccagagggcagccctaagccccacagtatggatttctttatgaagccagcccagccatcccagctgccattcttaaatgacgaacaaccttggcaaggcagttgcaccaatctcagagggcaggcatatatatggcaatgggtcagtgttccccactcacaaccatgttaacatgcaaacctgtctcaacacagcaggaaccaatcatcatttctgcaaagtgttgtagacaacagatgaaaaatggtatacactgtaccgtactgaaagaactttcaaggtgcttgcagcaaagtaagtttgaagacagaaaataagcccatgaaaaaacagacaggagggtgggagatggaggactcaggacagaagtcatcttataatctccaaaatgtaagcagagtgtgctgtgttcattgttgatccccagaccctagagtaatgtccatacataggagaactgtgtggaattgctcagaatcataggaagctagaactaacaggttataggtcgggcacagtggctcaagcttgtaatctcagtgctttgggaggctgaggcaggagcatcccttgagataaggagtttgagtttgaatccagcctgggcaacataacgagaccccatctcttaaaaaaaaaatgtttttagtattagccaggcatggtggtacacacctgtagtcctagctacttgcaaggcagaggcaggaggatcgcttcagcccagcagttccaggctgccgtgagctatgatagtgtcactgcactccagcctgggcaaaagagcgagatcctgcctcttaaggcaaaaaaaaaaaaaaaaaaaaaaaaagaataggttagagctgttgaagagaataacactgcaaaagcaaactgaattaactgttttacacatttatttaactctttaaactaaaatgtaggggatgatgtgcatttttcacataaataagcttttctactgtgtccaattaatgttttcccctttaggtttattattaaaaggcagttctctctccacacccttgggaacccaaggctaaaccaggaagggcgggctcagggaggagccaggaagtggagctaattcaccagtctgccacctgtaggctggttccagcagacttaaacctcagtgcccgctagacagacatgaaaacaatgcatattaaataatggtaaaaactgagcaatagatgtgtgaaaactatatagagaggggcatttaaatcatggctcccgtgtgcttgcctccaacctcctctcttttctttgaatactcccagctatgaccacacagtctgttgttcctattcagctctccaaggctcacccttgatctaaaatacgcttcgaaaattaatactcccattaggatgaacaaccacacctgtatcgatcgaggtgttccagaggcaattttgctcagatcttatggtaaaagccatgcaatgaacttaaaaaacaaagaccattatgaaataaacaaataagcaaagctggacgaatttttcaaattttaaaactcaagaacaaatagcaaacattagttttaaaggattggtttggatttctgtagatggaagtaaaacatactgagtttacaagcctatgcgatgtatttcagcacgatccaccaaatgcagttacagatgtcaagagttctcagaacaagtgcctctcttcataaatatctgctctgcatatatatctctcccattcccataacgtccattctttgttaatataggaaaaaaaccgactttcatcaaaatgctacaaaacgccaaaaattaactcttggggacagtcactttaatcgagacgtctttcttctatggagatttgttcaccactggcttctctgatttggtggttaagagtctgaaaatcggtcatccttaaggtctggagctcagaaagcacgccgcccccccttgcctgccccctgccccaggacgccggatgcgggtcgcctgcccagtcccgtcgcccacaaaccacgccgttctgggcggacgcgggaaaccagaagtccccgaagccaagtcagcgagcgaccacaggggccgcccggccgatccccgatatccgggctgacccaaaacccgacgggaggcgcccctcccccgcccccccaccccaccccccacccccaccgcccccggtcagggccgccgcgagggtgagaggcgcgcccacatgctgctccgctccgggttcggctcccacctcctcgcctcggccgcggccgctcggatggcgaggtcgtgtccccggcgcgcgcggtccccggcgctccctccggccgctgcgggctcggaggacggcgggcgcctggctgctgtttcctccaagaaaagtaactccgggaatcagcgcaataggagcgggaacgcgatgctccgagagcggcgagccgggccctggagttattctgctcggagtttcgaactgcgccccgcgctgcagctactcggccccggcgttggccgccggaacttgccgcccgcggtggcgtcccggcggccgcagcgcctagcccccccggcccgcgcagtccccggagcccgtccccgcctggtcgcggacactcaccgagaagcctgcccagaaggggcaggagtggcggacgcgggccgaggtggtgagcgccagcgcggcgaagctgactgccacgatgaggcatccgagcgccatctgcgtggccccgagcgccagcacgatgcgggagcggcccgggcactcgcgcaggcgggacaggctgcggggcagcgcggcgggacgcggcgctcgggggccgccggccggaggcatcgcgccgggcgcccgcacgcctcgcccgctcccgcccggcccggcgcgcgccgccgcctctcctcacagagggtccgaggcaagttgcgccgggtgcagggacggcctcccagccggctgccagggctgcggcggccgcgcgccgggagcgggccgggccgggcggggagccgggcgcccgcagcccccgccggtgcccgcgcccatgccgccgccgccgcgccgcccgcccgccggccgcgccgcgctgcgccctcccccgcccgccccgcgcgctccccggcccgagcgcgggcgcgagccgccgccgctgctgccgtaccgggcgcgagccgctgccgtccccgggcgcgagccccgccgccgtgcgctgggccccagctggggcgggagcgggagccgggacccgggagccgggagaggggcggggaaggcgcaggtgcggtcctggcgtcccagcctccgcgctcacgcctcgcgccctggcggctgcaggtctgcggaaggagagcgggggcggcagcgcatcaagggcaacggcatcagcctccgcggcggagccctgggtcggctgcgcggaggggcccgatagcggcagcgggccagccgagccttcagagcctggggacggctcgggatgggcgcgcggggcgctgaggacggggagacgggctgggagcagacaggagggaaattccgagcgctgggccgcaggtgtggcgaacaggagcctcttgaatgcaaaaatccaagatccaagatgctgcttttctgcagttcgagaatctcccaagccatccgctgagagaactcagctctggaggacattccgagaacattgccaggacacacacgatgtcccttacccacctttggtttgcatgcttttgatacaagttaaaagtttgggctttaaaaaaaaattgcacaaaacgaatttaaatgcgcaatatcattaataaccgattaaaccatctccactccctcttgccaacatagagtttaaaatatctaagtactggctcccttggaataccgggaaatcctgcaagttttgattgccataattcctttgtggccctgttgatgagccaactttaagactctgcttgtgttgaaaagggctgcattgacagattaagagatcaccagcgttagggagtctgaagggaccagacgtgaaaaggcaaagttcagagtaataaagggaaacggccggtcatttcctgagaccattcttccgtgtctttctagcagaccttactgttggatgagaaacgctagagagtgtagtcccaaaatatctcggttgctggtgcttgaaatttcaccgttagagatattgattcctttggggcttgacgatcctctattaaaatgcaaattccccttgaaggggctatagctcaagcctttatcagccaacactttagcagggatgggatttattttccaatttaacgagatggccaagggatgaacagggggtagggaattccacagatagagtgactgatctcaaaatgctggcccgtggccaaacgctgccttctcccccagttcttatctttaacaggactaagcctctggccggcattgtttaaagcactccagtacaaattccaatttcctggagacattttctgcctagaagttcgcagtgcagcactttttaagagcttgaaacaatacaaggcatgaccctggactggcaggaagttatgttcgcatttgatcatctcccccattcattcattcattcattcatccgttcattcattcctccaacaaaagttcataaagagctctctaatcataaggctttttttttttttacgttcttagggtacatcagtgaacaaaacagacaaaaatccctgcctttaagggattcagagagaaacacacaatagcctaacaaattagtgaattacagtttattgacattgtatactattcaaaaaatagtatacacccactatgtgccaggcactgaagatcgaagaatgagttgcaagccccctgtactcagagaactttcggtctagtgggaagactggcggcacactgggttcagtgttatggagactacacagtgcccccccaaccccacccccaccaaaaaaaaggaatcagatgataaggagatttgaaaagagttttctgaccacaataccaaaaatgggttgaggggtgcccaagtgaaagagtgttcagaggctgttactgtcagctggcaagaggtgatagtgttttggattaaagtggggttagtggagatgtcgagaattgggtgtgtttgggagatgtttcggaggtgtcagtgatgaattaaacagaagggggagccagttggtgacctccagtgatctcccatttatgaatgagagatgcttccaaaatatatgtgaattgatttgttttatttatttatttaagaaaggtacggaaagagagctccaagcaatacagcaggagattttggtgaaggtgggttaggagagggatctactttcgctgtaaaatttcgtttgcatccaaagggagagactgatctagaaattaaacttacttcacatttctatcaatgaaaaagcagttttgttgataaaatgaaaactttagacaaataaatttaacagagtttacttaaacaatgaacaattcatgaataaggcagccctcagaatcataagaggttcagagaactccactctgccatgtgggcagtgagtatgtatagacagaaaaagattgaagaaagtagaaatgaggaacaaaaagcagattagttgtttcaaagttactttccccataatggttaaaacggaacttccttatcatgtctgctcaaactggcctttctggatatttgtctattctctctcttctttctctctctctcttctctctctctccccccctctctctctccctctctctctctctctttctctctgtgtctgtctttcccccacccctcttcctctccttctcctgatttctcataaagtcagctaaacaaccgagtttcagcttggtggattaggactttagcatgactgactccattttaatttggtctgttggtgggagctctgtccaaatcaatggcctccaaaaatttttatttcatactatgttttacagaattttttaatcctgttgtattaaatgcaacagccaaagttaccttgatgaacacttgcaatttggagatataaatagggagataaaagtagttaaagtgagttgatttcatgggagtgaatcataaagaaagaaaggaaagaagaatgaaagggaagggaggaaaagaacagaaagaagggaaggagaaaggtagggagagagggtgctggcctgagcttagcctccctggcactgatcacgacaactcattgactctctttgatcttcagtgtttgtctcttgtaaaagcattataatcatacatgtcctagtgttacagaagattcttggagacccctggaaccaagttatggcttttattctccctggatcagatgggactaatagacaaaaccattgttcttttgggttttgtttctttgtttttgtttttttaaagacagagtctcagtctgtcatcaggctggagtgcagtggcatgatctcagctcactgcaacctccacctcctgagttcaagcgattctcgtgcctcagcctcctgagtagctgggactacaggcgcacgcccccatgcccagctcatttttgtatttttagtagagacaaggtttcaccatgttggccaggatggtctagatcgcttgactttgtgatccacccaccttggcctcccgaagtactgggaattacagatgtgagccaccacacccggccaagaccattgttcttaagcaaagcatgacaaggtggctgagcttcttgctgaaagacaggtttcagggctgcttgcaccatggggagacaaggaacacttacaaatgcctcagtcaccacatgcttgtttcagattcctgctctttttgacctgtacctgtccatacataatggatgagaaagaatctagacccttggtagcctctcttacgcagtagagagttgtgcttggatctcacaatttctgcctatggaagagtaataggggagaaactctacttctaggaatgtcagaccagctacttctcctactaaagacaacttagaaaccagggggactttttttaagtatctccttaaaagtatcaaagattatggagataatgagggaacaccaagcctagatgcaataggagaaggaatgcggagaggtgtgtgcagcacgtgggctgcctttctagctctggcagctgcacacagaatcagaaagatgaatttgagttcaggagtctccaaaggtggggacccagtaaaccagtcccctgccttgtgacagaaccccaaatggctgcatccctggagcaggaaataagtcaaacttccctctttttgcaggtgcccagaaaccccaattctgcattgcacaagcccctaggagctggcaaaacaatagaaaattctctctaaagaaagatattatcattctaggcctccaattatttctatgaatagaatttttaaaactcactttcccttaacttcctcaacacgataaaggacatttatgaaagacccaccactaacatcataatcaatggtgagagactgaaagcttcttcccaagatcaggaatttgacatgtggtgaatgtccacattcaccaccactgttcaatattttattggaagttcagccagaacaattagacaagaaaaggaaataaaggacatccaaattgtaaaggaagaagcaaaactatctctatttgcaggtgacatgatttgatatatagaaaatctcaaagaattcacaagaaagctactagaactaataaacaaattcagcaaagttaccaggtacaagatcaacacatagaagttagttgtgtttctatacaccaataatgaataatctgaaaaggaaaacaataagacaattataataatatctaaaagaatgaaatacctgggaataaatttaaccaaggaagtgaaggcttgtacactgaaaacattgctcaaataaattaaatacctaaataaatgaaaagacttgctatgttcatgcatagaaagacaatattaagatgacaacaccccaaattctctacagattcaaagcaatccctatcaaaactccaacagccctttttgcagaaatggaaaagccaatcttcaaaatcatatggaattccaagggtccccagatagccaaagggtcttgaaaaagaacaaagttgaaagactcatacttctagatttcaaaacttaccacaaaggtatagtaatctaaacagcatggtactggcataagagtagacatctagaccattggaatataattgagggtccataaataaatccatacatctaaggacaactgatctttaacaagggtgccaagttcattcaatgggagaaagaatagtctcttcaacagatggtgctgggacaactggacttgtacttacaaaagaaagaagttggactccaagctcatatcataatcaaaagttaactcaaaatggacctaaataaaagagcaaaaactatggaagtcttagaagaaaacataggcataaaccgtgaccttggctctggctgtagattcttagatatgacaagagaagtatgagcaatgaaagaaaaaataaacaaattatacttcatcaaagttaaacacttttgtacatcaaagcacattgtcaagaaagtgaaaagacaaactataacatggaaagaaatatatgcaaagcatttatcttgaccagagatatatgccatgtattcagattatggatagaactactcaaaacaaaatgacaacccaatttaaaagtgggaaaatgacttgaatagacatttctcctaagaagataaacgagtgtcctgtgaacacctgaaaagatgctcatcactcatcattggggaaatgcaaattaaaaccataatgtgatgccacttcacacccatcaggatagctatattattaacttgtttttgtttttgtttttgagacggagtctcgctctgtcacccaggctggagtgcagtggcgtgatctcggctcactgcaagctccgcctcccaggttcacaccattctcctgcctcagcctcccgagtagctgggactacaggcgcccgccaccgcacccgctaatttttttgtatttttaatggagatggggtttcaccgtgttagccaggatggtctcgatctcctgacctcatgatctgcccacctcagcctcccaaagtgctgggattacaggtgtgagccaccagacctggccagctatattatttaaaaaaaaaaagaaagaaagaaaggagcaagtgttggtcaagatatggagaaattagaacccttgtgcatttctggtgggaatgtaaaatggtgcagccactgtggaaaatggcatggtgacccctcaaaaaaatcaaacaaattctacttctggataaatacccaaatgaattgaaagcagggactcaaagaggtgtgtgtgtgtgtgtgtgtgtgtgtgtgtgtgtgtgagagagagaaagggaacacgtgtgatagggtgttactctgtcacccaggctggagtgcagtggcacaaagacggctcattgcagcctggacctcccagactcaggcaatcctctcacctcagcctctcaggtagcttggactacaggtgcgcaccaccgtgcctgactaatttttgtattttttgtagagatggggttttgccgtgttgccccagttggtctcaaactcctgagctcaagcaatccacctgtcttggcctcctgaagtgctgggattacaggcataatacccatgttcatagcatcattattccaaaggtggaagcaaaccaagtgtccatccttggatgaatggataaacaaaatgtggtctgtacatacattggaatcttattcagcctttataaggaaggaaattttgacacatgctacaacatgaacaaaccatgaacattaggctaagtgaaataaggcagtcacaaaaggataaatattgttcagatccaccttatgaagtacctagagtagtcaaattcataatgacagaaagcagggtggtagttgctaggggcagaggggtggtgggaatggggagttagtgtttggtgggtacagtttcaattgcagaagatgaagagttcctggagatggttggtggtgctacttgcacaactatgggaatgtgcttaatgccacagaattgcacacttaaatttgttaaaatggtaaattttatattatgtatattttaccacaataagaaaaaaacaatgaaattctcaaatccacgaggatggctataataaaaaaaatgaaaataacaagtgttggagaggatgtggagaaattgaaacacttgtaggttgctggaatgaacgtaaaatgctgcagccaacgtggaaaacagtctggctgttcctcaaaaataaacgtagtatttccacatgacccagtagttccactcctaggtatatacccaaaggaagtgaaagcagtgactggaaaagatatgtgtgcaccagtgtcctggagcatgtttgttcaggtgattatcattggagggctggaagcaagctggactccctggacactgatggagaatcaggcacatatagaattttgacttgtctttgttcgttaggtttaaaatgtctgtctcattgctaccaaaataattaaaggtcaactaagtgcagggagagaagaaatctaatttgacaggccttgaaatacttattacttcataggttttgtgatgagatttaagttagatcatgaatacagaaaagtattttttcaaacattacgcactttatgaatgctggccttattccgttagcagtaagttccttacggacaggaatcattcacgtttgcagtatcctaatgcacttagcacagtcctagcagatagtggtattcaattactatttattcaagctaattctgtatcttaaactatgttaaaattgaagtttttaacacttctgggatagtattgactagaattttgtgaaaaacccctgagaagtaaatgacttaattattgaaggagggtaataaggctaagaagtgagttccagttaactcaactagcactattaaatcaggttattagaaacctatgcattctaatggtttcattagaataagcagttattcatatgctcagactcaaacaaacttatacatgaaagaggtgttttgcctttagggaaaaactatgaaaattatgagtcaagcctcatgagatttgataattctcatccatcaactgaacagaaaataatggagtaaaatttatcatttggctctaaagtatgggtcaccttcaatcagaactccttcacttttattttattaagaagcaaaagtaaaacactttgcttgtggataaatggaaagttgcttagagaaataagcattaggatgcactcatttttggtgtcgattatgtgattggcccacatttttatagcaacagcaagagcagcagcagcaaattgctgagacgtaattcttatggcatatgttggcttttttcatgcaagcaagctatatgttcagtggtaacctggaccattcagcaaaatccatttctctcttcactctctccaacatgtttctctaatcctctgctccagcaaaatactggcctttggtttctttctttttttttttttttttgagatggagtctcgctctgtccctcaggctggagtgcagtggcgcgatctcagctcactgccatctccacctcctggattcaagtgattctcctgcctcagcctccagagtagctgggactacacgcacctgccaccacacccagctaattttttttttttttttttttttttttttttttttttttttttgagacggagtctcactctgtcgcccaggctggagtgcagtggcgcgatctcggctcactgcaaggtccacgttccgggttcacgccattctcctgcctcagcctcccgagtagctgggcctacagatgtccgccaccacacctggctaattttttgtatttttagtacagacagagtttcaccgtgttagccaggatggtctcaatctcctgacctcaagatccacctgtctcggcctcccaaagtgctgggattacaggtgtgagccaccgcgcccggccaattttttctatttttaggagagacagggtttttccatgttgccaaggctggtctctaaactcctgagctcaggcagtcggcccatctcagcctcccaaaatgcggggattaaaggcatgagtcaccacgcctagcctggcctttggtttctaagcttctggacagtaatgggtcactcctgctgagaatgactttcttcatcacctttgcaaattctatccctctcttaggtcttctctcacatctaaaagtcagggcagcagaatggttagggcacccatgttagtgtcacactgccttagtaaaaaccccaactccacttcctaatgaaggtaataataatacctatcttataaatttcttgtgaggattaaatgatttcatttatctagagttcttagagcagtacctggcatatagcaaacactaagtgccagttatttttctattattgtgtcagtacttctatttgaacatattcccgttaggtctagctttccctggcctatagcggcagaacagattatgctggaaaagaccaaagggaaagttaggcctacagggtctgcatccagaagatgaagttatattagaacctcaaatgcaagactgaaccaaaataggaggaaaggtgagatctaacaccattggtagactaagagcagaatacagatattcagcaaaggtggcttggtacctggcacccatcttctaagtcagcataaggcaaagaggttaggctgtttcctcaaatatggtataataactgagaagagacttcacaatgggtatttatttgaatttcccacagtgtacagaataacaccttattagaataaaagctatagtaaatatttgtatattgatgtcttaaaattaagaaagtatttaaaatgctcccccttttaagccatctattctataaatatctattgagtgaaataatatacaagacattaccctaagccatgtaaagatcagtaagacctcgcaccagacctcatatttcttatgggctaattactacctataattcaatagtcattattgtaatgactttattagttttagtcttctaattatatcattatttcaatatctttagaataaacagaccaagtaatgaaatttcagaaatgatttagtgatgtaagtgtgggatctaaacaaaaacaactttctaggaggtttcagatttgattataatcatctcctaacatggaaaggatgtagaaatcctttttctactcttttcttgtagggattaagtatcgttgattcttaagaaggatattgaaaaaaggcaataagaaatacaataacatccctatagacagtgagagcataccagaaagacataaccacaaaatagatcaactgattagatgagtgagggccacccacattatggaggggaatctacttcacttaaattccactgggttaaatttccatctcatccataaacaccttcacagaaatacccaaaataatatttggccaaatatctgggtactgtggcccagcaaagttgacacaaaattaatcaccacaatgatgaaatttttaaaaaactcctaaacaaatggagaggcatagtgtattcatgaattgcaagagtcaacatagtaaagatgtaaattctccccaaatttcctgataggtttactgcaattcctatcaaaatcccagcaagttggttttttttttaaaagacatatgtacatttatttttaaatgtatgcaaaaaggcacaggctctagaatagctaaaataatccgggaaaagaattaagtgggagtaattacttgatattaaggcttactacagagatagagtaatcaatatattgtggtgttggcagaaggatagacacacagttcaatgtaactgaatagagaacccagaaatagatccccaaaatatgctggttttttttttttttttttagatagaggcttgctctgttgcccaagctggagtgcagtggcatggtctcagctcactgcaacctctgcctcccaggttcaagagattctcatgcttcagcctcccaagtagctgggattataggcgtgcaccaccatgcccggctaatttttttgtatttttagtagagatgggtttcaccatcttggccaggctggctaattgatttctgacaaaggtgcaaaagcaattcaatacaggaagaaaataactgtttcaacaaatggtattggagcaaatggacatctgtaagcaaaaacaaataaataacaacttctatttaaacctcacactttatacaacaatgtattcaaaatgaatcatggacggacttacatgtaaaacagaaatgaaaggaaaaaagaatttcagaaataaagactaaacaaaaagcagtacaagagtgaataaacacaataaataaaaacctgaggagcaataaaaagcaaaaaggaggaaaatttttaagatcataaagaaattaaaaagataaaaaagattttagatagtggcatatttgaagagtgttaaagaagatccaacatgtggctgaaaggagtttctgaaaagggaaaccaaagcaagggaacaaaacaaatattaagaactgtctctcaagaaaataatcctgaatttattttattttattttattttattatttttttttgagatgaagtctcactgtgttgctcagcctggagtgcagtggcacaatcttggctcactgcaacctctgcctcccaggttcaagcgattctcctgcctcagcctcctgagtagctgggattacaggcaggcgccaccacgcctggctgatttttgtatttttagtagagatggggtttctccatgttggtcaggctggtctcgaactcctgacctcatgacccgccccattggcctcccaaagtgctgggattacaggcatgagccaccgtgcccagccctgaatttttaaaaagatttgaaattgcacattaaaggaggatactctgtaccagacaatatcaaaccagaatgatcatgaccaaaatatattggaataaaatttctgagctctaaagaaaaagaagatattttgggggatcacggcaaaaagaccaggtgacttaaaagggaaataaaatattggacaataattcattatgccagaaaaatgacatgaaagcattttaaggaaaatcaagtaaagaaaatattactcaaagattttatatccagtaaaactaaatttcaagtagaaaggacacagatagactgaataaagaaaatgtggtacatatacaccagggaatactatgcagccataaaaaggaacaagatcatgttctttgcagcgacatggatgaagctggaagccattatcctcagcaaactaatgcaagaacagaaaaccaaacatgcatgttcttacttacgagtgggagctgaacaatgagaacacatggacacagggagggcacaacacttactggggcatgtcaggggagagcaatgagggggagagcattagagaaaagagctaatacatgctgggcttaatacctaggtgatgggttgataggtgcagcaaaccaccatggcacacatttacctatgtaacaaacctgcacatcctacacatgtaccctggaacttaaaaactaataataataatttttttaaaaagtaaggatgcagataaactatcatcaatgtgcaaaaattcaaggaatcttgttccccataatccctttctgaagaattgtgttaatgtgcttcaaacaaccaaaataactagacagacattgacctaagtatagatggtgagcactgatatattgctccttttagaactgaaagtaaatgagggccctttcctcacaccatatacaacaattaactcaaaatccatgaaaggcctaatgtaagaactaaaactgtgaaactctttgaagaaaatataggtgtacatgtacttgaccctggattggaagtggtttcttagctatgaaacctaaatcacaagcaaccaaagaaaaaaatagataaattggacttcatcaaaattaaaacttttttcaaaagacactatcaagaaaatgaaaagacaatgcacagatagggagaaaatgtttgcaaatcatgtatcgcttaagggtctaatatcagaaaataaatgtatatatttatcctacaaatacagtaaacatgtatttgtaaactgttgcagctcaacagtaaggaaataaacaacccaattaaaaagtgggcaaaagatctgaagtgatgtttctccaacaaaggaaagaaatggccgctgaagaaaacaaaatctatatcttgaagagatatctgcacttcatcttcattgcagcattattcacaatagtcaagttatggaatcaacctaatcatccattgatggatgaaggaattttttaaatgtatgtgtgtgtgcatgtgtgtgtgtgtgtgtgtatgaaatggaatattattcagccataaaaaagaaggaagtcctgtcatttgcaacaacatatatgaacacagaagacattatgctaaatgaaataaaccaggcagagaaggacaaacagtgtatgatctcacttacatgtggaatctaaaaaagttaaactcacagaaacagagtagaatagtggctgccagggactttggggtgggggaaatggggagatgttggtcaaagggcaaaaactttcacttataagatgagtaagctctgagaatctaatgtacagcatgctgattattgttaataacactgtattttgtatttgaaatttgctaagacagatcttcagtgttcacatacacaaagaatggtaattatgtgagatgatggatgtattaatttacttaatcatggaaacaatttcataatgtatatgtatatcaagtcatcacatttcatatcttaaatatatacaattttgtcaattatacttcaataaagctggaaaaatataaacagtaaactcaaagatcgatggatagatagatagatagatagatagatagatagatgatggatagaatgatttagttgtttctccattcattgtaaagttaaagatgaatacaaattatgttgcattcctcttatatacacctaattacatcagagagctaatatgtacctcagaaaaatacatgaaaatgagtgctttataagacaacaaggattgaagctaactgggaaatccttatatacttttatacccctatatacacttaaacaggagtttcaacatcattcctaatttttcagagaagcacatccattttcaaaattattgattcactgaaatttatctctgatcattttcaaatcatattgaattgcgtgaaaccctcgaaaaaaagaaatagccaataagcacatgcagagatgcccaacatcatcagtcattagggaaatgcaaatcaaaaccatggtgagacacctcttcacacacacatgaaaagatgatcataatcaaaactatggacgagagaaagtgtgggtgaggatatggagaaagtggagcctttatacagccagtggaacataaaacggcacaaccacaggccgggcgcggtggctcacgcctgtaattccagaactttgggaggccgaggccggcagatcacgaggtcaggagatcgagaccatcctggctaatacggggaaaccccgtctctactaaaaatacaaaaaattagccgggcgcggtggcgggcgcctgtaatcccagctactcgggaggctgaggcaggagaatggcgtgaacccagaaggcggaacttgcagtgagccaagatcccgccattgcactccagcctgggcaacagagtgagactctgtctcaaaaaaaaaaaaaaaaaaaaaaaatggcacaaccactttggaaaacagtctggcaatttctcaacatgttaaactttgatttaccatatgactcagcaattccagtcataggtatatacccaagagaactgaaaatgtattttcgcacaaaaactaatatacaaatattgacagcactatgattcataatagccaaaaatggtaacaacctatatatccctcaacagatgaatgaacagacaaaatgtggtatatcccaactagacagtattttcagccacagaaagtaattaactattgatacatgctataacacagatgaattttgaaaatattatgctaagtgaaaaaagccagtcacaaaaggccacgattctattggtatgaaatgcccagaagaggcaaatccacagagagaaggaaaatagattaatggctgtcagggctggaaggaggaggaatgggaatctctactaatgggtagaggtttctttttgaggtgacaaaaaagttctaaaattggatagtggtgatggttgcagaactctgtgactatactaaaaaacaatgaattgcgtacactttaaaagagtgaattttatggtatgtgaattatatttcgtaaaggtgttatttttctaaaagaccaatggagggttaaaaagaaagtataggctggccacagaggctgacacctgtaatcccagcactttgggaggccaaggtgggcggatccctttaggtcaggagaattagctgggcgtggtggtgcacacccagctactcaggaggctgagacacgagaatcacttgaacccgggacggggaggttgcaatgagccaagattgcaccactgcactccagcctgggcaacagagcaagatactgtctcaaaaaaataaaaaagaagaaaagaaaaaagaaagaaagtatagtatgctctgattatatgctctgacaatatagatgtaatttggctatttttaaaaacgagttgaatggggaaaacatatgtaaaactgggaactacttgcagtaatcaattgattctggtagtattagtattagcatggggagatacttagcataatacaagattaagcaaatgaggtattatgggatattctatcatcccttgtgttcttgaaaaccaaattctcgaggtagaggaaaggagttggagacatacccaggctaggttacatacagaactctgtagtcctgaatttgaactagaaatgggaatatgagttcatgagataggctatctgtgtagctaaccgtgtgtgtgtgtgtgtgtgtgtgtgtgtgtgtgtgtgtgtgtgtgtgtgtgtttcgtagctctgtccactgaaaaaatctagaaacaatgaccaacccagtagcaatgaacatcccaagggccccaactatggtcctgaaatattacaccatttctcaataagagaaatggctgagctgaagtttgggatcatacaggactgcaaaagagctgtgaaagactgttatactagagcgatgacaaaagggttcaggagcccactttagatgttcttatttgctaaagattaaaacaatttttttctgagtgccaataagaatactcattgtaaggcattcaaacctaccaaatatgtttaaattcagaagtttataatcatatgttttaaaactcactggttgccctcagaggatgataggaaaacaactcattatcttaaaacctggcaaattagaaaacaattatcttgccttcctatatgaagtgtatcattgggaaaccagttagtagatgagaggaagtgtctttttttattttttgagagacagtctcgctctgtcacccaggctggagagcagtggtatgatctcagctcactgcaacctctgccgcctggttcaagcaatctgctggcctcagtctcccgagtagctgggactacaggcatgcaccaccatgcctggttaatttttgtatttttagtagaaacggggtttcaccatgttggccaggctggtctcaaattcttaatctcaagtgatctgcctgcctcagcttcctaaagtgctggaattacaggtgtgagccaccacgcccggctggaagtgtctttttgtaataatactgcaaacaataattgaaaaagatattgaattaaaatgtcatcattttgcaaatcacaattagttaaaagatacaggcactgagcatcgacagcggctaacattgaaaaaagacatgaactgaaacaagacatgaaggcctcctgatgaaagaacaagccatttatatcctgcaatggggatcaagccagactccaattcagtccagttccaggtaccaattttcaggaaactcagaagacagagtaatcatgttgaactgcaccaagagggtacacttggcaaactccagactccaaatgtcctcggcacttcagcctgtaaattgcagggaaaagaaagggatagagggtggcgggcgcctgtaatcccagctacccaggaggctgaggcaggagaatcgcttgaacctgggaggccggggttgtagtgagcagatattgtgccactgtattccagcctgggcagcagagcaagactctgtatcaaaaagaaaagaaagagagatcaagagagagagagagagagggagggagggaggaaggaaggaaggaagagaaagaaagagagagagagagagagagagaaggagaagggagggagggagggaggaaggaaggaaggaaagaaaagacagaaagacagaaggaaggaaggaaggagaaagaggaaacctgtacattaaaagagacttgatgacatagtacaaatttttaatggacaagactaaactataggccggggctgtgactcatgtctgtaatcctagcactttgggaggctgaggcaggcagatcacttgagcttagagttctgggcaacataatgaaaccctgtctctacaaaaaatacaaaaaaattagcctggcatggtgggacgcacctgtagtcccagctactcaggaggatgaagtgagaggatcacttgagccctgggaagttgcggctgccatgacccatgattgtgccgctgcactccagcctgggtgacagagcgagaccttgtctcagaaaaaaaaaaaaagaaaaaagaaaaaaaaggctaaactacagtgtctagggatagctacttgagtgataaaaccatacagaaatgaaaggaagtgattactataaatcagagagtgactactttgaaagagaaggaagaggattgtcattggggccaggcacgtggaggagattctggggcagctggcaaagtttaatttcttgaccagagagggtgattacaagcccactcacctcacaataacttatccagctccacacttgatttgggtggatttctgtgtctgttttgtctttccataaaaaggtttttaaaatctctaccagagcatgtttgtttacaatttcagattaaaacctcgccttcttggctcgtccaagttccatatgaccttcctgcaccatgacttttgttctgtatttgagagcaagtttttaaacaactcaattttgtgtctgacatcaatgaacaaagatgtagatgctgttctggaatctgcctctgcgtgtcttcattcgtcacggagaaggggctgcatatcatcttccagatggtgcttgacaagcacactctttatagaatgaaaggaaactgtggccatgaacaccgcattcagctttccctccgctacctctgcagccttttagatgctaacatagactgcctgccccgctgcggatttacagctattcggatgtcaactctattccttccagactttgtctgcgtcagattagtcaaggcaggcagctgtgatacagacagtaggaaaaacagtaggcttggaatcaagacacctggcctccactggcaactccttccagctctgtaacctgggacaggctgctcaatattcctgcatccgtttcctcatccggaaggtggggattatacacgggattgttgtgagggaggtgatgcgtgaaaaagcaacttgtgaactttgaaatgcactctcaccattcagaggtcttcagcatcctcacacagctcactcccagtgaatttctttctctatgtcattacccacagtaatgggtcacattatcatgctgccctatccaacacaaaaaatgatcagaagatcttattgtcctttgaatgcccttgcagctgggccactgaggtttgaagagatatggtgttggaatgggaagaaggcctcagggggtctcagagccatctggttccctgagtgttctcttgtgtcccttctgaggtgcctggggttccatggccaggttcagcgaccaccttagggtcaggaagtagatatcggccactctgaccctcatgcctgcctcttcagaggagctctgccttatccaatccacatcctggcgcatttgtaagtaagagttcacgtcacaggttctgaaaacaacagcagcaacaagtatgagttcaaggccaggcgcggtggctcacgcctgtaatcctagcactttgcgaggccgaggtgggcagatcacctgaggtcaggagttcgagaccagcctgaccaacatggagaaaccccgtctctactaaaaatacaaaaaattagccaggcgtggtggcaggcacctgtagtcccagctactcaggaggctgaggcaggagaattgcttgaacccaggaagcagaggttgcagtgagcagagatggcgccactgtactccagcctgggcgacagagcaagactccgtctcaaaaaaaaaaaaaaaaaaaaagaaaaagaaaaaaaaatacacttgaaggggagaaggagggaaggaagggaaattttacatgattgatataatggtatgtttaaagacacaacacaaaaggtttttaagggagccaaatattcataaacacactgataagaagcctgtgctttataaatgttctaacataacttcctgttaatatgcaaataatgccccaggggatctataatgtgattctcttcagaagtttaacaaactgctgtgtaaactagtagctattaatactttctgcattcatcttacacattaattaaaccttcaaacattgctgtcagttgttcttttgccaatcttctgtcaaacattattaaatacaatttctcatttctttctatctaaaaacatcctttttttcctgaaatatttaaaaaaacactgtaatgtaccaaaagatttgagaaaacttgtctcttctgggagatgctgtggcaaatcaattccttctaaataattaattttcttgagatcaatgcctaattagttttgcattttcttttaaagaactcactcaattttagaagattattgttaagggaaaacttatttcccgtcttcatgccctggaaggggcagtatcagaacacacagctcgggcttctcgactcctcacttgcttcttccccaaaaggagtgacttatttcatggataagcagaccccatatgtagggcagtgacccccatcctacctgctacctgttatgggttgaattatgtctcctaaaaggtacgttgaaatccaaatctccagtaactgtgaatgtgtctttattttgaaataggatctttgcagatagaatcaggttaaaatgaggtcactacagtgagccctaatccaaaatgactggtatcctcataaaaagagaaggctgggtgcggtggttcacacctgcaatcccagcactttgagagggagaccccatctctgcaaaaaataaaaaaatacagccaggcatggtggtgcacacctgtagtcccagctactcaggaggctgaggtgggaggatcatttgaaacccaggaattcaagcatcgatcacaccattgcactccagcctaggtgacagagtgagaccccatctcaaaagagaagaagaagaagaagaagaagaagaagaagaagaagaagaagaagaagaagaagaagaagaagagagaaaacacagatgtttctacaaaccaagtgtgtatcttcaagccaagcaatgccaaggatggctggcaaacacagaaactagaagaggaaggaaggattctccccaacaaatttcagagaaagcgtggccctcctgacaccttgatcttggacttctagcttccacaactgtgaagtgacaaatttctgttgttaaaccacccagtttggggtactttgttacggctgccttcacagatggatacaccatccttgctctctctgccccctggttctgctggcacccaggcatggcaagggcttcctcaagccaggtctgatctttccaacccatctctcatctgtgccaaaatcaggcaagtcatgctcatgaaattcctataggtctaggttcagggaaggagacaaggggcctgtctttgttttgtgttgctataacagaatacctgaaactgaataacttataaagaaacgtattggctcatggctctggaagctgggaagtccaagactgaggggctgacatctgatgagggccttcttaccatgtcatcctatggtggatgatgagagagtgagagaaagcaagaaggccaaattcaagctcactcccatgataaagttaatccatttgcggggggcggagccctcagggcctaattccctcttaaagttcccacctgttaacactgttgcactggggattctgtttacaacacatgcttcttgggggtgctatagtttggatgtttcacctcttcaaacctcacattgaaatttgatcctcagtgttgaagctgggttctcacgggaggtgtttgggttgtgaggatggatccctcatgaatagattaatgctgtccctggtgggggtggggaagaagtgagtgaattctcactctactttgttgctgcaaaagctggatgttcaaaagaatgggcatctcccttctctcttgcttcctctcttgttatgtgatctctgcaatctctgcacacagcagctccccttcaccttacaccatgagtggaagctccctgaggcccttaccagaagcagatgctggcaccatgcttcttgtaacagcctgcagaaccatgagccgaataataaacctcttttctttagaaattccccagcctcagatattcattacagcaacacaaatagactaagacagagggacacatttgaaccatagcaaatctctctgcagtccagatctgttacttactagcactgctctagaactttccttccgtttgttccttgtgtctatgtttctacaactatgtcatataactatatgtatagttacagcctgccgtttagctataacgtactctcccactgtgtcacttggctcacctcctgtgccagttaacaagctaatgtcagggcaaaatccactcttctattctctgctctttgtggctggtatgccctcattcattcctgatagcttctccactcaagcctgcatcaccctgagtaacttcaacatccccgtgacaactcccccaccagtgacagcctcttgactcctcctctgtatgtcccagtccactccatctcagctgccccctcccataggcatacctaggattttgtcttcaccagaagctgttctcctccaaaatagcaaatccacaaacagcccatgccctgtccatggcttccagcttgctcactcagcaatgttcaccctttgactatcatttcttcccttggctgatattcttatatttgtccttgcctcctccaatctactttatgcatcaaaaacagagaatgcttttcacattgcgtcaggtcactctgtgcatgtcaattatcaatataatgtatatagaaggggcacagactgatggttgccagggaatcataataatggctgttatggaagggtgtggtgagtgtggcttgcagtgatgtaacagtatcttgattgtggtggttacataaatctgcaaatgtggcagaattgcatagaactatatacacacaagtaagtactatgaaactgctgaaatctcaataagctctatggattgtatcaatgttaatgtctcagttttgatattgtactatagttatacaagatgttatggtgggggaaactggatgaagggtacagaggaccttcctgcacattttttttgcaacttctagtgaatctataatcgttttccaaaaaggtttaaaaaaaaaggaaataaaaatttcttcctgaccttctgctaggtggtgaggatgcagctatgagcgcaacaggctgtatctctagactcatatgactgaaacagatagggaggataagttgtggttctcatcactcttgggacaagccaggatcctgaataaggtctattagttcccctaatgggccctgccaatcctggcagcctcacctcccgctgttcttcagtaaccaccttggcttttacaagtttcctagcgtgtaggagcttcctccccgacatgcctcccaactctcacctgggagcagcctcccctgtgctcctaacctggtcaggtccctgtacaggctctgccagctccttgaacctcttctccagaggtgcaatagatctaatctcccctattaaactataagaatcgatgttttcgttgctcatgattaaatcctcagcaatgtacacggtggccagaacataggagtcactcatgaattttttgaatgagtgaatgactgaaagggctttaagcagaggataatgcaatctgatttgctttttaaaaaataaacttttgtgggggctgggcacagtagctcacgcctgtaatcccagcactttgggaggccaaggtgggcaaatcacttgaggtcaggaattcgagacaagcatgaccaatgaggtgaagccccctctctactaaaaatttaaaaattagtcactttgggaggccgaggcgggcggatcacgaggtcaggagatcgagatcatcctggctaacacggtgaaaccccgtctctactaaaaatacaaaaatcattagccgggcgtggtggcaggcacgtgtagccccagctactggggaggctgaggcaggagaatggcgtgaacccaggaggcggagcttggagtgagccgagatcacgccactgcactccagactgggcgacagagtcagactccgtctcaaaaaaaaaaaaaaaaaaaaaaaaaaaaaatttaaaattagccaggtgtgatggcacacacctgtaaacccagcggggagggaactgaggcaggagaatctcttgaacctgggaggcggaggttgcagtgagctgagttcgcgccactacgctccagcctgggcggcagagtgaaactccgtctcaaaaataaaataaaataaaataaaataagcttttgtgttttagggtagctatagaattacagaataattactgaagtagcatagagctcccaaatgttccatacccattttcccctattattattaacatcttaccttaatctggtagatttgtcacaatcaatgaaacaatactgacacattattattcactggagtccatactttgtccagaattcctgtttttctccctaatgttctttttgggatcccatccagaacacacgtccacagtataattagttgtcgcgtctcctacagctcctcgtggtgtgtcagcttctcaggcattccttatctaaagtcttatctatgcttcaccttcttaagagcagctacacagattgaagttcttctgctcgggtttgtctcttcttcactgtgtctttacttatttactggactgtttatttatataaattaatctatccttcattcacctactgaaggacattttggacatatatttatttatataaatatggtctcatggatatttatgttttgggttatagcctcctttttttggtgttcaaattgttctagctttggactttgggggctctttcagttggcctatgtgtccctttaacataaccctttctttatgggaatttattttgtgagcacttcgttattttctggcactaaaagatgctcccggcttatcctgtatatttccaacctgagtcctaggttcagcctttctcaaaaaagccctggttccttccactgaaaatggtattagaaaccaagctctgagcagtaggtatgctcattgctactggggagtcattgcttcattgcttgtaggcctgctcagttggcagaagagcaaaatatattaggtttgtgcaaaagtaattgcggttttgctgttacttttaatgtaactgtctgtatctataattctatatgtaaccatttatagatatacctctgcatatatataatgctgtgtgtaaccatctgcatctatattgagaagcatgagttcctactgaatgcttcacctctaatccattaccacatagatccttccagactcctctctttatctggaatctcccatgcctgcagtgaggagcctagcttccattatttgcttactttagttaattctttaatcccagtatacgtgtacggtggtttcagaattgttagctcatatccctagggggcacaactttatcagctagaatagagtgtgtatgtagagttcctgtgcctttagtcattcatttccaaagatacctaagccagcactttattcctcatctccttcaacaacattgttccatacatttgtggtacatttagatccttttgtcgcattctgcctctcattctgggttccccaacatcctaattatttttatttttttatttttttttagacagattcttgctctgttattcaggctggagtgcagtggtatgatctcagctcactgcaacctctgtttcctgggttcaagccattctccctgcctcagcttcccgagtagctgggattacaggcgcccgctgccatgcccagctaatttttgtattttttagtagagacaggctttcgccatgctaactaggctggtcttgaactcctgaactcaaatgatcctctcatctcagcctcccaaagtgctgggattacagatgtgagccaccgcactcggctcctaattttttttaaatttacctgattagggtttgctctctgcactgtaaagttcatagaaatcccccatagggttttgccaaatccttgtatatgccattatagtatcactcatacaaaaaaaaaaaaaaatccctgtgcttcacctattcaatcatccccccaacttctaacctcttggcaaacactgatctgtttattgtctctgtcgcttgctttttccagaatgtcatatagttggactcatacagtatattgctttttcagactagtttatttcatttagcaatatgcatttaagattcatccataactagagtcaggcgcggtggctcatgcctgtaatcccagcactttgggaggctgaggcaggtggatcagctgaggtcaggagttcgagaccagcctggccaacatggagaaaccccatctctactaaaaatacaaaattagccaggcctggtagtgaacgcctgtaatcccagctactcaggaggctgaggcaggagaatcgcttgaacccgggaggcggaggttgctgtgagccgagattgcgccattgcactctagcctgggcaacaagagcgaaactctgtctcaaaaaaaaaaaaaagattcatccataactttgttgggcttgatagctcagttctagttgctgaataatattctattgtgtgaatgtaccatagtttgttcatccattcacctattgaaggatatattggttgcttctaattttggaccattatgaatagagctgctataaacattggcatgctggtttatgtagggacatacgcttccaaatcagttcagtttcaaatcacctgagtgtgattgttgactctgatagtaagactatgtttaggctgggcacagtggctcatgtctgtaatcccagcattttgggaggccgaggagtgtggattgcttgagcccaggagttcaagaccagcctgggcaacatgatgaaaccctgtgtttccaaaatatacaaagattagccaggcctcatggcatgcaccgtgtagtcccagatactaaggaggctgaggatgggggatctcttgagcctgggaggcagaggttgcagtgaggtaagatcacaccacgcactctagccggggcaacagagtgagacccctgtctcaaaaaaaaaagaaaaagactaggtttagttttgtaagaaagcgcaaattctcttccaaagtggctgtaccatttttgcattcccaccaataaatgaacattcctgttgctccacatcccctccagcagttggtattgttggtttttggatgtccgccattctagtagatgtgtgggggtatgtcattattgtggtgatttgcaattctctagtaacaaattatgtttaactacagattaagtattctaaaatcatcattttgggccaatgcccattatttaactggcttaacagtaataataatattgattcagaaattttatttagtcagttatttaagagaacattttgcagctagttttgcttgaggtgttcatcaggtcatgacatggtttaaagctatttcatcattgcactgatgagatattttatcattgcactggtaagatattttatcactaagattatatctgttttaaaattttcaaactaaaactactaaatgtatggtaacaaattttgaggcttccattcatccattgttgaagtgacctaaaatcttttttttctttctttctttttttctttttttgagacggagtctcgctttgtcgcccaggctggagtgcagtggcgtgatcttggctcactgcaagcttcacctctcaggttcacgctgttctcctgcctcagcctccggagtagctgggactacaggcgcccgccaccgcgcccagctaattttttgtatttttagtagagacggggtttcaccgtgttagccaggatggtctcggtctcctgacctcgtgatccgcccgcctcggcctcccaaagtgctgggattacaggcatgagccacggcgcctggccaaagtgacctaaaatcttgacccagtccaagggtacttcctcatcccatctccatgcagggaatgttcatccttttagaacatgttgatagcaagtccatcatttttaagaggatttttaaaccatattctcagctctactggatgttaaatcatgtgactatgaacttaataggcaacgtgcatcacaggacatgtcagggaagataggttcaaatgtattgctgctgagcatgcacagaaagcttaagtaagagaaataataatgatgcaggattacttgaaggctgtattgaccatctattcatttagactaataaggatggagatagattcaaattgatcacaatggtgatgctctaaagagacagaccatgaggttctgcttcccagttccctagaactcccttggtccaggaccttctgagggctggtggttgaggttttcatttgattctcacagttgatagagcaaactttaagaagctgatatagaggagaaaaaggatcaagttaggcatcaggttcctgggtccactacctaacaccagtgcttccttggacaagttacttaagctccataagcctatttcctcatgtggaaactggtcataacaatcgcattataatccctactttgtccaaattagatgaacactgtgtgtaagacagcaccattgtcttacaaagcagttacaaactggcagccagatcaggcacaggggcaggccatttaccctgcaagatgatatatgttttaaaagtttgagtcaactttttcaagttcaaaaacttcatattaagccaagatttatggcttcctttaaaaactttaatggatctcacaatacagtccctacatttccaagagccgagcagcagccctgccctttaggcaaagcaccagctctccaggtgcctcagctccctaccttcctagctgtctctatgttttttttattaaaaccacaaataaactgtaaagccataaaataagtgattaatattattgctggagataacttacggaaggcttcttaacacctgagaggcgatgtttcactcagagtaaaggtgagggtagcctctatacggctggtgacagaaggtgcccatggcacaattcagtttgttgagccaaattttctgtgcttcattccacagtctttgtaatctgagcatgcatggcttgagaaacactttttaggcacacactttgatataaaacaatttgtcaaaaaaaaaagatgctggaaattccagagtcaagtagtctgccttactgacatcattcatggcaataatattatatgggctgctatgagcatctgctcaatattatatgggctgctaggggcatctgcccactttcctagaatgccacttttctttcactgggtctatccaaattggaaactccaaagcccatcccagttctctcccaccatcatcatcatcatcatcatcatcatcatcaatcatcatcatcgtcatctcatcatcatagatgtgatgatgatgatctctctctcccttgacctcttagggaaattactatctataaaaattaactggcaatgagtcacatgttgctttgaaacctgttctatcatatcatgatgtcttattgtatgacctataatttatttgattcttttgtagggacagggtcttgctatattgccggggccagtctcaaactcctggcctcaagtgatcctcccacctcagcctttcaagtagctgagactacaggcatgagccaccacacccagcttatgacttaattattcatatacaggtagtattcactttgcatggtactgtggaactgtaaaaatcaccatgcaatctgaaaccacgcaaagaaatattaataatcaatggggaaaatatgatttttctttctttttttttttttgagacagagtctcgctcttttgcccaggctggagtgcagtggcgcgatctctgctcactgcaagctccgcctcccgggttcacgccattctcctgcctcagcctcccaagtagctgggattacaggtgcccgccaccacgcccggctaattttttgtattttcagtagagacggggtttcaccgtgttagccaggatggtctcgatctcctgacctcgtgatccgcctgcctcggcctcccaaagtgctgggattacaggcgtgagccaccgcgcccggcctgatttttcaatgatacgttctaatgcttgtaaaaacattaaaatctctcttactggcagttataaacaataggaaaatgaaaaggaacagtaaaactgatatttgattatgccttggtgaattggcatactcctttctaagtttgcatcacttccaacattttcccctttgtgctttcaatgtcataaaatatatctgagagttccattaacttaaagtgtttccccaccaccaccttttttttttttttctagagttacttcctctggggtatcttcttcattctttttgtcatgaccttttccctcatttatgtctgtaagtttattgtcaataagtccttctggctgtatatctagagtttctccgaaggtggcagggtcaacattcacatgatcagctatgtcttccataactccacatggtcagctatttcttctataactccatttacatcccattcaaatttcacttccatctttaacactttttgtttcttttgtgtactttcatctttgttggccaatttgaccttctaattatctgtttttataaaatgccacctgggtttatcactgagaatcaccgaggcagcacaactacacactttgctggcagtgcaattgaatgacatatgcacaatgaccaatcactgcagattttgaaagaacttgctgcgattggtcaccaagcactgcaggtgttggaataaaggtcatgattggtaactgactgtggtgcgcatctgttacttacatagtgatttgtggactgaagagctagcagccccatttgtgctccatgcaatgactcacagttaatatgccatggtaactgtaatttgaaccgtgttgttggaagactgagttatttaatgaaaccatggtaaatgagttcgtttcatgcttaatcagaaccacgagaagcaaagcctgcctgtatttgtattctgtcttcacaagtccagtgtaagccccatgagggcaggacccatgactcaagaagtcatctgcacatattccccatgctcaccccaagcacctactacagtaccttgtgtatgaaaaaatactcgataaatatttactgaattttattttcttcaccagagaaagaactgtgtagatgtaacacagtattgaaagtcaagagacttcaattcttggtctgggtctggaactaattgagtatgatttttcagacactctctcttttaaaaaaatgtattttaagcaaaatctctacctatggtaaggatataatcagaattctaacaactattgtgtcttagtcatattcaagatgaaaaaactgttttagtttattattttattatttatattattttattattttttgagatggagtcttgctttgttgcccagtctggagtgcagtggcgcgatctcagctcattgcaacctccacctcctggattcatgcaattctcatgcctcagcctcctgagtagctgggattacaggcatgcaccaacatgcccggctaatttttgtatttttattagagatatattccctctttcagtgttcctgggagctccttaatgagccaaaacacaaagccattctgacagagaatgctggctgtcagctgcattcattcagagctaagtgatctgatccacacaccagcctaacagccaaagtgatctcactaaaatgaccaatatcactgcaaaggaaggttttccaggccaagagaacgtgcatgtgcaaagaccctggggcaagaaagaacctggcatttcgtagctaccaaaagcccatatgcaggagagcacagagggcagaaagatgtgaagagaatcacgagatggcccaatgacgaaaggggaagagctggaagggagtgccatgagcccctgttgaaatccctctggctgcagtgtggtgagtggatggcagaagagtcacaaaggatgtgggggaagaagctgtgaaaggatgccagaagagatgtgatgtgacctggccctgggtggaagcaagggagatgggaacaaaggcatagcttccagagaggtcaagatgtcaaaccagtgtttgaggcaggtggtccatgtgtggtcccagaacagcagcatcagcagcatctgcagggaacttgttagaacacgaattctcaggcccactgtagacttcctgaatcagaagctctgagatttctgaacagttggggttttctcaagccctctggaggagtctgcctcttgctcaagtgtgaggtccaccagacgaggtgatagaaacagaaaagaacctgcaaagatgactcctgagcaagggggctctcccacagggcctgggtgtcagtgagtgctcttcgggggcaagagagaaccctgggaagcactgagaagcagacagcaaagcccctccaaaaaatggtgtgaaactccaatttcattttatttaattaattaatttatttatttatttgagacagagcctcgctctgtcatccaggccagagtgcaatggcatgatcttggctcactgcaacctccgccgcccgggttcaagcgattctcctgcctcagcctcccgagtagctgggattataggcaagcaccaccacgcctggctaactttcgtatttttaggagagatggggtttcactatgttggccaggctggtcttgaactcgtgacctcaggtgatccgcctgccttggcctcccaaagtactccgattataggcatgagccaacatgcctggcctgaaactccaattttaatttgaaggacacatttgacaacatatgaattaaatatatctatatggtagatttctcaccaagaatttagatgaaaaaaagagggaaaggagacagttgcaacatttatgacgagggaaacggtcactatccctaatatgcaaaggagtccatgaggaaactcgatagaaaactggataaagaaagtgagtgggaatttcacaaaacgaagaaataccgataatgaataaaaagatcatcagtctacttagtaaccaaggcaatgcaaattaaagtggcaatgacatttctgcctatcagatggccacaagaattttttagaccaaataacatccagtggatcatattccacattgtggtcgagaatagaaattggtacaatcttcggtgatggtaatttgatggagtcttttaaaacttaaaaatgctcattctctgaaaatgagcagaaaaaaagaatttgtatgacaataatttttgaaagtgataaaataaactgttaagacagtttaatttctacgtagataccatcttattcataacatattataccaagtaattctcaatttactttcaaggtaattataaatccctgaagtcattatacatctcacccaaggaattataatatctagcaataacaaaaatacattgaaaaggagtaaactgctcagcagattttgaatattttattttgaaattcaacgtggaacttaaccaaaatattgttttatttctcttggcaaagtatctcaacagagagctatttccctaggaaaaaaagaaaatcttttattccctatgaaatcaagtccactctaaggaagctgattaggaaggagaactgagtgcctcaagctcagtagtgctgtcccgtgaagatgatgtgacttggcccccaaagggtggaagagcccttaccggcatcacgagtaagggcaggtgagaaaggtgggcacctgcaggtggtgctctggggtctacacacagtgacatgcacaggtgacacaaaccgtggtatttataggagtattcaaaggcaggctaacctcaaacactctcagcttagaaatgtacagatagataacgtttaaactgagacaaagctttgcagtttatgtgaagctcaaatgctgctgaagctgctctgtttcctggcccacccatccaccagcctgtgtatcctccccaatgaacaaatgatggaccaaaatgtggtatggcaaatggcaaatgtaaaactggagcaaagagattgtcaggctctttgagaatattactttttctaaaatatagttgattgattattcttttgagagataatcataggcccagtggaagttcaaaggtatatatcgaaagtcaattggcctcccaccctctgaacttgctttgaattccttgtgtgtcctcccaggacagtctatgcatacacaaatacctcctctatgtgtaaatgtcagtggcatgctattcacactcttctgagtttgtcttatttcacttaaccatatactttggaaattgatccacatctgtatctctaaatctgactcattttttaaaagtcattttattttaaataaaatgtggattcagggcagggcatggtagcacatgcctgtaatcccagcactttgggagaccaaggcaggcagatcacctgaggtcaggagttcaagaccagcctggccaacatggtgaaaccctgtctctacaaaaatacaaaaactagctgggcatgatgggggggtgcctataatcccagctactcgggaggctgaggtaggagaattgcttgaacctgggaggcagaggttgcagtgagccgagagcaccattgcactccagcttgggtgacagagtgagacaccatatcaaaagaaaaaaataaaatatggattcagaaaactgcaaaataaaatatatggcttaatgaattatttgaaggtaaatactacctaggataagaaatagaactttgccagccaccccagaagcacctccatattccctacctaatccctgtcttctccctcccaccataagtgacattaatctgacttgttttcatttttatttttatagctttatcacccaaatttgctcccctagaccttatactttagtcctacctattctaaaaaatgtgtgctaggtcttttaagtctcttttaatctatatggttcctcctccatccatttcatttctttacaacttatcgttgacaaatctgggctagtcgaatttcccatgtctgtctttttcttttcttttccttctttttttttttttttagatggggtctcactctgtcacccagactggagtgcagtggctcaatctcggctcactgcaacctccacctcctgggttcaagtgattatcctgcctcagcctccagagtaggtgggactacaagcgcgcgccaccacacctggctaattttctgtatttttagtagagacggggtttcaccatgttagccaggatggtcttgatctcctgaccttgtgatccacccgcctcagcctcccaaattgcatgttggtagcaatttgctatgccctttacacttaagggtcagtttttctgggtataacatttttggcttatactgtctttccttgagtatgttaaatatgctaatccattctcctttggtataaagcatttttctcaaaaaatcctggtaatagtctatttttcttttccttataagtcacataagactttttcaagatgtccaaagaatttctctagaggttcaaatgattttttttttcttaagtactaataatttcagtaggatatatcttgacagcagtcatcctgggccgatattctcaagtgtgcattgaaccttttctttctttctttctttcttttttgagacaggttcttgctctgtcacccaggctggagtgagtacagtggtacaacctcagctaactgcaacctctgcctcccgggttcaagcaattctagtgccccagcttcctgagtagctgggattacaggtgcaagccaccacacccagctaatttttgtattattatagaaatgagatttcaccatgttggccaggctgttctcgaattcctggcctcaagtgatctgctcacctcagcctcccaaagtgctgagattacaggcatgagccaccgcattcacatttcaatatacattatcaaatcttttatttcaaggaagttttcttggattatagctcttagtacttcctctgttctcttgctttggttttcttcatgaggaaaacctattattcatatgtacaatagccttcaatgttcactactttctcttaaatccttctctcttcatttctttttttttttttttgtcttatttcaccttttatgtctctcgaggcattacccttgtatttgtttacttttgtgttccttccaggaacacaggtattgacatccatcaaatgtatttaaatccatggattcataataattagtctaccttacagaataattatttttagttctacttttttcctgagttgtcacttcatttccaagtttctctaattctgattgatgctgttctgccatgtctatcatgtacttaatgtctttttctgaaatagatcaaacagaagcttgctgttttatgactatgtctctctgccatgacttgtcagttacagtgttaccctattctttattctctctagtttttaaaattactttgcataggattgaacttgatactcttctagtgctcgttttttcatgtgaaatcaagttttcctaaacttttagaacaagtcagggttccctagggggacagaactaatagaatagagggatagatagatagatagatagatagatagacagacagacagacagatagatagatatagatagatagacagagaaaggggagtttattaagtattaaattatatggtcacaaggtcccacaataggccgtctgcaagcctgaggaacaaggagagccggtccgagtcccaaaactgaagaacttggagtctgatgtttgagggcaggaagcatccagcatggaagaaagatgtaggctgggagactaggccagtcttgccttttcacgtttttctgcctgctttatatttgctggcagctgattagattgtgcccaccagattaagggtgggtctacctctccaagcccactgactcaaatgttaatctcctttggcaacacctcacagacacacccaggatcaatactttgcatccttcaatccaatcaagttgacactcagtactaatcatcacaaaggccatgttaaggaatgcttttcaaacttcacagggctcctacttctgtgttcaaaaatagagccacctgctttcagggatttgctggctgtttctttcccccaatgcagatggaaactgctccttcctttctttcatccttgtcttgctcaattttgattcctctcccagcgctttctcctgagtgtggagcccttcctgatcagtcttgggaattcctaggggctcgactgctcctgcctcctcctgcctcctcctgccttctttattattattattattattattattatttatttattattattattttttgagacagagtctcgctctgttacccaggctggagtgcagtggcgccatctcggctcactgcaagctccgcctcccaggttcgcctcccaggttcgcccattctcctgactcagcctcccgagtagctgggactacaggcacctgccaccacacctggctaatttttttgtatttttagtagagacagggtttcaccctgttagccaggatggtctcgatctcctgacctcgtgatgcgcccgcctcggcctcctaaagtgctgggattacaggcttgagccaccgtgcctggcctcctcctgccttcttactgtgggcacctgaactacctcgcactagagaggcaactcttcagctccacctgctcgtctcgaattggcccacaatactttctagtgaatactggtatatctggggttcttctgttctcaggtctatcatgcctcacccccttgctttctaacttctttcagcccctcaaacccagataccatgcaactcttgaggctgttggccatttatatatgctaggttagtgggaataatttgtcacctagttttgtcataaatattttccttgggttgtgggttttgctgcctagtttctgtgtgtctgcatggggacttggaaaaactgaaaacttggacccctttgcctagaatctggtttattctttataacaggggcactgtatttatctaaccagtcccctattgatggatatgtgggttgtttctgaattttgctatcacaatcaatgtgccctattattgtttgaatgtttgccccctcccaaactcatgttgaaatttaattaccattgtaacagtattaagaggtgggacctctaagaggtgattaggccatgagggctctgccctcatgaatggattaatactgttattgtgggagtggattcacccccgttcatctctctctcacctctctttgcccttctgccatgttatgactgatcaagaaggccctcaccccatacacagttcccagaactgtgcaccagtcatctgtttattatagattgcccaatctataatattaattattattgttacccaattattactaattaatactcaatctataataataataatctgtttattatatattacccaatctgtgatattcagtcattgcagcacaaaatggaccaagtcataccctttacacaagtgcatatgagcaggtacatctgtaggatacatttctagaggtggaatagttcaataaggatatgaacacagtaggtgctcaaaaatatttgctaatttgagttagaaaatgtatttgccacaatagtaataaaatttgttctggcccacagcccaggtagacttctattgagaacaatgtacttaaatactgttaagcacaactttggggctccttgagcagaagaaagaggaaacaaaaaaagacactgattcattcctgcagttagcaatcaggtgttgcctagtgtactacagactctactggggcctggggatatagcagaggtcctagccctgttggagctcacagttcagagtggagatgcctttgttgtttgagcaactttgagaattaaatgattgctcttcatactcacaattgagtaacacttcgtaaaacgtaccatccaatctttgtctacacctagaaaaacttcagggtaaatttcagtgcagagcacagggagaacagctgtccaggataaatacttagatgtcagctgtccatttggtcatatgccatttctgagagtcagtctacaacctcctcttcagaaggcacccaaggttttctgtaaacagatgaggctgcttcaggggtacactgcgatgcttcattcctgttggtactggagtacaaatctgggaactttaaaatgcatcgatggtggaaaaaaagaaaaaaacaaaacaaaaacaaatagcaaaagcggtgtgcattgcttcagtttcagccaagttcattctctcttccagaaacccagcttccatgctgatgtccttaagccatcaatgccgtcaacaatgctgttattccctaagttcagggtcaataaaggcagagctagctccgcagctcatggcaaagatctccatttggccataacattttcccagattgacctcgtaatgtttttcaacacggtgctctggacaacctctacaaagaggtgaaggcatccaagctgagtctcatctcccatcccctatgtgactattctgcactgaaacctgggactcttcctccttctttatccctctgcagtgattcagtccccaagtccaagtctattccaatgatcccttcacctctatatttcttctactctttctgatcatcctccataagttctgctgccagattaacctgtcacccctttgaagccatgattcatgtgggctggtctcaggctgatgtgatgttcaaagaaacgcagtctagcatccacttgtattttcaaaaattgctcccgtcctttatgtctctttagtcccatgcaggagatactttgcctatagaaacatttctcaaacaccctctttgtctgtctcctactcccatcacttcctggggcttcttctgtgctttcttgtctaaactcccccagtccctagccccggactctgagacacttctcactccacccttcccccttccctggtctttgcatcacaaaagcccaaagagtcagcagggaaatgacccagcctttcttagagagcttggggaaagaaacctggtggggaaactcttttagtcggacagacagaggcatattaaaactcattaaaaaaaaaactcttaaaaaagaaaaacactttgtaaatgtaattttttctgctccttgacacagattttcccatcatcccctagcgtctaatggatagagtccacgctcctggcctgggagtcaagaccctccacgtgcacccttaacttatgtctcaagcttctctactgcttcccagccttacccctctgcccttcccagccactttatctgctgtccctgaccacaccaccaatatcccagcatgctggctcctctcttcttccccatccaattcccgattttccttccagtgtcatctcaagtggctttatctcggggtttgatgttttctgctcctcccaaacctcccaagccttctgactcttcataagagtttgttcggtgaatgaatgaagccctcacttcatgcccttctctggtacaggaatcgcatcattcaggaagcttctttgagcaactaacaggcattttcttagcttatttcgttgcctttaaaccaaggctgccatttctgcctgtgcgttctgtctgccttcgctgcacctccactccttcaagcttggattgatgacttctgttctctaattttatctgggcaatcaaattcccaaaatatgtgtaaaagagaagattgcattcctattttacaaacgtggcaactctgtggaatttttaatcagataccagcttttctgcatctctgtgatgtttttcctccttcggagtcagtagatagggccttttgctttgcattgttgaccattgtccttgccttctgacattttttgctgtcttcctcacgtgcattccacagtcagaatactgggctttgtccttccctctttcattacaagaagctctgctataaggatgttttgtgggttcctcagctctaatgaaattccaggcatttccttgaagctggcccccagggagaagctactctcactggtctgtgacgctcagctagagaggagatgacggcgtgagtttggttctgggctggaatttcttgttgcaacatcccagcgtggcccctcttagaaccttcccaccaccacattcaaatcttattcctccagcctctggcacaccttcagcctgctaccagcagagaaaaaaaaaaaaaagacatatgttcttgctccatatatccttgaggtgggcaaaaaaattaaatgttaaccatggaggaaattgtgcacatccagacaggacactgtggcagtcagatcagtgccaaattctgggaagttatcagtgatggtcatagcatggacctaccagtacctgcccagggaccacgatctgtagctggaccacatcttggtgtgccacagtgaaggcactggggacaaatatgttcctcccactatcctggtggatccagaacctgggatcatggactctgctcagatccttttgaaaccatgccccaaagagttaaagaaaccagtgactcacagaaattcttaagcctgcaggatggcagataagaaaagaaacagcttgctgaaattccctccaactataaggtaacaaaacaggctgaaatcagttgaaaccaatacggcccactggagtatacgcagaacgagactggtgatgctacgacctgaatttcctctgcatgtttcatcctaactcccccagaatttgcacgtgggccccataaaaaggcaggaagagataattgtccatgcccaaggactttgcagaccacccttttcactccctgaaccttttctaacaaaagtacagccttatgcccagcacagggagaccgatttgagctagaatgctatctccttgttgatagacctgcaataaaaagcgtttcttttctgaaaaacccagtgtcatagcgttggcttctagcgcatcgggtagtgagcacttttgcttagatctgcagaccagaccactttgttttcggtcagtttggggcaggcagcagtacacagtggagctgagctggttgattcattcctggatatgtgcagaaggaagctgagagctgtgactgccttcagggcttccagctgacccactcactgggtgagggcacaggctctggaatgggcaccctcctccacagcaagatccgagaagaggatcctgaccacatcatgaacacctccagtgtaatgccctcactcaaagtgtttggcactgtggctgagccctgcagtgccccctccccatccatccactggtagagaacactgatgagacctgcggcacagacattgaggctccttataatattcgcttccgcaccctcgagctgaccacacaaaactatgaggacctgacccacctgtctcagctaacatgcgtggggtcaccaccttcctctgcttccctcaccagctcaattcggacctctgcaagctagcagtcaatacagtgtccttcccacgcctccagttcttcatggctacctttgcccctctcaccagttgtggaagccagctgtatagggctctcaccatgcccaaactcacccagcaggtctttgatgccaagaacatgatggctgccccaccaggactgccttcttccatgaatatccatccattcatgaaggaagtcaatgagcagatgctcagtgtgcagaacaagagtcgccagcagctatttcatggaatggatgctaacaacggtcaagacagccatgtgggacatccttcctcatggccacaagatggcggtcacgttcgtcggcaacagcgcggccacccagaagctctccatggcctctcagggcagttccctgctgtattgtgcgggaaggctgtcctccactggtatgcaggggagggcatgaacgagatggagttcgctgaggccgagaacaacatgaatgacttcatctctgaacatcgacagtctaggacgccgccgcagaagagggagaggactcagtgaggaagcccagtgggaggcctaaggcagagctcccatcacctctggcatctcaattccttcagccttcttccttggctgcccctttcttctccctcagtagtcgtgtttgctgcctttaccttgtttatctggggagagggagggtctagagcagtgcctggtacatagtaagtgctcaataaatatttgtctgctgaatgtctcctctctctttccactccaggaaacctagatttctgccgatctgggtaaccgtgtatttccttctggtaccctcctcccatctgcccaattaatatgtccctctgttttcaaaataattctccaggaagctgggtcccattcagatcccatttagaaccaaccgggtgctgaaaacccagataatgtgcaccatcctatgtccacgtagtagccagcactgggaaggtagaaggtggcaggaagaagttactgcaaggggctgggcatggtggctcacgccagtcatcccagcactttgagaggctgaggctggaagattgcttgagcttagatgtttgaaaccagcctgggcaacatagcaagaccacgtctctattttttttttaagtaacaataaaaaaaaagaaagaagttactgcaaggaagaggatgggattttccattctagaacggttttggagagggaaatccaggctcataaagccataattcccaggtatttctgtgctccaattctcaggttcaggggaggtggtaacagcattatcccattttcagtttcctttggaggagtcgccccgcttcaccaagagaggtctttccttctcccaccactcctcttctctcacaaatttttttttcttttttttttttttgagacggagtctccctccattgcccaggctggagtgtaatggtgcgatctcagctcactgcaacctctgccttccgggttcaagcgattctgctgcctcagcttcctgagtagctgggatcacaggcacacaccaccatgctgggctaattcttgtatttttaatggagctgggttttcaccatgttggccagtctggtctcgaactcctgacctcaggtgatccgcccacctctgcctcccaaagtgctgggattagacgtgagccacaacgcctggccccctctcacattttggatcccttccttttccctaatcagaaaaggagattaagagggagagatctgcctgggtcccttagcctctagaaatgccctctccattcccaatttgtcttaccccttaaaaggtgtaacatccctgacatatgtgggaaggtgtgttcccccacctaaatgtttgagtcattcccaagatgagaggggatggggcaacatctcatctcttccttttgctattcccttttttcccctgctcttggttttgtcctaccctacacttcagatttctattttgggttgaacttgctgctttttcctcataatgaaaagatgacattgtcccaagagccaaaattaaatgggaattggaaaaaaatccactgtgcagattgtctttcttccctacccggcagggatgatacagggaagcagcgtccaataccacctttgttaagagcctagaagctcaaagtgtgggcactcctgagagagggccctcatgcacatgccatggcaccagaggacctggtgggacagcagcccccaccccggttcacagagcagctgccatcgcccaggctaacctggagcatgcaggtaacagtgtctgttggaggatcacacatatgttgttgctagacaatgtaccctgaacaatgcaaatatacagcagttttgcaaacatcagagcagacaaaagtcattcttgatgtattaccctcaatttggaataaatcctttgtgcaacagagcatttcccttaccctttataaaaagctccttttaaggcagacctttggacaaaccaaggggacgatgaccccttggtcagacttctttttaccaggatgtggcagagttagcctgcagtgtgagaagacaagtcctctgacaccacttgaaggggctgagacagacccggtcagggctgatggctgtcagagggctcaccactccacactcagaggtggatttttttccaattcccctgctctgtgagacagtcacactcacagagtgtctctttagaagcttttatggaagcttttaaatttgcttcacaaaatgttaacctggctgtgttttctgcattgcatatatttaaggtgtatgacttgatgatctgattggttgaatttttgattgtttaccttttccttttttcatactgctttaagtataacaaaaagggaaaggaaacttttaaaatacattggatctcatttcccctttacagacaagtattttgcttcctatgactcaacttttatattagtcaggattctccagagaaacacactcaataggctatacagagataaataagaggaaatttaggggctgggcatggtgcctcacacctgtaaacccagcactttgggaggctgaggcaggcagatcacttgaggtcaggagtttcagaccagcctggcccatctctactaaaaatacaaaaattagccaggtgtggtggcacatgcctgtaatctcagctactccggaggctgaggcaagagaatcacttgaacctgggaggcggaggttgcagtgagccgagatcatgccactgcactccagtctgggcaactgagtgagacgccctctcaaattataataaaaataaataaataaataagataagatttattataggaactggctcatgtgattatggaggctgggaagtcccacggcaggctgtctgcaggctggaggcccgggaaagccaggggtgtactgcagcctgagcccaaaggccagagaacctggggagcttatggtgtaagtcctggagtccaaaggcctgagcaccaggaatgcacacgtccaagggctggagaaaatgcaggtcccagatccagaaaagagagagagagaattccctttgcctcctccttttttgttttgtctggcttctcagtggatgggatatgcccacccacattggtgagggtgatctttacttagtcaatggattcaaatgccaatccctttcagaaacaccctcacacacacccagaaagactgctctacaggccatctgggcatcccttaatccagtcaagttgacctgtgacattagctgctgcaactcattatttcatgtcttcagctgcgatattaagaaacatgatggaatccatcaacctacgccatcagcattcatcaacacaggtgcaacttaggttaaaagatgaggctttgggggaagatattcaaagcaccaagccctacttgtcaccaaaagcagaatttcagatcagtgggtggacattgggcaggaggcgctcttatgtggcatctctcagagagctctgcagggtctcatcccgatggctgcacaaggtggtgggtgacggggatgcccgctgagcctgaggcccagggcagcctgacagagggcctgtgtctcagccctctcgggcagaaggttaggaccaggcagcctggcatcttgatttccacagcccttttcctcatcctcttggtctcatgtcctgctctggactctctaactagctggttagttcctgaccaaggttgggcttcctccactcccacctctgtttctgtttcctaattttcgtgggctgcctatctctttcttagagtcttagaaataatggctagttcatctgtctgtagccatgtctatagtgtccataggcttaaaaatgttttcacagaggccgggcgtggtagctcacgcctgtaattccagcactttgggaggccgagtcgggcagatcacaaggtcaggagttcgagaccagcctgaccaacatagtgaaaccccgtctctactaaaaatacaaaaaattagctgggcgtggtggcagacccctgtaatcccagctatttgggaggctaaaacaggagaatcgattgaacccgggaggcggaggttgcagtgagctgagatcacgccattgcactccagttcaggcgacagtgtgagactctgtctcaaaaaaaaaaaaaaaaaatgttttcacagatgatccaggaaacgcactttgaagggtcctaaatctgctttccctcccgtgagcctcttgtgaatctgaagttctcagcaggttgccagccactaatagaacagagaaacacagaaatcaatgcgaaaacctttgttgctatgttcttcttacaaaaattacagacatgtcctaggtaagataagcatatgttctctgataatgatgatcaatatcattcttctctgaaatgcaatctagaaaacaggtccccagaggctgccctgatgggtggtggctgccagcagtgtgccctgaaggagactgatctggtcacatggccctcccaccccagggtggcagcacccacagacttaggagagacacacaggagggtgactcagcctggctctcaagaaagggccaaaacacccttggtgagaaagcacagaagacgctaagacaacccctggagaaaccaaaggaagaaagttacatgcaggagacagagcctaagcagacaagagctggaagattcccctggctgcggctggagtggaggaggaccacactcccagtgcagagccacccggcaggggcccatttgagttttgaagcgaaatcaccctttctgagtactctttgtgtgtcaggcatgtgctagctgttttgcatgcatggctgggcgcggtggctcacgcctgtaatcccagcactttggaaggccaagacaggtggatcacaaggtcaggagatcaagaccatcctggctaacacggtgaaaccccatctctactaaaaatacaaaaaattggccaggtgtggtcgctggcgcctgtaatcccagctacttgggaggctgaggcaggaaaattgcttgaacccaggaggcggaggttgcagtgagcctaggttgtgtcactgcactcccagcctgggtgacagagcgagactccatctcaaaaataaataaataaataagtcacaacaacctcatgagatagacatccttacttacagatggggaaactgaaacactgagggttaaataactcgctaaatatcccatggctggtcatggtgtagctgggacacacacaaacccaggcctatcaactccagtgcctacacgcttatccagtgcctctagagggacagacacagtactgaaaagtgcctgtgaaagacaaagtgtcacctgtctcattgcagtagtggacaaatggaactctgactgctcaggaaagaagaggtcggtgctcttggagcttcactctcttgtcccatgcaggtgcagggtagaggctacggatttcctgacacccaccctcctggccatcccctgatctcatcaccaggctcatcctcccactcctggccacgtgcctggaggttctcctgtctctgcctcaggtggcttttctggtttctgggccatctctcatggcctctgtgagccctgtcctcccatgactcacagtttgctccctgaatctcaccctcagactctaactggaggatccattccagctttcccgcatctcagtcccagtgagtggttctgtgtctgtgaagcctcagaagcagaaccaatgggatgatatagaatgtgggggtttattataggaatttgatctcatgcaaatgtgggaactggttagagtttatgtacgttttttgcttctgtgcctggtcagctgtgaggaaggacagatgacacaaagtgaggaaaaggacaagctcaccctggagaatgagtttggagccctcctgggcttctccctacctctgggaagcacctgtcaggtgaattgcaggagaagctggtgcctttgccatggagctgagcatgaactacctggcccagcagacagggaattgggagaaaccggggggaagtggttgctgcaggccgggttgctctcccatgcccaggaggtgggccggcaggtcagggacagtgcacctgggctgtgaagcttgtggtgcctgcactgacattctgagcaaggtggctgctgttttcccctccaccttgcaaatctcaagaatgggtctgggccaggtgcagtggctcacacctatagtcccagctacttgggaggctgaggcaggaggatcatttgagctcaggagttccaggctccgatgaagtatgatcacaccactgcactccagcctgggcgacagagtgagaccatgtctctaaaataaataaatgaaaaggaaaaataatggttttgctaggctcttttccacactgactgatgaggccaaagaaataagtgggaagaaggagttcatggaaactgcctggctgtttctgagccactgtcccctgtcccagaggctttgcttgggcagacagagggttcatcttactgagaggtggggaaaagggcaggaaatggagagaaaggaagaacaaatccctctcatttgatcagttcatttattggatgtttcttgttagaagctgagaataaagacatgcaaaagatgcagcctgacctctggaagcagacagtatcgattatcccaggcatgtgggaggagccgggtggactctcagggtctcatcgtgctgctctcccaggtcttgccttaggcaccaccattactgcatttgagaaatggcgctggcagtagttgctcctgcttaaaatgtaagggggcggccaggcgcagtggctcatgcctgtaatcccagcactttgggaggccgaggcaggcggatcacaaggtcaggagatcaagaccatcctggctaacacggtgaaaccccgtctctactaaaaataaaaaaaataggcggggcacagtggctcacgcctgtaatcccagcactatgggaggccgagacaggtggatcacgaggtcaggagatcgagaccatcctggctaacatggtgaaacctgtctctactaaaaatacaaaaatattagccaggcgtggtggcgggcgcctgtagtcccagctactcgggaggctgaggcaggagaatggcgtgaacccaggaggcggagcttgcagtgagccgagatcgtgccactgcactccagcctgggtgacagagtgagactctgtctcaaaaaaaaaaaaaaaaaaaaaaaaaaaagtaagggggcagctcgcaccattaggatggccactatcaaaaaaaaaaaaaaaaaaaacccagaaaataagtattggtgaggatgtggaaaaatcggaacccttgtgcactgttggtaggaatgtaaaatagtgcaggcactatgtaaaacaggatggcagttcctcaaaaacttaaaaatagaattaccatatgatccaaaaattccactgttgagtatacatgccaaagaaagcagggtcttgaagtgatatttgtacactgcgttcgaagcactatcattcacattaaccaaaaagtggaagcaagccaagcatccatccacagacaagtacataaacaaaatgtggtggattcatacaatggaatagtattgaggacaacatttctactaagtgaaatgagctaatcacaaaagaacaaataccgcgttattccacttatatgaggtgcctagactcatcaaattcacaaagacagaaagtaacatggtggttgccaggggccatgcagtggggaggggatggggacacagtttcagttttgcaagatgaaaagagtcctggagatagatgatggggatggctgcacaacactgtgaatgtatttaacactactaactgtacacttaaaatggttaaaatagtttattttattttattttattttattttgagatggagtctagctctgttgcccaggctgggggcaatggcatgatctcggcttactgcaacctctgcctcccaggttcaagcaattctcctgcttcagcctcccaagtagctgggattacaggtgcccatgaccacgcccggctaatttttttgtatttttagtagagacagggtttcaccatgttgaccaggctggttttgaactcctgacctcaagtgacctgctggcctcggcctcccaaagtgctaagattacaggcgtgagccaccacgcccagccaaaatggtaaattttattatatgtgtttttcaccataacttttataaaaaacctaaggagaaatgttgaaactaccaaggagaaggtgttattgagaataaactccaacagccgagacctgttggtcctctttggtcaactggagcaggtgagaggggatgccctgacctcaagcctctcctctccaattgtttcaaggtttgcttctgtgaaaaggaaaatggaagtttacttaaaccccggcatgtgttttattttgtcctaattgtgtagccaggcattcactgttctcattagttctgccaagtcagcaccagaggctggcgaggtggccgtggagatgaacgagtccttccagatggcagagagcggtgtgaggctgaggcttgtcatagtgatatgcaatgcccctgaactctgaagctgagaacttcctttgggaagctgggtgaccatctgcgaacacttccaccccaaacatcatcatcagtggttttacgatgatgtttgagttcctagtgtagcagttaaattttacagcaaaagctataatgctcctttatactttgttaaattatctttggacaaagagttatgggagaaggtgaagaatgaagaattcctttctgaaacacaataaaaagagtggatcaatgtttttcggtagctcctggggccgtcttcccctgacaatgtttctcaacgctgaaacacacacatggtcttgcagagccagcctctgagcgaggaaaagcttggcacccccatgtcctgagtgggctcaagttcaggtttccaaggccatggtgcccaagctacaggcagccaaagtttcagatgttaccatagctaattgtaatttactcagcttcatcctcacaaagctgaggacattaacactgtagttagcaccattttccagcaggggaactggggtttagacacagagttaggttttgctcaaggtcatgcagcaagtaaacgtgaaaaatgaggtttgaacccaggcaatctgggtttagaggctgaagactttactacatgcagcttgggctctggtggcagagatgtcaacgccatcagaacaatacagaactcatgaaagctccagttccagataggatgttgaggacaccacaatgtcagaaggtgtcacactggttttgtttttaaatcaagaaggtgctaaaaggaggcaatcagataataggagaaaaaaagtcactactgggttggggcacatgcatgagcctgcagggacaggaaggagggagggtaaggtatctccaccagaccctcaactcaccctctccctcctcctgggttcaagtgattctcctgcctcagcctcccaagtagctgggattacaggcgcccaccactacgcccagctaagttttgtatttttagtagagacggtttcatcatgttggttggtcaggctggtcttgaactcctgacctcaggtgatccacctgcctcggcctcccaaagtgctgggattataggcgtgagccaccgcaccaggcttccagtcccttcttttggcctctagttataaaggtaattgtaaccatgaaatatccaggatataagttccctttgcccactggtactttcgacttggtttatccacgttttcgtgcactctgtgtcttcttagtctatatcctatgatagttattctacgattcacacaatatccattctctcatttcttacgaccaaatttaacttcaaccttttctaactttgtgataccagaaaatcaaaatgatttatctctttccttctgtctcccaataacgcgcacacatgcacgtgcgcacacacacacacacacgtacaatatagtttctagaaaatgttcatctagctcggttttctggcccttaaccgaatgtgtgagtagtgtaaggatgcattttcttgatcctgtgctatgtttaaagcaatatgtctccatctgatcagggttatgtctctctacaaatgctggatttatgtaaatgccactctgtctccaaccagtacagcacatgatttagctgtcgttcagtgatgttattttggagaactgcatgagctctaactacagaatttaagaaattctatattaaaggagaagaaccagcatcagtgctggcttttacaaaactatttatttcaaaataattggagacccacagggacttgtaaaaataagaaatagagtttgttgagccctccctcaccttacttcctccagtggtgacatcttttataactctattgcaacatgagagccaaggaccaagaaattaacactgctacattacactgcaaccttactcagttttcacttatttttaccctgcattaatttgtgtgtgtgtgtgtgtgtgtgtgtgtgtgtgtgtgtatagttttatgcaattttaccctatgtgtagatttatgtaatgtcaggatcaggatacggaaccattctatcatctctggggaactatctcatacccatcctatccaggctcacccatccacccacccgtccctaacagcaaccactaacctgttctctatctctatagttttgtcattttgaggatgttttgaaatgaacttgtacaatattttttaaaaaaaccatttcaaattggctgtttttactaagtaaaatgaatgcccttaatatccatccaagctactgcatgcatcaatagttttcattgctgagtaatattttcttttatggatgaaccagtttgttcaactcttcaccctttgaaggacatttgggttgtttccactgtttggttattatgaataaaatcgctgtgagtgtacaagtttgtgtgtgaatataactttccatttcactactgggttgtattgttagtacatgcctagtttgttgttctctttttgagatgaagtctggctctgtcgctcaggctggagtgcagtggcaccatctcggctcactgcaacctccgcctcccaggctcaagtagttctcctgcctcagcctcccgagtagctaagactacatgtacttgccaccacacctggctaatttttgtatttttagtggagacagggtttcaccatgtcggccaggctggtcttgaactctgacctcaagtgatccacccacctcagcctcccaaagtgctgggattacaggcatgagcctccacacctggttgtacatgcctagtttttaaagaaacttattttccagagtggttataccattttcacacttccactagctatgtgtgagaattccagtttctcaacatccttgccaagatttcatgttatgcctatttttatattttagctatttaaaaaacaatttttttcttttcttttttattttattttttgctctgtgcccaggctggagtgcagtggcatgatctccactcactgcaacctccgcctccctcgttcaagtgattctcctgcctcagcctcctaagtagctggaattacaggcatgtgccaccacacttggctaatttttttgtattttagtagagacagggtttcgccatgttggccaggctggtcttgaactcgtgacctatatgatcaacccacctcggcctcccaaacttagaatggtttcttcatgttgttgctagtacataaaaatacaattgatttttctgtgttgatcttgtatcttcaaactttgctatactcacttagctctaggagttttcctagatttctgatagggtttggctgtgtccccacccaaatctcaccttgaattgtaataatcccgacatgtcaaaggcagggccaagtggagacaattgaatcatgggggcggtttcccccatactgttcttgtggtagtgaataagtctcatgagatttgacggttttataaatgggagctcccctgcacaagctctcttgcctgcctccatgtaggatgtgactttgctcatttgccttctgccacaattgcgaggcctcccagccatgtggaactgtgagttcattaaacctctttccattataaattacccaatcttgagtatgtctttattagcagcaggagaacagactaatacagtatcttacttagcattttttacctaatcaggtcatctgaaaatatggacagttttatttcttcctttttgagctgtatgctttttattttcttttcttgccttattttactgactgaaaacttgacaggacacatccttatcttgttccatatcttacaagaaaaacgtgagctttcaccattgagatgatgtcaactgtaggattttctgtagatgatcttactcaagtttaggaggttccccttcatacctagtttgctgagggtttttatcataaaatgataaagacaaataaaacaaatacaataaaaaaacaaataaaaataaactgtctttattgttgccagtcttgagataattttgtcatttttactgatattttcaaagagccagctttttctttgatttctgctcttctctttgttattttttccttcttttcctggtttcctggggtgggtgcttaatttttgaccttaggatctttcttctttcctaatataagcatttggtgctgtaaatttccctctgtgcagtgctttagctgcatgtcacaaatttcgatgtgatgtgttttcgtttcatgcagctatgggcacttttatttttctaactgactttttaagccattttaaagtatacaattcagtggtattagtgcattcaaaatgtcatgttaggccaggcgtggtggctcacgcctgtaatcccagcactttgggaggccgaggtgggtggatcacgaggtcaagacatcaagaccatcctgggcaacatggtgaaacttcgtctctactaaaaatacaaaaattagccagccatggtggtgcatgcctgtagtcccagctactcgggaggctgaggcaggagaattgcttgaacctgagaggcggaggttgcagtgagccaagatctcaccactgcactccagcctggtgacagagcaagactccatctaaaaaaaaaaaaaaaaaaaagtcatgttaccattaccagtatccatctccagaatttttttcattatctcaaactgaaactctatccattaaatggtaagtccttattccccgttttgctagttcctggtaacctctattctactgtctgtctatacatttgccagtcctaggtgcttcatacaagtgaaatcatacactttgcctttttgagtctggcttatttcactttgcacatgttttcaaggttcatcacatgtggtagcatatgtcaaaatttccttcttttttaagactggataataattcagttcatcgtatgtatgtgccatatttcatttattcatccatccattggtgggctcttgggttcttttcacctattgtgaataatgctgctgtgaacagcaatgaacaactacctatatttctgctttccattccgtgtaagtatatacccagaagttagatgactggattgtaaggtaattctatgtttaactttttgcacaactcaaactgttttccacagtgactgcatcattttacattcctaccagcagtgcacaagggttaaatttcttcacatcctcaccaacacttgtcattttcaatttgggaggataataagtcatcctaatgggtatgaagtaatattacattttgatctgcatttctctagtaataatgtttaacatctttgatgtgtttattggccatttgtacagctcctttggagaaatgtctattcatgtcctttgcccatttttaaattgagttgcttgtggtttgttactattgttgttgagttgtaggagttctttatatattcaggaaattattctatgtgatcttactctctttacatttgtgaaggtttgttttttatgatccaggttttcatctatcttaaatgttccacggtgcttgaaaagaatgtatactatgctgttgtcacttagaatattctatcgatgtccattagatcatgttgattgatggtgatgttcagttcatctgtatctttgctgattttctatctaatatttctatcaattgctgacagaggggaattcaagtacccaaccataattggggaatcgtctagttcttttttcagttctgtttttacttcatgcattttgatgttctgtcctttggtgtttggtacatgcacatttaagatcactgtgtgtttttggatggttgcatctttatttatttatttaagacagatcctcactctgtcatccaggctggagtgcagtggcaccatcttgactcactgcaacctctacctcctgggtttgagtgattctcctgcctcagcctcccaagtagctgggattacaagtgggcgccaacacacccggctaatttttgtaattttagtagagacagcatttcaccgtgttggccaggctggtcttgaactcctgacctcaagtgctctacccgcctcggcctcccagagtgctgggattagatgtgtaatccactatgcccggccaggttgcatctttttatcattatgtaatgtccctggtaattttctcttggaagtctactatatctgttatgaagccactccagttggcatggcatatcttttccatccttttatattcaatctacttatgtcattatagtgagtttcttaggtgcatcacatagatgggtcattttttaatccattcttccaatctctgtttttcagttcgtcactaattatattttacagagatcatttatattaaaaataattattaatcgattagggctcaagtctaccattttattattgatctcctgtgtgttgtctccagttcttgttcctttgtgtacctcttcttgatttcttgtggattacctgaatgttatttagaatttcattttgatttgttcataatgttttttattcatttgaataattttcttagtgtttgctctaggtataccaaaatatatgaagcatatcgcagtctactagtattgacatttaccatagtcaagtgtagaaactttacttccctttatttccctttgccctctccaatttttaaatatcgttttaagtacttctatatacactgagtaccataccagatggcattataatgtttgttttaaccatcaaatataattgcataaggagaaggatagtctattacgtttgccctttttacttattctattgtttttttctttcattctgtatttcctttcctctttctgtcatctccatctgctatcacttgcattttgtttctttagctgttctttaaaagtagatttggctgggcatggtggctcatgcctgtaatcccagcacttcaggaggccaaagcaggtggatcacttggggccaggaattcgagaccagcctggccaacatggtgaaaccccatctctactaaaaatacaaaaattggcggggcatggtagtgcacacctgtaatcccagctactcgggaggctgaggcagcagaacgcttgaacccaggaggcggagggtgcagtgagccgagagcatgccaccgcactccggcccgggtgacacaatgagaccctgtctcaaaaattaaaataaataaataaataaaatttttaaaaagagtaaatctgatggcaacaaattctattcctttgtctgcgaatgtctttatccttcagaaataaatggtactttcactagttttaggacatagggtttataattctttatttttcagcccttgaaaaatgctgggctacttcctcctggtctccatggtttcagatgatgaacattctgtcattcaaatcattgttcccctgtaactaattcatcgtttctttctagctgctttcaattgtgttttttggggatttttgtcttcagttttcagaagttttattataatgtatcttgatgtggattcttttggttttattctgtttgagattcacttagctttttgaatctaagtttatgccttgcaccaaagttggggaattttcagccattatttcttctggcgccttttcagcttcacaaattttctcctatcctggaactctgatgacataaacgctagttcttttgtcattgtcctgcaggttatgagactttgttcatttttttcccccaggctattttctctatttatttatttacttagtttttgagacacagtcttgctctgtcacccaggctggagtgcagtggcatgatctcagctcactgctacctccacctcccgggttcaagtgattctcctgcctcagcctcccgagtagttgggattacaggtgctcaccaccacgctaatttttgtatttttagtacagacgggatttcaccatgttggccaggctgatctcgaactcctcacttcaggtgatcccccgcctcggcctctcaaaatggtggcattacaggcataagcctgtattatttagattgagtaaattttatttctctattctcacattcactaattttattctccgtcatctctaagctagtacggagctcattcagcaaactgtttctttcagttcctgtatttttagttctatgattttcatttagttccttttttacatcttctatttctttgctgagactttctatgtttacttgtttcaggagtatttgtaattgcttgttgaaactttttgtgatggcggctttgaaatcttcatcagcaaatttcaactgctgaatcatcttcatgtgtgcttttgtttgtggtctgtggccattcaagttattttctgggttcctggcatgacaagcggtctttgattgtatcttggagactttgggtactatgttagaagactcagggtctgtcttctttaaagtttccattttagcaggcagtttccccgtttagacttaggatgcaagtcccttaggctgcgggtccaatgacgactgagttttcagagcccctgtagtgctactgtagtcaagtttgttagtgtgccacctgcggggcactctgcaatgcgtatgtacatctgcatgtgtgaaactttcacactggtccagttctaatcttttgatgtgttgaactggtcagtttttacctttgggttgatcagctgtctgcgccagaccttctaggcagggcttaaagaatcattttctccagctttttcctatctgagatcctcttccccatgtctagctgggggtggggacagaagtccagactccccactccatctctgtggacaccatgccagtagggaaggaacttgctgccaacagctgccaacaacttgctgccaacagctgccacctggccctggtggatgggagtgggagtccacaccccctccctggcctctgctgatggcaccagcccaggctgcctgctgctgctgggcggggcataggagtctagactctcctttgagacttcactgcagtgctggagttgctaaggtgtgcacttagctggaggtaaagtggatattatcaaaaaggacttccgtcctgtgggctgcccatttccctgtctctgctagataaataaggtttttcttcaagctttattttccatctgtgccttatggtggttctggattgcaggcttctctagcacccagtccagaatatagcaaagataaaaagaaaacccagagtgtcgccaccacctcagtcctcaagtcttgagttctcgaaccaggctgcctgcctctttttacttttccaagggtccttatgattatccattaaattatttccagggtttttagttttacttaacaaaaaggagcagagggaagtgaatctacttgtctaggaccagaaagccagctgcttttttatgctgtcttttattttgtagctagaaactcctggatttttttcctcagaatgttggagtcaatgtttcttttattttcaaatacagaaatgtcttataacctgtttactaaaatgataaagaatcaggttaacagaggccaggcacggtggctcatgcctgtaatcccaacactttgggaagctgaggcaggtggatcacctcacatcaggagttcaagaccagcctggtcaacatggcaaaactctgtttctactaaaaaaaatgcaaaaattagctaggcatggtggtaggcacctgtaatcccagctactcacaaggctgaagcagggagaattgcttcaacccaggaggcagaggttgcagtgagccgagatcccaccactgcactccagcctgggcaggtcccaagagcaagccgcaaaggtccctggcaagtctcagcccgtggctggatcctccctctgctgcctctacctgttggttttacatcaggtttcccacctggtttcttcctggaagcccagtcttgcagggggtacaggtgattttggacggtaatgcagagagaccagccactctccactgtgagacaagttgcatgaggatgaggcttcagaggtctggcctgaccttgattcaggtgcgatgtcaggaaggaaacaaacgttggcattaggattgcatccagcatgaatgaattgtgattgctgaatgagtaaacttttagttggaggaacatttccactccaaactcccgtgggagtaagttcttcagaaactgccttcagtgtgccccaggattctgtgaaagtgcagagactggcaccaccaactgtcagccttctccagggcaggatgacaacatgtgtcaggtcccactgaattgcccaaaaggctgaataagcacatgtaccagctttccaaggtccccgaggcttcagggagagggaggggttggaggaaatattgattccaacttttgaaagaaaagaaaatcaacattaacatccatagatctataagatgtattttatgtcaaataatccattgtaattcaatttacatgtaggaatataaaattgcatttgatgttggggggggcgggcattgaaatgtatttggtatgacatggagtggagccttcagtgtttttaaaagggcccagctgaaccaggaaaggagggacaaaaatagaagggtggggagggaaaagatcagcttcaatcagttcatgcacaattttgcaatcagaaatgtcagaaggaaactattttagtgtccacacacttaagttttgtgaaatggggtgagggggccgggcacggtggctcacgcctgtaatcccagcactttgggaggccgatgtgggaggatcacctgagctcgggagttcaacaccagcctggccaaaatggtgaaactgtctctactaaaaatacaagaattcactgggcgtggtgacgggtgcctgtaatcccagctactcgggaggctgaggcgagagaatcgcttgaacccgggaggcgaaggttgcagtgagtcgagatcgtgcctctgcactccagcctgggtggagacttcatctcaaaaaaaagaaaaagaaaaaacggggtgggggtttcatgaggggctcactgctcggggtcttacctgggttctgccagtggtggggctgttactttccactggcagccacaccaagctggccacacctggcacctctggtgtggtggctggggatgccctggagacgaggtcttcagatgccccttcatgtgcaccagatgccaagtgcctgctgtaggggagggtggcggagaccctaaggttcggtgtgcaggaggattagccggtttgccagacaagcttagagcatgtctttaccccacttgccctgtggggtaagggtaagaactgtcaccctttggtgctggctcctgtgccaggaccccctcccaggacaagtgcacacgatcccctcccagcagagcttggatatagccctgcaacttgcagtaggctccgcccacctcttccctacaacccccactcctgtttggggctgtaaaagtagaaaaaaactcccataaaacccaaaatgctttttctactctcaccccacaaaaatcaacacagaagacttctatggccaaatgtgcagggatttctccccaaaaataaacaagcaatcggttctgcagtggacaccagctgggtatcccccaattcagttccaatactgtctacctggagagagtatcagatcccagagggtgagggctctgtgcccaagactaccccccttcccagccccgctagataccagcaacaagtccggggcctccagaactcctgcctgactggcttcaagttggggtccccatggctcctcttttggtttgattaatttgctggagcagctcacataactcaggggaacacttaacttacctttagtggctgatcacaaaggacacaaatgaagagatgcacagggtgaggcatggaagagggagcacgaagcttctacgccctccccagggaccaccctccaagaagctccccgtgttcagccatccaaaagctcctgccatccagcctcccgagtagctgggactacaggcgcctgccaccacacccggctattctttgtatttttagtagagacggggtttcaccgtgttagccaggatggtctcaatctcctgacctcatgatctgcccgcctcggcctcccaaagtgctggtattacaggcatgagccaccgcacccggcctccttagggtttttatggaagcttcatgactgattaaaccactggccattggtgatcaactcaacctccacgttggggggttgggctgaaagtcctaaccctctaatcctgcctaggtgttgctcgtaaccagccccaaccttcctaggtgctgccagccagcagtcagttcattcatgtgcaaaaagacatcactgtgtagttgctaaggatttcaagagtcatgtgccaggaaacggggttcacaatatcacaggggccatgctgggtctcccatgagcctgagacacccagcctcgtccatagtgtgctcaggagtcctgcactgtagggcgggatgtgcaccccgtgcatgggacaggggacacagaggacacagaggagctcggaagtgtggcaggactaggccacgatgacccattctcctgccaaggaatagcgagagaaggctccccagggtgcagccacagcacacctagggggtccacggaaacagaccccgtgtaggcctctccctgtgagttcaggtcatctgagactgatcattcaagccccagccatgcgctgttgatgatgtgagaccacagcttatccaggaatcaaaacagaggtgtctgctccagccacctgtgatttatgggctttaattgcagacctgctcctgtcttataaaatcaggatggagcctccactgctgaggcaaggaaaagatttgtctaaaatattggctgctgtcgtcgatactgggacctcttgagccaggtcccttccacattctgatgaggtaaggctgctctggaagaaaaagccctccagaacataaatctatttgacaacaaatgtctccttctcatggcgagccaaatccccctgtgcaggagccagagatacagacacagaaaaagaggagctggttcagtcttcaaggacagaaagaaagagaaactctgcctggtgctaaagcaggccctctttgcagctcattccaagcctaaaccagctcctgcaactctcaccaaagctgtagctcttcacggggatggaaaagcaatctcgtcgcgtgtggccattgggatgattttctcctcccctcatgcctgctgtggacgaggggcgtttcctcacgtcgcaactgttgctttggccaatggaacgttagcagttgaggtgtgggcaaagtcctggaatgtgcttgtgcgtacagttggctcagctcctgggctctggcccttcaccatgagaacacgtccaggtgctgctgatcaaaggaggaggaacccgtggggcacatcagaggccgccctgcagcttagagcccagtgcagctgagcccagtggcctgcacagctgtgcatgaagaatgaacattggttgctacaagccactgaaattgtgaagttgtctgctacacagcaatattatgccagtagtccatcaccacatccaggactttagagaagcaagaccctgatacgacgctcctgccaccatctcagaattatctgaaaaacaaccctgacaccaacataattttttctctctcacaaattcaaattatattattccctcagtctgtgagtcaggggttattttatttttaaagtttgctgcctcctcagtatatgtaatttgaccctaattttgtaagacatgaatatagctaaatatattccagagatgagactgaaatgctcaagatggtgacagcagtatttctgggttgagagatttagagtgacttatgttccaccaaaaacatttctatatttgttcacattttctataatgtcattattttatgatcaactatatatacttgatttttgaacagataaagcttaacataaacatggtttaaacataaagtttactccccagaaactttgttcagaatgtcaaaaacacaggacaggaagataagtaaatcctcatacagcagagtcactgttcaccctgggaagggaggtaactgccagaaacccaaacaaagggatcctcagatgctgttggcctcttctgcttaggaactgatgtcagaaaatatttgtccttgagaaagccagcccctgattaaatgttactatgctctgatacaatgtcagtaaatcatttccaaaaccccaaacactgaaatagtagggggtggcaatgaccacttgggtgatttctcacctgggaggacatcataaaggtaaagatgagcactggggtacaaatgtgcttgcaatggggacatatgcagtgagcagagagtggggcacacacctccctagactcatttctcagaaacacatcaggtcacccactttctctccaaaagcagaagtcagattgagctcatgttcccttgtccatgaataactggatgtgtgaggttatgacagatttagaacctgccaaaatcagagtgagtgagagagtgagtgtccttcctgggctagaacatactctacttctctgaagttgaacaagatggaaatttcataacctcaagggacagagagaacactgcccactgcagatggtaatattcaggggcatcctccagggttcctcaggtgggcagaaccagaatgggtcatgggatgagagatctattacgggaacgagaccttgccagttgcaggaggagctagagaagagaaggtatgagagggaagtgtgcagagcggaggagtcaccaactagctggtctgagaaatcaagctcgtcgcactgccaacgctggtccatgaaagcagaggagacatctacagcaagctatttcttcagccaagcacctgaagatggtcggagttattgttggccaggaggatgccccacagtgaagaagaccaaatggacatggagtacaaggacacgcaggaggctgtggcacctccaagtgtgtctgtcactgcacctaactgcgttgaccttcagagggtaatggctgctgcctgctgatcagaattggctcagtcctttctgcaaggaaggaaggggaaagggaaatcaaaaggaatctggccttgtcagtttctatggcgaggctctgccagcaaaaaacagtggctatgggccaggcagcccagagtgcctgctgcagggccagctcttccagctaagggcttctccacctcggcactgctgatgtttccagcccagtgatccttggtggtgggggtttatcctgaacaccactggtctctatccacaggattccaagggcatagtccctgcaagtcataaccaaaaccatctccagacattgccaaatgtccccagagtggtggcagacaaaaccctgccagctgagaaccactgttttaccttctgcatctcagagtgctgaatcaaggtttaagaacataatgaagcttattcagtcacattgtgctcactaaaaacattgttttaaaaagttttagtgagaatagaaaggatttctgtgcaattaataaaaaacaaagggctgggtgtggtggttcacacctgtaatcccagcagtttaggaggctgaagcaggaggatcccttcaggccaggagtttgagactagcctaggtaacatagcaagaccccatctctacaaaagtttaaaaattagccgggcgtggctgttgcctagcaagtaaataaatccagtgttctatttttctatcactgtggcattcattgcctttcctttaacaattctggagattccactaagattgccttgtcgattctccttgtctggagcagtggacagcccaatctgaggagtgtgagccctcagctcaaagggctgagcccacggtcaggggctctgctgctttttgtggtgagtcactcaacagcaataatgcctttcttgtttgtggagttataacctgaatcctggtcagcagtttccaatgcatgactcagtgtgagactttgttgggatgctaaagtgatttgttgagttttcaaccttgatttgtaacttatctattaactctcttttgaaagaaatctttgtcgtggaggagtaaataagctactgagcatctgcagagtcccacggctctctaaatttctgcctattccatttatagtctgcacttcttgttcaaatgcatgttgggtcgtggagaccaatgctgtccagaaaaaaactggccgagtcttgactcaatctgaaagtctctctgttacacaaaattgtcatttgccatacttatcataattatctgtcggtttgtctctctgtttcttgtcctaaaagttctgccgaaagtttgtgattgaagcatttatgcaaaagtcagacgtaacaattaaaatggtaaattttatgttacatatattttatcacaataaaaaataagtcaaatgctggctgtacaaactaaaagtaaagagtgagacatagacttacgggaggcagctagagcagttcttacagataaatttataattgtaaatacttataataacaaagaaaaaagatctcaaatcaacaacttaaccttccacagtaagacactgtgaaagaacagcaagctaaacccaaagcaagcataagaaaggaaataagaagaattagagaggaatttaatgaaataacaattagaaaaacaatagagaaaatcaacaaaatcaaaagttggtttttgtttgctttttttttttttttttgagacgaagtctcactcttgtcacccaggctggagtgcaatggcataatctcggctcactgcaacctctacctcccaggttcaagcgattctcctgcctcagcctcctgagtagctgggattacaggtgcgcaccaccacgcccagctaatttttgtatttttagtagagatggggtttcaccacgttggccaggctggtcatgaactcctgacgtcaggcagtctgcccgccttggcctcccaaagtgctgtgattacaggtgtgagccaccacgcccagccagaagttggttcttgtaaaagatcaacaaagttggccaacctttacctaggctgactgacagaaaagagagagaaatcaaattactaaaatcagaaatgaatgagaagccattgccaccaacttacagaaataaaaaagaattgtgaggaaatactatggacatctgtatgccaacaaattagatgacttaggtgaaatggacaaattcctagaaagacacaaactccaaaactgattctagggaaacatagaagatataaatagtcatagaaaagagattgaattagtaataaaagaaaaaatctaggccaggtacagtggtataagcttgtaatcccagcactttggaaggctgaggtgggtggatggtctgagctcagaagtttgagactagcctgggcaacatggtgaaaccccatctctacaaatacaaaaaataaaaattagccaggttcagtggtgtgtgcctgtagacccagctactctgggagatggaggtggaaagattgcttgagcccaggaggtcaaggctgcagtgagactgcactccagtctgggcaacagagtgagggcctgtctcaaacaaaacaaaacaaaacaaaacaaaaaaaccaaaaagaaaagaaaagaaaaaagattcccacaaagaaaagcacagcactgaggaattctaccaaacatttactaaagaattatactgatctttcacaaaatcttccaaaaaatacaacagaagccaacactttccaactcttcctatgagcctgataatagcccaataccaaaaacaaagatatcacaagaagagaaaactacagaccagtatctcttatgagtacagatgcaaaaattctgaacaaattactaccaaattgaatccagcaatgtgtaaaaaggatttacaccataatcaagtgggatttatcccaggaatggaaagttggcttaatatctaacaatagattattttaatacaccatgcctttacaataaaggaaaaaacacacaacaatcttaatagatgcaaaaaagcacttggtaaaatttaatactctttcataatttaaaaaagtcacttttaaaaactagcaatagaagttcctaagcctgataaaaagcatctatgaaaaacttacagctaatatcatacttagtagagagactgcctacttttcccctaagatcaagatgtctgttcttgccacctctactcaatattataccggaagttctagccagcgaaattaggcaagaaaatgaaacaaaagtcatcaaaattggaaaggaaaaaataaaaccatcactatttgtagattatctaatcctgtctttacaaaatcctaaggggtctaagaaaaaaattaatattagaactaataaatgagttcagccaagtttcaggatacaagatcaatatcaaaaaatcagttgtatttctatacattagcatgcacaatcaaaaaatgaaagtagaaaaacaggctgggcacggtggctcacgcctgtaatcccagcactttgcaaggctaaggtgggcagatcacttgaggtcaggagttccacatcagcctggccaacatggtgaaaccctgtctctaaaaaaagcacaaaaattagccgggcatggtggtgcgcacctgtagtcccagctactcagaaggctgaggcacaagaatctcttgaacacgggaggcagaggttggagtgagccaagattgcgccactgcactccaccctgggcaacagagtaagactctgtctcaaaaaaaaaaaaaaaaagaaagaaattagaaaaacaaattcatttacgagatcattaaaaggaataaaatacctaggagtaaatttgacaaaagaagtgcataacttatgctctgaataccacaaaatgttgttgaaagagattaaagaaactctaaatatatgcaaaaacatatcccatgttcatgtattcaaagacttaataatgttaacatggcaatattacccaaattgatctacaaaattaaagcaattcctatcaaaatcccagctgacttatttgcaaaaattgacaagctgattctaaaattcatataggaactcatggacccaaaatagtaaaaaagaaaacattttggaaaagaagaacaaatctgtagcacttaaaattcccaatttcataacttaatgcaaagttaacaataatcaagacagcgtggtattggcataaggatagatatatagatcagtggaatagaattaagaatctagaaatgaacctgtgcatctctatattcaactgattttcattaatggtgccaaaaccattcaataggggggagagaataatcttttcaactgggtgtggggaataacaattatatatatacatatatatatacacacacacatatatatactgtatatacacatatatacatatatacacatatatatcatatatacatatatacacatatatatcatatgtacatatatacacatatatatactatatactatatatatactatatatatagtgtatatgtatacatacatacatactatatatttttttgagacggtgttttgctctgtccccaggctgaagtgcagtggcacgatctcggctcactgcaacctctgcctcccaggttcaagcgattcttctgcctcagactgccaagtagctgggactgtaggcacacgccacgacacacggctaattttttgtatttttagtagagatgggatttcaccatgctggccaggatgatctcgatctcttgaccttgtgatccacccgccttggcctcccaaagtgcagggattacaggcatgagccatcgcgcctggccaataatattcttttcaacaaatggtgctgggacaactggatgtctacatgcaaaagaattaaattgaacccctacctcattccacatgcaaaactgaaaggcaagtaaaaacgaattaaagacctaaacgtaagagctaaaactacggaattcttagaagaacacatagacttaaatcttcacaaccttggattaagcaacattttcttagagatgacaccaaaagcacaagaagcaaaaccaaaagtagataaattggacttcactaaaactaaaatttctgtatttcaaaggacaacattaaggtagttaaaatacaagcacagaatgggagaaaatatttgcaaattatcctatcaactcaacaataaaaacacaaataacacgactgaaaagtggacaaaggattagaatagatagacatttctcccactatacaaatggaccaataagcacacaaaaagatgttcaacatcattagccaccagggaaatgcaaatctaaaccacatgagacggcacttcacatccaacagaaaatctagactcgaaaatacaagtgataacaagcatcaaaaaagacatgaagaggctgggcacagtggctcacgcctgtaatcccagcactttgggaggcggaagcaggtggatcatgaggtcaggagattgagaccatcctggctaacacggtgaaaccccatctctactgaaaatacaaaaaattagccgggcatggtggtgagcacctgagtcccagctactctggaggctgaggcaggagaatgatgggaacctgggaggcggagcttgcagtgagccaagatggggccactgcactccagcctgggtgacggagcgagactctgtctcaaaaaaaaaaaaaaaaaagaaagaaagaaaaagacttgaaggaattgtaactctcatacactactgatgagaatgtaaattggtacagtcactttggagaacagactggccattcctcaaatggttaccatataccccagtaattccatttgtaggcgtatactgaatataaataaaaacatatgcctgcataaaagcttgtacgtgaatgttcaaagcagcattattcataatatccaaaaagtggaaacaacccaaatgtccaccaactgatgtatgaataaaataaaatgtggtatacattttactggatatcatttgtcaagaagaataaatgaactgatacatgcttcagcaggaatgaaccctggaaacagcatgctaagtgaaggaaactcgttccaaaagaccatatgttctatgattttacttttgtgatgtgtccagaaccggcaggtctttacagatagaaagtagattaccggttgccaagggctgatgggacaatgacaaaggggtgcagagttcctcttgggaaaataaaaacgttctaaaatggattatgtgataaccctatgaatatatactaaaggccatttaattgtgcactttacatgggcagattgccagtatataaatgatatctcaataaagccggttatcgaaaggagtcatatagagacagggaagtaaacgctcaaagggttctgcctgaattcatcatcacagaagtgagtcctggccgggcgcggtggcccacgcctgtaatcctagcactttgggaggccgaggcgggtggattgcctgagctcaggagtttaagaccagcctgggcaacatggtgaaaccccgtctctactaacatacaaaaaattagccaggcatggcagcatgcacctgtagtcccagctactcgggaagctgaggtaggagaattgcttgaaccggggaggtggaggttgcagtgagctgagatcatgccactgccctccagcctgggcaacagagcgagactccaagactccatctccataaaaaaaaaaaaaagaaaaaaaaagaaagaaaagaaaaagaaaagtaaagaagaaaaataaaaaaaagaagtgggtcccaaagttactaacccagtcagaagaaattgggatcagccaggcatggtagctcatgcttgtaatcccataattccagctctttgggaggccaaggcaagaagattgcttgagcccaggaattaaagaccagactgggaaacacggcaaggtgccatctctgaaaaaagagaaataaattgagttcattgggagaccacaaacttaagaggaacaccaaatacacactatagcaggacattatcagagaattcttagaaatggagcatatggaaaagaaaagaaatccatggccctccaatctgcagagctcactccaaaccttaaagccagggatgatgagacgtgagaattctgtttctcagttaacctagaattaagtctaaatggtgaaaaaaaatagatgtagatcctgccaacagcagggactttggaaaaatgtgtccagcatcaaaggaggactcaaaggcaaaagcattttgaaaagaaaaggcaaagcatgcaaggcagtcagacatcaggagcatttacccaccaaatcagaaagcacgaatgttgaaaaccgcagcaatgatgcctccctgcaacctcaccaaagttgccacattacagtagcttgttcatggtggggaaccagtcgtttttctcatgtgattaccttatttatttatttatttatttattttgagacagagtctcgctctgtcacccaggctgcagtgcagtggtgtggtctcggctcactacaagctctgcctcccagggttcacgccattctcctgcctcagcttcccaagtagctgggactacaggtgcccgccaccatacccagctacttttttgtatttttttagtagagacagggtttcaccatgttagccagaatggtctcaatctcctgacctcgtgatccgcccactcagcctcccaaagtgctgggattacaggcgtgagccactgcgcctggccgtgattaccatatttctgaaagacataatacttttgtgggaaatgctcagtattttattgattctgggtactagaataagacatgatttatttcagagtgaaatatgtgaggtttttcctgactgtggcaggtcacactggaagcagggcaaatgtcagatttatgtttttggtcttgtcttgaaagtaaaaggccagttgtagtcaacagagctcttgctggcataattccaaaggccataagagtgcttggctatgtcttctgttctctgattcagaagaaaagaaatcattgattgtgttagctttctattgatgcctaacaaattacctcaaaattagcagcttaaaacagcacccgttgatcacctcaccattctggaggtcagaagtccaggtggcttgactggcttctctgctcaaggtctcacaaagctgatattgaggtgtgggccaggctgggtttttatctgaaggctcgaggaataacccatttcgtgcttactcgggatgccggcacagttccgttccatacagttgtaggactggggagcttgtttcctttctggttgtcagctaggggtgaagagccactgtccttctctacgtgaggccctctgtgtcttcaaaccagtgatggcacttcagttccttcttgtggttgggctctttctccttctgccttctcttctacctgcctcttctcccatcagctggggaaagtcctctacatttaaggactcgtgtaattagattaggctcacacagataatctcacaggttaatctctgaatcttaagttcagctgacttgggaacttaattataactgcaaaatcccttgttggcagtacctagatgaacatttgatggaataaccagggatggaaatcttggggcatggaggcacttttaggacatggcctaccatatctatagacataaagagacacaaaggcctatttctagttgacacaagggccactctgtctatcctgaaccctactgcaataaaacaatcactcactcagagaaatcaatgggttactacagtgggtatttcaaacccacttctctatccattgccttgaccaccatatgaggaccaacagaagacaacattgatttctcctccgtggtttcatgcctctccacccacctggaacaggccctttatataaatgcagctgtcatattaagtgcccacctgcaagaaccacccaatttcacagcatgctatttctacacttgactttcctaaacttgcctagaccatgactcttgaaactgtagataacttactctggctggtacattgcaatttatgagcaaaagctctgttaatggaggacatacaataggaacagagcctaaaaacacacaggtagatcctctcaagtccttgcctaagccactctaatgtcctctgaaagcagaagttattcaaggaataaaaccaattatacattctcaaatcaaaagtgtctcacagaagtctatgtatcgcctttttacaaacctaatggaaagggatgggatgttcatttgttcaagacttaagaaacattcctaaagttatccctaggtttcccgcagtgccccactctaatgctattctatctccagtttcacttacaggcaaatgtactgtaatgtacagtacaggcaaatgtactgtgagagacctttctcagccttctttggcatatctgtaaatatagtcgataggtattttctttatttagaatgactaacagtatacaggtatttgggcagtaatacctcagagacaccttatattccttccagtctttaaatcatgatttaaaggacatactcccaaaagggtacaatttcattcaatatagaagactttgcctcatatatacctctcccggaaaaccctccagaggactcaatccaccttttaaaggagcaagtggctacatatgataaagcctcaaaggaaaaatgaccattttgccaagaggtgggacatgatttaggaggtgacctctccaccaacaggcacactctacccaaaaattggacactcataggatttgggaaacttaagaggtatgaaaagcaatggattcccagtttttccagcgtaacttgactcctccatgaacttaacaaaaacacgcaaccagaaaacttccttgatgaaactgaccttgtcactttgaaatctaaatcacaacaggccccaataccggctccacctgaacatcatcatcatttaccttacgcccatttggcacatttcctttagctgaagcaaaaaggaggtgccatggggtaccaaaaagaggctttagctcaacaacatgggaagtaccagaaaccgctcctgatttaggcacttctctagactcagtggctagggttttcttccttgttatgtgccttaacagtggttgcaaaacggtcagtgcttctgtagatattatccttgtcgcaccattaactccatgggttgcccaggctgttcagtccatactactgacaagcaacagccagcactgctctgcaagcccattagctcaggctggctgctgttgttggtctctcatgttacccaccatgtgtcagtgttatcatctcagtcttgcagtattgcttccaccacctgaagaagagccccaggactatagtacagcaaacatgaagtcgagtatttccaaggaagatctagttgatgttctcctagagaatctgcagcaagtgttgcttttaaatgatcaaggtcaataccattgaagttacgcaatgattacataaaactgtattagggccgggcacagtggctcatgcctgtaatcccagtactttgggaggctgaggcaggcagatcacctgaggtcaggagttcaagaccagcctggccaacatggcgaaaccccatctctactaaaaatacaaaaaattatctgggcgtggtggcatgtgcctgtcatcccagctacttgggaggctgaggcaggagaattgcttgaactagggaggcggaagttgcagtgagccaagactgtgccattgtactccagcctgggcaacaagagcgaaaactctaaaaaaaaaaaacaacaacaaaaaaaactgtactagatgataacctttcacccaaagttgagccatctcaaatagtagaactagtagcccttaccagagctgatgccaaaagggacacatgtacacacacacacacacacacacacacacacacacagctattatgccttggtgttgtatataatttggtgatgctatgggactgaaggaatagctgacctcatcagagaggcctaaaaaaagggagaaaaaagtagatttgttagaagcactgatgctctcaaaagaggcatacaattaaaagttaaggcacatagtacaagccataataaagaaggtgatgggagtgcattggcagatattaaacaaaggaagtgcacttttctccttgttcttaggagttatttatgatgaaggaaatgtaaaaacatgaatagatttttttacatacaatttatttcagacagagtatttagccctagattcaagaaacagaaacactgggccaggcgcgatggctcacacccataatctcagcaccttgagaggctgaggtgggtagatcacctgaggtcaggagtttgagaccagcctggccaacatggtgaaaccctgtctctactaaaaatacaaaaactagccaggcgtggtgatgtgtgcctgtaatcccagctacttggaggctgaggcaggagaatcgactgaacctgggagatggaagttgcagtgagcaagatcgagccactgctctccagcctgagtgacagagcaagactccatctcaacaacaacaaaaaaaaaaaaaaaaaagaaagaaagaaagaaaaaagaaagaaaagaaaatagaaatgctggctaaaatcaggttgttctgtcaatttcagtggtctctaatggagcaaggatggcctcttgcttacaccaaaaatctgaggtagaaattgaccaaaatgcacaacagagcttctaccacggataagagttggtggggacatttccccttggtaactagagatgtgaaaggtatatgcctcatctgtactatcataaccacccccacaaaaaaattgtgatggtgggacacaggtctgagctatatcccagaggacttttaaacacttgaaaatgggctttatccactttcccaagtcacgagattatgcatatgcgctaaaggttgcctgtaaattctctggaggtgagctcttctcaagtagaaaagccactgcaataactaaacttaaaaaaaaaaaaagttagacaatggtttttcccacctgggaagccaatcatactcactaatattaaaggtactcatttactggagcagtcataaagggacttggtgaggtgttactacttcgtcaaaaatctaggccacacgcggtggctcacacctgtgatcccaacactttgggaggctgaggtgggtggatcacctgagatcaggagttcaagaccagcctggacaatatggtgaaaccccatgtctactaaaaatacaaaaattagccaggcgtggtggtacacacctatagtcccagctactcaggaggctgagacaggagaatcacttgaacctgggaggcggaggctgcagtgagccaagatcacgccattgcagtccagcctgggtaacagagtgagactccatctcaaaaaaaacaaaaaacaaaaaaaaaaaattcttgttacccttactcttcagtttccagaaaaggtagaggtacaaatgtaggtacacaacttaaattggtggtgatgtgcgcctatgatcccagctactcgggagcttttcatttttctttcttattgcttcttgctttctgtactgcttctgaggcaggaggattgcttgagaccaggagttcaagagcagcctgagcaacatagcaagaccctgtttccaaaaaaataaaatgaagtacaatacattagccagggatgatatgcacctgtagtcctaactacttgggaggctcaggtgggaggattgcttgagcccaggagtttgagactgcagtcagctatgattgcactactgcatgccagcctgggcaacagatagagacctctgtctctaaaacataaaaataataaaactggttaagttatctgaagctcttaaacatccatggctgagaattttacctctagtggccatcaggtcagcctgttctggaacttacagattgtaaccttatgaattaacaactagaagacccatgcactggtaagttttaccactcgtaattgattggagcttgcttcaggcagacctagctaaatactgtcaaagagaaattcaataatcattcttatcttccatgattgcaaactagattttcaaaaacttcaccttcaaaacctctacactccttcaacctagatattaggtattctggaaaagacaccaattggaaatattctctagagacattctggaaaggatcctaggaaggtgatagcagaagcggcccatctagaatggcagctgccaagatgccagctgcagcagacaggcaggcctgggcctcccattctcagagtgggctgaagccccgccctccctgggtacctctgcagctgccctcccaggcgcaagacccgggcatctctgcagtctgcacccttgggggcctgggaaggccccccatctccacaggctcaggagtctctgctctgctgcctggcctcttcccagctcagcaccctctctgatcttgaagcatggttggggccaagcccaggcactgtcacagcccagctgggtgtatacacactcggggcagcaccgacacaccagctccctaccgcctcagccccctacaggctttgggcacccacgagcatgggaggggaagccaaggaggggctgagggcagcttggtgctggcctgcaggtgccccttagttcaagcagcctgggcaccatggacagcagcaggacgcagacgggttcctgggtggcagggggtgggtccccagtgaagccccaccttctggctggagaagatctgaagcctgggggccaggccgccagtcctgtggattggagggggaactcatggtgctttttcctgggcccgcccatggctgtccatggaacaatcagcatgcacttccccaccctgaggcccataaaagccccaggctcagccagagcaggagagacaatgggacaaccagctgcagagagagccttcccactccagcaatgaactacctgcagagaggagaaacacactccaggtcctcctttctgcaaagagctgtggaaatgacaggacaacctgccagcagagaggggccacccaccccagggccttctcctctctgctgagggctgaacactcgtcaggacaccctggttgcaaaaaggagctacccacagtgggtccctgagctgttctactgctcagtaaagctcctcttcatcttgctcaccctccacttgtctgcatgcctcagtcttcctggttgcagggtaagaactcaaggtgccaaatggcaagtctagaagtgctgtaacacaaacagggctgaaacacgccgcttgctctccacattgcaggtgaagagtgggaaagaagagctgaggccctttagggagcccagacctgggggctccccaagccagggctgtgactccctctttgaggccctgcggttcttggagtctctgagcttccaggcactactgcattccccccagggccagccaaagctgcttgtggtgtgcctcctccagctgcagccttgcagagagctgctgcctgtgctggtacctggaaactgctcctgctacttcaggagccggcccacttgactgtgtgcagcggccggactccacactcacttgctcatgcaccttgccactccacgcctggctcaaccttggcagccgtggatccaggccggtagcatgagccaagtacagcctgccaggctgagtgggaggaataagctgaatagactggatcaaaagtcagacaaaggcaccaccaaccacagaggtttctggccagaaaaataacacccaaaagatcccataagaaaggttcttaataacagacatcagtaaaactgcaagaagtgtatccttggatccatgtatcccctgtgcaaaaagatggacaaagaaattgatttggttgcaagggccaactgggagtccatatcactgggaatctcaaactgcaccttaacacaaaacaaaacaaaacaaaaaactccagatgaagaaaactgtctgaaggttgacagcagctacccaagtactttgcaccacactgattaatacttgaagcagcttccactcaagatcatcagagtaagacccaatgaccaaaaccacaaattttcttttctttcttttttcttcttgtttcttgcttctgtctctaacccttatatcgatttggattcctttttgttgatttaaactggctgacagtacactgatacagtttggctgtgtcccacccaaaatttcattttgagttgtaatccccataatccccacacatcaagggagagaccaggtggaggtaactgaatcatggggcagtttccccaatgctgttctcatcatagtgagtgagatgtcatgagatccgatggtttgataagtgtttggtagttcctcctgcattccttctccttcctgccactttgtgaagaaggtgccttgcttcccctttgccttccgccatgactgtaagtttcctgaggcctccccagccatgctgaactgtgagtcaattaaacctctttcctttataagttacccagccttgggcagttctttacagcagtgtgaaaatggactaatacacacaccaacaatgccttattcatgttttttattcttgtccttaatacacgtggtccagagagagcttacgcttaccagggcattttccatctaagagtgtaaagctccagaaatcggaaagaatctggatttttaaatgcatctctgacttctaatgtgtcccttattactggatatcaagcattccacatttctgctcaagatttccaagcttatgatgctaacatgttctgttcaatcatgtggattgaacatatttcatttatacagatcagtatagctatacttatcttaaataatttataatattgctataattatacttatcttaaatattagacccatccaaggcctaaaatcttgtccaaagtttgaactgagaaactgatcaggttttctctaattgtttttgatgtttctacttaaatttttgtaattgtacactaaattctgtgactaacggtaaaattgttttctcaaactttcgcattcatatcatggaaaatttcatcagacccaaatcaaaactggaaactaaaatttggaccaattaccaaattttgtgccaatactacattgaggaaggcaaacatgtttgtgcggttggagaattcatatatattaaacaattaacattcattgtatactgaaagtagaacatacgctttgacagaaagatttcatataaaagctgtactgaatctggtcagtttttaacttgcagaaagacatgcattaataagaacttacatgaatttttaaattccccatttctatcaagcatgttttacacccatcctacgctctcaatggaatgcaaatctacttggaggaattagagatggtgagatccatatctctatgtaaggtatctttccttatcttgcagtatacaaaattcctattgccatggtaatcatttcaaataaaactatatttgcactctaggctaaaaaaaattagcctgaactttcttgataaagtgttactagacaacagaattgcctttgattatacactagcagagcaaggtgatatttgtgtcctgactaatacctcctgttgcagctggatcaatgagagttccttacataaaattcaaggacaagccaacaggttgtccaagtgggataatgcatacagttgaaatctagtctcatggcttgagtttgacaaaaggaggggtactttgtatctattagttatgctgtttctatctctgtttctattcactgctgttgtcaaatgatttgtaaacagcttctgaaatgctgctgcaccatctcaacaaacatcaaatgatcctgaattgaaaggattctaaagtgatctgaaaaaacacaactgaaaaattagcacctttggtagagcgtgatgatggccccaattcttcatccctccagtagcctcagctttttccatgtgccctttctctttgagacacaggaccacaggactacagctgagagtgtaacaagaaaaactctctggtagcacaaccctaatctatgcacaaggtaaaactagagaattttgaatcttgtggttcacttagagtcaccatagcaacaacagaacccaagcccaactcaaatatcacctatattgactcagctccccacactagcagaagaggatgtgctcccatctctatgtaaaacgccgttcattttagcctttactgtgtaacacaacatgttttgctttcaactaaaaattacaagacacacaagaaagcaacaaaaagcaatccccagtcaaagagagcaatcaagagagccagacttagatatcactggatgttggaactgtcagacaggaaatttaagataactattattaatatgtgaaaggcttgtggaaaaattcacaacatacatgagccaatcatgaatttcaactaaaaaataaaaactatgagaaagaatcaaatggaaatgctagaattaaaaaacaaaaaaacaaaaaacaaaccgggcacagtggcccacacctgtaatcccagcacttgaggaggccaaggggggtggatcacttgaggccaggagtttgacaccacctggccaacatggcaaaactctgtctctagtaaaagtgcaaaaattagctgggtgcagcggtgcatgcctgtaatcccagctactcaggatgctgaggcatgagaatcacttgaatctgggaagcggaggttgcagtgagcgagatcacgccaccgcactccagcccgggtgacaaagcaacactccgtttaaaaaaaaaaaaaaaaaaaaacaactatgtaggccacaggcataacacttttaaagagcagaaagaacaaagctcccacctttgaattctatacccagtgaaaatatcttacaaaaataaagaataaagaatttttcatataaacaaaaattgagagaatgcattaccagaaaatctgtgctatcaatataagaaatgttaacggaattttttttttttttgagacagagtctcactctgtcacccaagctggagtgcagtagcacgatttcagctcactgcaacctccacctcgcagctttaagcaattctcatgtgtcagcctcccgagtagctgggactacagacatccatcaccacagccgggtagtttttcgtatttttaatagacacgaagtttcactaggttgcccaagctggtcttgaactcctgagtgcaggcaatctgcctgcctcagcctcccaaagtgctacaattacaggcgtgggccactgtgcctggccagtaaatttttaaagtagaagaattctgatagcagacagaaacttgggccaacacagcaaatggaaagatgctcaacataatttaccattatttgccagggaagtgcaaattaaaaccacagtgagagtccagtacacacgtattaaaatggctaaaaacctgacaccaccaaatgctcgcaaggacgtggtgcaacagactctctcatatcttatcttgcttgaaagaaagcaaaatggtaaagccactctgaaaaacagttcgtttcttctaaagttaagcatgtacttaccctatgaccctctaatctcactgctaggtattacccaagtgaactgaaaactcatcttcacacaaaaacctgtacacaaacgtttaaagcagctttttatgaccacaaaactccataaatagcccaaatttccctcaccttgtgattatgtgtctgcagttgctgccggccagggtgttcgtggtctcgctgccttcaagaacgaagccgggccttcgtggtgagtgttacagctcttttctttttgagaccgagtctcccgctgttcctcacgccagagggcagtggcgcggtcttggctcactgcaagctccgcctcccccgttccggccattctcctgcctcctcctcctgagcagctgggactacacgcgcccaccaccacgccgcgccagctttttttttttctttttgcatttttagtggctacagggtttcaccgtattagccaggatggtcgcaaatctctcgacctcctgatccacctacctcagcctcccaaagcgcccaccagtgttacagctctcaaagacggcagtgttacagttcttacaaatggcacggacccaaaaagtgagcagtagcagctataaagaagcaaaggacaaagcttccaccacacagaagtggacccctgcgagttgccgctgtcggctgggggggcggggggggggggtggccagcttttattcccttattgtccccacccatattctgtttctgtcctatcagagtgcccttttttcaatcctccccacgattggctacttttagaatcctgctgattggtgcattttacagaacgctgattggtgagttttacagagtgctgattggtgcgttttacagagcgccgattggtgcattttacaatcctcttgtgagacagaaaagttcctgattggtgcattttacaatcctcttgtaagacagaaaagttccccaagtctccactagacccaggaagtccaactggcctcacctctcaattagataaccaaattgtgacatatatgtatgaaatactatctatagtgtgtgtatgtatatatacatatatataatgaaatattactcagcagtaaaaaaggaatgaactacagatacacataacagcatcaatgaatctcaaatgtgctattgtgctattaatacgtgaaagaagtcagattctaaaggccatatgatatggtagaatgggaaaaacgttaaaacaaatcaggagttgccaatgctgatgatatggtttggctgtgttctcacccaaatcttatcttgaattataatttccataatccccacatgtcttgggggggaccaggtggagataattgaatcatggagcagtttcccccatcctgttcttgtgatagtgagtgagttctcatgagatctgatggttttataaggggtttcccccttcactgggcactcatttttttctctcctgccaccttgtgaagaaagacatgtttacttttccttccaccatgattgtaaatttcctgaggccttagcctccctagccttgcagaactgtgagtcaattaaacctctttcctttataaattacccagtctcgagtatgtccttatagcagagggataattgacgaatacaactgggaatttaggaggaggtggttatcaaaaagcggaatgggggaaggtagaatttttaggggtgatagaatcatcgtgtatcttgattgtgtgggtggtgggtgtagtggttacacaactgtataagattcaaatctcatagaattctatactaacaagaattttactgtatataaatcacacttcattaaatataaaacaaatcaataaaaaaaaacaatctactcaatacaacacccaagactgatctgaatgtgatctgaatctgaaagcctgataattctctcatcctttcaggtcaacctttcatctctgaatgaggtaaggacattataaaggactataaaaaaaactttataattatagcaatacttgcctggggtttgatcaaacatgaatattattttgaccagccaaagctgttaaatgactataaactttgagcaatacactagcaaaggtgataaacaaccaagaggtgatcctcacccaacctaacgaaaattctttcccaactaaagagcaatgagactcacttcacacaacatacagatggatgcattctgcccagtccaggctgtgcgctgcaattgttaactggcaaaatcacaatgaacctgtcctttctagcacataaaattcctgatttttttttccctgtggggatccactcaattgaaataaatatagtgcttacattttcagtcagtaggtggtccttatcattcctttaataatacacccagaggctgggcacagtggctcatgcctgtaatcccagcactttggaaggctgaggctggcagatcacgaggtcaggagatcgaggccatcctggctaacacggtgaaaccccgtctctactgaaaatacaaaaaaattagccaggtgtggtggcatgcacctgtaatcccagctactcaggaggctgaggcggaagagttgcttgaatccgggaagcggaggttgcagtgagccgagatcacgccattgccctccagcctaggagacagtgcgagactccatctcaaaaaaataaaaaataataataataataatacacccagaaaaccactatcaccactgtctaggtcatgaaacagaacagactggaaccacagtaataatgcattttcccaaaatattacattcctgcctccctaaaggtaactactatcatacttttaacaccatagactagttttgcctattttgtagcattgtgtaaattgaaccatatagtataaataattttatgcctcaaccttatgcttatgggagttgtccatattacagcatgtgtaagtagctgttcatttttattaccgtatgatattccattgcacgaatatgccactatattttttttttttgagacagagtcttgctctttcacccaggctggagtgcagtggtgctatatgtcagctcactgcaacctccgcctcccaggttcaagcaattcttgtgcctcggcctcccgagtagctgggattacaggtgtgcaccaccacacctggctaattttttttgtatttttagtagagacaaggtttcaccatgttgcccaggctggtctcgaactactgagctcaagcaatccgcctgccttggcttcccaaagtgctaggatttcaggcgtgagccaccacacccagccaccactatgtttatgtacctgctatcagtgaacatttaaattgtttttggcttgagctattataaataatatgcaaggataaataaatgcaaggatctttccattacactatggttcaaatgtgccccctccaaaattcaagtattgccaatgtgatagtattaagagatgggacttttaaaatgtgattcaaccatgagggctcctttttctaactgaaattaggtgcccttctagagggacttgatggagggctttgctctctcttgcccttctgctgtccatcctgtgaggacacacacacaaatgccctcagcagatgccagtgacttgatctttgacttcgcagcctccagaactgagagaataatttttttttctttataaattactgagtctcaggtattctctcacagcagcacaaaattgactaagacatgtacctttcagatgtgtatcttttgggtttcgaaccatgtgactatattacctcttcaaaattgaatcaaattaaaattgtaaagtaatgaacaaatccagtgagcatttctttggatttctttctgacaagtagtagtgcaaatacactctgtgtgaaaagtagttttaaagtagcactttattgttatcattggcaattagaatccaataattacagttgacccttgaacaacacaggtttgaactgcgtgggtccacttctatgaggacttttttcaacccaacgaggattgaaaatacagtattcatgggatgtgaaacctgcatacacaaagggccaacttttcttataggtgggttccagaaggccaactgcaagatttaaagatgcacagatttgggtatcctctggcagtcctggaaccaatccccctcagataccaagggacaactctataattattgtaaagcattaatgatatttacatgaattaagagtgtggttgtaattacagcatttttttgctgatttgtaaagaattctccatttaatgaaaattagtaaacaaggccaaagatgttttaactgaaaaaggaaattaaaggttcatttgaaagaatcagacaattgcatcctctgagaagatttttttgtttgtttgttttgttttcttttgagacggactctcactctgttgcccaggttggagtgcaatggcgagatctctgctcactgcaacctctgcctcctgggttcaagtgattgtcctgcctcagcctcccaagtagctgggattacaggtgcacaccaccatgcctggctaatttttgtatttttagtagagatggggtttcagcatgttggccaggctggtcacgaactcctgacctcgtgatctgcccgcctcggcctcccaaagtgctggcattacaggtgtgagccaccacacccggccgagaagatgtaattttatcacataaaattcagataccctcactgtgttttaattcagctggctaatttatctgagattatactttaaaacctgagtataaacaaaaaagaggtatgtaacattaggttgactgttacaattcagtagaatatttaatgagctacacacatacacacacatttacaagcatccaaggctataatacacagaaatcataaaaccaatggctgacagtctccacttcattattactgtttactgtaaggtcattattaaagtagtgtgaaaactgttgcccaatggaataactgttgttttccatttcaatacaaacgtagtcagtgacacacacattaacctttaaaacacccatgttttccatgtccatgtctacctaagacatcagaaaactatttacttaaagaaaatgcgccaggcatggtgtattacgcctgtaatcccaacactttgggaggccgaggcaggcagatcacttgaggccaggagttcgagactagcctgggcaacatggggaaaccccatctctactaaaaatacaaaaattaactgggagtggtggtgggtgcctaaaatccctgctactggggaggctgaagccagaggattgcttgagcccaggaggtggaggttgtggtgagccaatatcgtgcaaccgcattccagcctgggtgatgggagtgaaaccctgtcgcaaaaaaaaaaaaaaaaaaaaaagaaagaaaaaagaaaatgaaataaaatacagctgcataactgaggctcacaaagctactctgccatgggttactacaggaaaatggagattctgggagaagaaatagtatatacatccaaaagttttggttttgctgcagtcttattgtgcctgcttttaaaaaatccgatgtgaagattttccccaaataaaaatattttttataataggataaagttatatcccagcatagtgatattcatgaccatcctcgcccctcctttgtatggtctttgtgtcattcttgacaggtccaccattttagtgcattacaccctgcaacctggctccagacagaagactccctcttcttctcagaagcctgcctgggctgcacagggccacctcgcccagcagtgttcacaactctgtctgctggctctctgctgcccctctccatccatgccacgcacacgagcccataaggactgcctcccgattctttttcttttttttctttttttgagatggagtttctctcgtgttgcccaggctggagtgcaatggcgcaatctctgctcactgcaacctctgcctcctggattcaagcaattctcctgcctccgcctcctgagtagctgggattacaggcatgcaccaccacgcctggctaatttttgtatttttcttagtagagacatgttggtcaggctggtctcaaactcccaacctcaggtgatccgcccgcctcggcctcccaaagtgctgggattgcaggtgtgagccaccgcgcctggccaggactggctcctgattctaacggttgcccggaatcccgtgcccagcccagctgagctctgtacccactagggtacttgatctgctgtaattgctctgggcctcagcctctccatgcagcacacacacacatgcttggtgtgcttcacaaggatatagggagagctttaggagaggcagacttgtcttctaagaatcatttttagtaataaatagcatggtggggtggcgggtgcagtggctcatgcctgtaatcccagcactttgggaggccaaggcgggcggatcacctgaggtcaggagttcgagaccagcctgaccaacatggagaaaccccatctctactaaaaatacaaaactagctggattataaatcatgctgttataaagacacatgcacatgtatgtttattgcagcactattcacaatagcaaagacttggaaccaaccaaaatgcccatcaatgatagactggattaagaaaatgtggcacatatacaccatgaaatactgtgcagccataaaaaagaatgatttcatgtcctttgtagggacatggatgaagctggaaaccatcattctcagcaaaccatcgcaaggacaaaaaaccaaacaccgcatgttctcactcataggtgggaattgaacaatgagaacacttggacacaggaaggggaacatcacaccccgcggcctgttgtgggggagggggaggggggagagatagcattaggagatatacccaatgtaaatgccaagttaatgggtgcagcacaccaacatggcacatgtatacatatgtaacaaacctgcacgttgtgcacatgtaccctaaaacttaaagtataattaaaaaaaatacaaaattagctgcgcatgatggtgtgcgactgtaatcccagctacctgagaggctgaggcaggagaatcacttgaacccaggaggcagaggttgcagtgagccgagatcgcgccattgcactccagcctgggcaacaagagtgaaactccatctcaaaaaaaaaaaaaaaatagcatgggggtatgaagcctcatattttgataataaattgctcccagcatatattacaatctgatgcattcttaaatgtgaattcctttgtgctataaacgttaagtgcctcattttctcaatgctgtgagcttttaattctgcagcatggctctgtgactgtgattgtgagtagggacggctgtgttgatgtgcatgtggtcattccacaccttaaacgtgagaggtgcactctggtctgtggtcaacagctaaattcctctatctctttaaacttcactgcaccaaactggagaacccacagctgctgtttcccaatgggtctgggcagtatttgaggctggtttgcaagccaactataattttctgtagtggaaagagactctttatttttctctctctctttttttttttttttagcgctcctgcgcactgcctgatgttccctccctgggctggatgccgacgctgggagactcggaagccgcgtgtggaagatggcagtgtgggtatggcctgggtgcttgcgtgatggggtggagggagtcattatccccaacacaaacgcgcccactgactcggacccgcattggactgtgggacctgggcagactccctaaaatgtgggttttgtgatagttataacagcctgcattgactggtcctcggccagtctcagggtctttggcaatatttggaactctcttggccctttgtcttttgatacttatctggccaaatttggcctgaatggaccaaacttctgccttttctgtttctgggcaggcactgttgggcactgccagagagaaatctcaaagtcagatgttacactgtctgggatgcagctgcgcccagcaatcctggtgtgtccccaatccaactttctctgccaccttctggagtggctatttcaagtctccggttttctgaagtccttaagtctctctttccacttcaaagagaacattgcagtcatcggttgggaacttgctccaagtgaggagcaactgtgcccaccctcccatcctctcccacacctggggagttcatggctagccctgccctttgggcactggctcccagccagagacctctgcaggggcagtgccccatctcatgccctctctttcctgcaccttcctctctgctagtgcccttcttctgcgtatctggctgtgtaggagaagttctctatcagcagagcctagttcaacagttaaaaaaaaaattcaccataggtttcatgccctgaataccacttacagagcagctgctgggtacttgcaatataggcaaaatgcagatcttgctcaactcttctggtgtctgttaactagccattgcgctcccctagataaaatggctctctctagaggggtgacacagatcattcatggtgggtagcagacatcaatcgctaccacttgttttcttgctggtggtaatggagaccctccagggaacccttacacccctctgaatctcctcgtgggaggaaaactgggttgtgctctgaaatgtcgttaaagtcatatttggagagctgcgctgactctgaggagctggctgagatctctttcttcctgaacagcatgccagctgccatgcaaccattcctcacgcaggcagcacaggggaaagcagggaggccacatcttggactctaacgtaatgattttttttcctgcttctgtggttaaacacatttagaggacctgttttgaaggttcctatgttcctgtctgcgttatgcaaattataggcacgtgtatgttaggaatgcaaggaacttgtttacatcatctttttttttttttttttttgagccagagtctcgctctgtctcccaggccggagtgcagtggtgcgatcttggctcactacaaccttcgcctcccgggttcaaacaattcttgtgcctcagcctcctgagtagctgggattgcaggcacacaccaccacacccagctaattttttgtgtatttttagtagagatggggtttcaccatgttggccaggctggtctcgaactcctgacttcaggtgatcctccagcctctgaacccaaagtgctgggattacaggtgtgagtcaccgcacctggcctacatcgtcttttgtgaaaaaaaaaattatttatacacttgaatgtctaatcagcgtttcaaaggtaacatgcccaaaactaaattctcagtatccctcctccccagccaccttcatcccagcaggggtgtcaccagcagctcaggccaatgatccagcagtcagacttgactccgctcatgctctctcacccatctaacccatcagcaatattactgggtctgctttccaaatccaccctcattacacctccccccactcacccccaccctcgcccagactgccaccatggacagttacagtggccttctaaaggtcatgtctcccccattgtcttctctcccaaattctattttccatagacaagctagactattttgatcatgaaaatctcactgtgctgctccctgcttacaataacctcctctcccttatggaatcaaatctgaagtcctcaccgtgcctgcaccagccctccagcatccctgtttcttgggcctgccaggccagtccccacctcaggacttttgcacttgttatgtcctctgccaagaaagctcttccctgagttatcagttcctggagtggccttccttgacactgtagtttcccagggctgctgtaaccatagactggagggcataaacaatagaaatgtagtctctcacagttccagagccagaaatccaaaatcaaggtgtctgcagggccacgctctctcgctctgaaagctctgagaaagaatctatcttacttatctttctcagcttctggtggttcccataaacctgtgatgctccttagtttatagacgcgtcattccaatctctgcctccattgtcacctagcactcccactatgcctgtgaaccttcccttcttataaagacaccagtcacactggattagggcccactctaattcaccatgacctcatgttaacttgattacttctgtgaagaccctatttccaaataaagtcacattcacaggtgccaggttagggcttcaacatatattttcttttcttttctttcctttttttttttttgaggcagagtctcactccgtctcccaggctggagtgcagtggcgggatcttggctcactgcaagctctgcctcccgggttcatgccattctcctgcctcagcctcccgagtagctgggactacaggcgcccaccaccatgcccggctaatttttttgtatttttaatagagacggggtttcaccatgttagccaggatggtctcaatctcctgacctcatgatctgcccatcttggcctcccaaagttctgggattacaggcgtgagccactgcgcctggcctttttttttttttttttttttgagatagagtttcgttcttgtcacctaggctagagtgcaatggcgtgtggtctcagctcactgcaacctctgcctccaaggttcaagcgattctcctgcctcagcctcccaagtagctgggattacaggcgcctgccaccacgcccagctaatttttgtattttttaagtagagacaaggtttcaccatgttggccaggctggtctcgaactcctgacctcaggtgatccacccacctcggcctcccaaagtgctgggattataggcgggatccactatgcccggctgtcttcaacatatgtttttgggagacacacttcaatgcatgaaaacatcctatatcctatagatgtagagtcgctatttgctctacatcttggcctgttttcttcaccccatgtcattttccactatctgaaactatgccccagaggatagtggcagctgtctaaattagaatctccctacccattctccttaaaactgtacaggtgagcaaggagagaagacacccattgctcctgtctacaccacatctagaaggcagagaaaggaaaaagtgtcttaaaaaagtaataataaggacccagcaagagagcaccctagccaatcaatcgtggaagaaaagggtgtcgttgattaaagaaactgcccttcactctagcaacagaagagggagcagttgatctgcacaaccaacaggccgctcgggcctctaggcctccactgcattgtctgctattgccagtccggggaaacgcaacagaaataaccaccaccaatcacaaagcagaaaaggagaaccatactttccagcagatggcgccacttcggaaaacagtttggtgcgtcctcaaaaaattaaacatataattaccgtgacccggcaattccactcctaggtatacccaaggcaaatgaaaacatgtccacatagacacttgtacatcaatgttcctagcaatattactccttaagagccaaaagatggaaaccactcaaacgcccgtcaactgatgaattggtgaacatgttgtggtatatatcgatacaagagactatttgcggtaaatagggatgcaatactgattgatactacaacatggattaactttgaaaacattgctggggctcggaagctgatgccccgaatttgatgctttgtacatgctgaactgaaaaaggagcttcaaggtctctctcctccctcctgccccaaagcataggcttctctgacattcccttatctgtctaaagtctgggtctatgaaagaaaaacaatcacctccagtcacttccctgagttttcattaactgcacccatatctcagaaaggaaaactaaagtcggtcaacacacctggacagacttttgtcacaaaccattgtctgctctgcaggcccagcagactttaccgcagaccgtggtgtgttcttcaagccctttgaatcttccctagtcatcatttattgcccctccccagaattcctcttctcccgctcccataactacgaccagggaagattcaaagggctaaaaatacaaaaattagctgagcgtggtggcacatgcctgtaatctcagctacttgggaggctgaggcatgagatttgattgaacccgtgagatggagaggttgcagtaagccaagattgcgccgctgaactccagcctgggcaacagagcgagactccatctcaaaaaacaaatcaaaacaaaaacaaaaaacaggtgattgtgtcatgggggctctgcctttgtgaatagattaacccattcatgaactgatggactggtgggttaatggattaatgtgttatcacagagtggaattggtggctttataagaagagaaagagacatgggccagcatgttcagccccctcgccatgtgatgcccggcaccaccttgggactctacagagtccccaccagcaagaagccctcaccagatgcagccattcaaccttggacttcccagcctccagaagtgtaagaaataaatttcatttcttagcaattactcagtttcaaatattctattatatgcaacagaaaatggacagagagagttcttaaggaattccccatcacatccgaggcttatccagaggtgatccttgtctggttccccaggaggctcctggaggaaaggaatggacactgtccaccaccccattcattggatgcagggcccgaagggaggacctgtggagggttttccagcggctcccttaaaaggaacctggagagaggtgattgaattacttcctcagtgcatcttatttgttaatgacatgctcatttcaatgatccatgtcatcccggtccctattaccataaataacgaagcattagctgtacgtggcagtggctgtctggagcagcaaagagccgatcccacggtgtgtctgccctgtcaaaatcatgttggctgtgcttaaaaatgacactccagcctgtccctgcaatccccatgcgttttcatcatgagtcagaacttcaagatgctattcattccgaagccatgtcagctcagctgtcaagcaagtttatcgcatcttgtatttatgataaacttgagtgacatgcagattttgaatatcatattctaaagccattttaatctaggctaaatgcagcctgtcaaattcccctgtaaggcaggatccatggtgggggctggggactgaagggaggtgacagcagtgcggttggcagacaggggagagggaaggtaagcaacagagaaaggtgcctgggttcccaaacagggttccagaggcaagtccactctgcctagaagtaagatggctctggggcaggacgcatgaagggtctcgcccagaacagtggttccagcggtgattcccagggacctatagaaaccctgaagggtggggaagcttgagtcacaagatgtttcaggcctttcgaggactaggtatttgtgaacacaggccagccttggaaattgaatatgctctcgacttacaatgccaccacttaagaggttgttgggctgggggttactcattcagggcactgttgtcccttctgggatgagaaaagccaaattattacacgctgaagcagatgtgtggggcccgaggtttatgccacccgggaactctctttaaagaaaatgaaaacaaaaattgtggtagagaattgctcgggtccctccaaggagcctacacaaagggcctgcagtgaggggtcccagtaccctaggcacagaggaccatgagctgcccagggcctcatgcctggggaaggctaagatgtgaagcatggtgatacaataagaaacatagatttggtccttgtctctgttcctggcacagagggcctaagacctttggaatctctgcagtgagaataatgaatgttttttgtgtactaatgagatgactggtggctgggagcccctgaacagcttcaggatgagggctggtcccagaaagaccaaggcaggattaggaggttggaactttcagccccactccccgcaaacctcctctggggagaggagacaggctggagattgggttaatcaccagtggtcaatgattaatgaatcatacccatgtcatgaaaactccctaaacattcctgaacaacgaagtctggagaacttccaggttggcaaacacagccatgtgctgacagggtggcacaccccgactccatgcggacagaacctcctgggctccggacccttccagacctagccctggctgttcgtctgtgtccatggtaataaactggtaatagtaaataagtgttttcttggtttctatgagctgttctagccaattattgacctgagggaggtggggattgtaagaacctcctgactttgtagccaagtcggacagaagtgtaggttctctgagtacctaagacttgggactggcgtctgcggtgtaggtgatcttgtgggactgagcccttgaacctgttcaatctgacattagttagtgtcagaattgaattgaatcataggacactcagttggtactgagaactggctggtgcgggaaaaaatcccacatttggtgtgagaagtgtttgagtaaaaacagctcaagcccattcttcatttctcagcagggtggcttttgtttgctttgctgttccaacatttcattactcatctgggtcccaatgggcctttattaagaaaagaaaccttttaacataaaaattggctccagatctgagccactcatttcccctgaacctctctggggtccttgtgggctttctgtttggacaggtgatcccagcgattctcccagcttcagaggctgagaggctgtgatccccatcaaaggcagcacatgccacagtgtcccccaaggagcccccgtctgccttgaattccacctacagtggcacagaattggcagtgggcacagctggctgccatggcttccaggggctggaaggagacggtttactgcagggattctttttttgtttgtttgtttgaaacagcatctcactctgtcgcccaggctggagtgcagtggcgccatcttggctcactgcaacctctgcctcctgggttcaaatgattttcatgcctcagcctcccgagtagctgggattacaggcacacaccaccatacccggctaattttttttatttttagtagagaggaggttttgccatgttggccaggctgatctcaaactactggcctcaagtgattcacccgccttggcctcccaaagtgctaggattacaggcatgagccaccgcgcccggtttactacagggattcttatccaagggcctatggatcccacaatggcatgtacaatttttatttttaaggtcttcttttctgaggaaatcagttgtccaattttcaaatgggtccttgactaccctcaaaggttaaaaatgatttccaggtgaaaaataaagaaaaacactgttgcattctctattttttttttctaaaagtcaaatcaagtatgggaaattccagttatccagggtgcctcaaccagggagcttctggctgcttgaacatggagtcaccacacacggtccatgtgtaattgcccaatgggctctccatacccactgcctagacagagccgatttatcaagacaggggaattgcagtcgagagtttaattcacgcagagccggctgcacaggagactggagttttattactactcaaaccagtctccctgaaaacttggggatctgggtttttaaggataatttggtgggttgggggggttggaaaatggggaatgctgattggttgggtagaagataaaattgttgctggaaaggggtcccaatccagacaccaggaaagggttcttggatctcacgcaagaaagaattcagggcaagtccatcaagttggtgactccataggcagggcagtggcatgagctgctcgagggagtatacttagttacttcttgattatatgctaaacaagcggtggattatacacgagttttccaggaaaggggaaggcaattccaggaactgaaggttactccctcttttagaccatagggggtaacttctggacgttgccatggcatttgtgaaccgtaatggtgctggtaggagtgtcttttagcatgctaaacattataattagagtataataagcagtgaggatgaccacagctcattatactctaattattaaaagacgtcgccatcttggttttggtgggttttggccagcttctttaccacatcctgttttatcagcaaggtctttatgacctgtatcttgtactgacctcttacctcatcctgtgactaagaatgcctaacctcctggggatgcagcccagcaggtctcagccttatttcacccagcccctactcaagatggagtcgctgtggttcaaacacctctgacaaaatcacggaaagtcgaagctgtcctcttttgctgaatcagttcctgggtagaggccacaggatcccatgtggtgccagctgatcatcgatcatcatgtgcagggtctacaaatcatctcaagcactgatcttaggccttaccatagtgagtttattctcaggagcaatttgggatggctcagaatcttggagtctccagatgcatgactcctaaaccctaatttctaaccttacagctaatttgttagtcctgcaaaggcagtgtagtccccaggcaagaagggagtttgttttgggaaagggctgttattgtttttgtttcaaagcaaaacaataaaccaagttcctcccaaagttagttcatgcccaggaatgacaaggacagcttgggggttggaagcaagatggagtcagttaggtgagatctctttcactgtcatagttgtctgttataattttgcaaaggcagatctaccatttctctgaaggttgagtttgggatgtggtagcctttgagtacccgtcctgttgctgtgtgtgtgttcagggcaatccaggaaatctggagaaaccagagtgtgtggtcccccttccccatttctctagtggatcaggtaggagggtgactgaggaaatgtgtcctgggatacttcctgcctcccagggtgtgtgggactcagcccttccccagcctgcagaggatgggggggggggggggctttgccagcagtcaagtcctgtgccccaggggaccaggaagcctgtatcaactcctcgctaccccagccagaagcagcaaacgctccaccctgtcctgctgcctgatgggcagagttgttttttttgtttttgtttttgttttcagacacagtctcattctgtcgcccaggctggagtgcagtggcgcaatctcagctcactgcaacatctgccttccaggctcaagcgattctcctgcctcagcctcccgagtagctgggactacaggtgcccgccaccatgcccagctaatttttgtatttttagttgagacggggtttcaccatgttggccaggatgttctcgaacccctgacctcgtgatccgcccgcctcggcctcccaaagtgccgggattacaggcgtgagccaccgcgcccggcttgagcacagacttttaatcagattttttctttctttaaattcctgtgagaccagccgcctgagggattaagaatatcgagggatggaagggagagtaaaagaacgggcacttttccctagggaaaaggaggcatgccgggggggcggagggaaggagggggtgtggaggagggaaggagggaaaagggggagggaggagagggaggagggggcgcggaggaaggggcgggcttccccctgccggcctcccttccttccccgctgcctccgcctctcgcactagcgccccgcacctgtggcgcccctgctccgcccagtcccgcggcctcctcgcccctagtccccggcgctccccgccccttcccgtgggatccgcccctccgccagccccgctggcttcccctctccgccaccccggactcagaacctcccctcccccgccggggcctgggcgcgcctgcccttcgctccccgacctcctgctgcagctctgggcccctcggccgctccctcccctcctcccttgctcaccccacggttggccgcggatctccagcacgccgccccagtcctcggcgtcccgcagcgcctgccagggtcgccgagcctcccctgcctcctggccgcctctgcagtgccgtcctcccggggctggctctctccccaggcccccgctttggccacccaggcactttccgccctgagcgtggcagctgctgccgggggtcctgggaccgcgggatgggaactcccacgcagcgtcccacaggctcctggccgccgcgagcccgcgcgactcgcacgagcatgtccacccgcagcgaggggccggtcactgctacggagcccgccagaaggcaaagccccagacagcaaatagggaggcggctggcacccagggaggccgaggcgggaggatcgctggagcccaggagttcgagacctgccttggcaacatagtaagacgcccccccaccccccgcccaccatctctacaataaatttaagaattagcctggcatagtggcgcgcgcctgtggtcccagcacttcggggaggctgaggtgggaagatcacctgcgcccaggacggtcgaggctgcagtaagccgagatcgcgccactgcactccagcctgggcgacagagcccagaccccgtaacaaagcaaaaatgaaggaggcggcggtttacttctggaataactgcagaagatcatcaagtgcagggagctgtggaactcccgggcgcccagccctcggcgcccctgcaccctcagccgtagagctggggtgttccggcccggagggataggggtttgcagggtgcgtgagcgccgaggctgcccgcgaggcgagagaattgcggggggaggcagggaggccgacggggagggcctgggaggctgcacgcgcagcggggacccggctttgtcccgagcagtttccaggtaagagctgagaggaggggagggagggagaggaggagaaccaggcccggattttcccgcctggggtcaaaccaaagcaaacaaaccaaagtggtgtgtccaaagtgatgcgcctcacaggtgccttgcttctgcccctgccggagttgaggtttggaggaagggcactgtgctgagtcccagcgggggttttgtaaatgctgcggtattggtctctcacggttcacggagcaatcaccacacttgcttgacctcctggaaagccttactctctttttataattaaaaacaattttttttggccgggtgcggtggctcatgcctgtaatcccagcactttgggaggcccaggccggcggatcacctgaggtcgggagtcggagaccagcctgaccgacgtggagaaaccccatctctactaaaaatacaaaattagccgggcgtggtggtgcatgcctgtaatcctagctactcaggaggctgaggcagaagaattgcttgaacccaggaggcggaggttgcaagtgagccaagattgcgccattgcactccagcctgggcaacaagagcgaaactcttgtctcaaaaaaaaaaaagaaaaaatttttttttagcgacaggggtctcactatgtaggccaggctagtctcaaactcctgggctcaagtgttcctccagccttggcctcccaaaatgttgggattacagacatgagtcaccgagcccagccagccttactgttcagaatgatgtcacatctttgtggactgttgaaaataaggttgtcttcctcagtctcctagaagccccaaaatagccatgcagatgtccaagcagttctggtttgattatcaaggagcatgtgtaaaatagctacgtgtgaatggggtctctgcaaatggaaactggcgggggaggctcaggactcttaagaggtctgcaggagaaagtgcataatgaacacacacccatggcctctccccatgtgccagggcatcctcccacacaggccgaaagtgctctgcagaacaaagtgcttttggtccacaaaacgcctcccagctcttgcctgcaaagggaagaaaggatagctgagaatcatgaagcagaatgccgggagatttatggaaaccccctctgatagctcaatctaattgcagctccctccagcgtgccaaatgctgctaatggacagccgctcctgccgctctgatgttgctagacctcctcagcactcagcccaaggcagccaggaagaatgaacgaatggtgattcagagggaaaggaggaagctgcgtggcatttcagagatacttattttaaaactgctggtggccatgtcttcttttcatatcagagctaatgagttttgatatgtgaacatttcttctccttcataggtaatgtgttgatttggcactttaatcttagaataatcatttctaaaaccaacccaactgcttttctttacaattttggccttagcaaacagatgagtccgttgacttgagcattgcttgggcactgtctgtgtgcaggtcaggcaggggatgctggtggctgggaaacatagaggatggaggtgtcttgggtgtacatgaaggggtggggtcaagtccacagggggtcggcccctggcagcagtcctggagggcttcgtggaggaagggagaattgagtgagaaagtggtccccaggtaagagggaagagcatccagggagaggagactgcttctgggaagaccagaggcatcacctcgcaggggctggtatggtggtggctcaggtgggaggaagagagacctcagggaaaataacaggttccattgacaggaggcctgctctggtggggaggcaggctggtggtggagtcatggctgcaggccagggagatgcctgaccaacaggtgtgttggccagggtccctgtagcaaaaacacggagctgaggacctcatggcagggaccccatgcagagggagccgcgggtggcatggggatagtcacctggctctcctgctctcggcctcctgcagctcccctcactccctgccctgccacacaaggtcaaacccaccaggaggcagaaggcgaagggcgaggtcccagggtgaggagcagggaggagatggtggcagcagggaaggtgatgcctgctgcagagtgagacctgggactgccaaacacacagtgacgggagctgaggaggcctgccgggggaggaagacagtggctggcagtgacaggaagggagggtcagcatggggcggcagtcccagagctcagggctccctgccaggccagcctttgtggcctgtggggtggaggtggcaattgctgtcatgtcataaacacgtcaagcttacaatgaaatctccagtgtggcttgggagcaaatacatgtgcaggtgtttgagtatctgtgctcttacctaacctcagggagcaggaaaacgaaagcttatcatgtaaacacatcagcagcagggcttatgtgtgtctccacactggaacccccaagacaagagactggaggcagagttgatttccaagcccagagtgctgggcagcctttgggttttatgtctgcttgcttggagctcagtgatagaaatctaggccccagaagaggaaaggactgtcctgcataaccagcacacccggggaatgcttcaggtgcagctggatccaggcatcctcaaatagtgtgattaggactccactttcctttgtcaccttggcttggctcttccctgctctgtgttgttttcagacgaggtggggccccagcagctctggtcctcctgacatcctagagaagagccagcccttccctcctggggtctacaccgtcccctaagggacctcagactgggctgatggaaggtctcaagcaggccatgtgaagggcactgcacaggaaacacagaaacgggaatcctataaggtcagcagagctctgagccctttgttcttgggcctgtttttatgatcctccctctacatgtagctcacacttccctgcttctgtgcaggcaccaggtgagggggttgtcatggcctcctgccactcttgaggctgtcagatattacctgtgctgtccctgcattctcaagctccaaattgtcaactaagaaatggtcacttaaaaagagaaaagtgaggccgggcacgctggctcatgcctgtaatcccagcactttgggaggccaaggcaggcggatcacctgaggtcaggagttggagaccagcctggccaacatggtgaaaccgtgtctccactaaaaatacaaaaatcatccaggagtggtggcgggcacgtgtaatcccaacttacttgggaggctgaggcaggagaattgcttgaacctaggaggcagaggttgcagtgagtcaagatcataccactgtactccagccatggcgacagagcaagactccgtctcaaaaaaaaaaaaggatttctgaaatggacgaagtttttttccactggcggtgccatcagtgatcgtgtctgttccactgtgaagtcggtcgtgagctctgtgacgtttccctctcaactcaaggcttttttcttccgcttatgggtgtagtccaaatggttgggatgaaaatcgtttcacagataaagaaatctacaagcccaatcgtggtgtaagaaaaaaactttaaaactctgtcgttcagaaggaaatcaggaataagaatttctcctttgagactaaaagaaagtcagctttagccagtgcattggggtgctggctcgatgtggtaaacaaagcaaaacattgtttttaaatatccaaaacattatttttaaatataaagaaatacatttttctcctctcaacaatgaagtcatagtttttttggggggcggggggtgggtgggtgggtgcacaggatttactgttttgtttgtttttttaacccaaagagaaggaaaatactttccttactcctgaaaatggtgagtttgtacattgtccttttatatggatcaatgtcatttaagcaactacagacagataagtgaagatgaatctcatccatcagaggctgggctatcaggcaccaggaccaggggcttttcttttaataagggaaacctctgctatctttggattcctcaaagcctggaatctagagctggatgacaggcttgctttggagagaatttcttgagacaacttcaaagtggcaggttttgttgaagaaaaagctcttcatggggtagttgggaacatggttagtccctctgtggggaccaggaggagcggagaggggaaagggagggagagggagagaacaaactctctgctgtcactctaagagcgccaatcccatcatgggccagaccctcatcgccttatgaagcctgatcacttcccaaaggccccgcctcctggtactatcactcagcagtccccaaccttttttggcaccaggaactggttttgtggaagacaatttttccatggactgggttgcagggatggtttcgggatgattcaagcgcattacatttattgtgcactttattattattacactctaacgtataatgaaataattatacagctcaccataatgtagaatcagtgggagccctgaacttgttttcctgcaactagacggtcccatctggtggtgatggaagacgatgacacccgaagtgtgttgctaatgtccagtctgctctgtaatctcgttttggtcgatgatattgcagaaaactctgcttcacaaacacaggatattggaaatggaagtgggcttttcagtgctttgggaacaatcacaggagattctgccttggctgtaatccagaacgtatggagatttgaagttgtcgcaaacatactttgaaggccaccagatgcagctgtacaattgaagtccatcagctcacttgcctcaataaagcctgccactgcatgcagcttgtcacttgccactcacagatagggttttgatatgactctgcaagcaattgatttatgatggtctctgtgctgtcaaacctctctgctaatgttcatctgtatttgcagccactcccaagtgctagcatcgccgcctcagctccacttcaggtcatcaggcattagttagattctcataaggagtgtgcaacccagattcctcacatgcgcagttcacaatagagtgcgctgctatgagaactaatgccactgctgatctgacaggaggcagagctcaggcggtcatgctcacccacccacctgctgctcccctcctgctgtgcggcccagttactaacagtccatggacaggtactggtccgtggcccagggactgggggccccttctgtcacccaaccaaactgggtccacttgccctcaaggaacggaagccaaacaccgaagcaccaagtttttgcaataggaaggctttattgccagttgagtgacatggagaccggaggaaatgttcctatctgtcttcccactggccttgccaccatagatgtaagagacagattttgagggtggggtttcggggcgggacgaagattggctggaaggaaggggctttgttgagtccctcggtcactcactgtcgccctacctgctgcttcatgggttgcatgtttaaaaacaatgttggcattagcatgacctggaagtggggttttgggccctctgacatcaaaaggtggctcgtgggtgagtcagtgcactctgcagactctagtcagccatgttggctccaactggtccctcctggcagcccacttagttgcaaatagaggggattgtagcaaattgtcgtcttctccactgtcctgcaaaatgagctcaagaaattttgctggttaacaaatcctgtctaatcctagggcaggtttcagtaccatcctgttagggattggggcttcaacatatgaatttggggggtacacttcagcccatggcaagctggatacttgtgctcccttcatcaagatgagaatgtgaacacacagaggcaaagcggcccatacgaggtcacagtgagagagggtgccgtggagtcagaacgcacagcagggacccagcccctaggttccgtctctgagccccaggtcccatgctgagctgcaggagtcactgtgtgcctctgctttgtgctttgtgaccacacgtcatggccaggctggggttttccaccctttgtgcgttattcccatcttagtttgaggtcagaggcctgcaggacttatttcctggtccccacgggatgaaggaggaaacccgtgggaactagcacatggccctaaaagcaacctctccttgccctcattgtccattagcacaagacactcccatcagcaccatgacagtttacaaatgctgtggaagttgctgccttttccttagagatttccaaataacctgcccctaatgtgcatgtcattagaagtcagtataagtggctgtgagtgcagctgcctcagcccatatgctgctgactccgggtgcactgctgaggagtcagccctggcccagttcaggaaaagtggctgcataatgccaccagctggcccttgcattctttcctgggtgaagccaagaaccctcaggggctaagccccactgtgagagctcacctgccacctgcatccagtgaatagggcgccatttccaggtttccccccagtgctgcagcaaacatccctgtaggccgcaactcacacgcttgcttgcatttttttttttttctgtgagataaatcttcagcagcaggattgctgagctgggtctaaaggctttcaaagttttattttcaattttttttttctcaattgtctgtaagagggcagaaccactttactctcttccagtggcagatgagaatgtgcttcttaacacctgcccagccccagggattatccctcattttagtcttggccaatctgagacaatccatgaagggaactgatgactcgctgtcttccagacatttcttcggtggtggtgaagttgagtatgtctttatgcttattggccattgttcttccaggaactgtcagttactgagctctgaccttagatttgtcatcttctaaaaactgatctgcaagagctctttgtatcttaagagaactacttttactattaatgcgtgacaaaatattctccccattgacttgatgtgctatccataagtatagtcatgaaccacataaccacattttggtcaacaacagatcgtatataacagtggtcccataaaattataatatcacatttttactgtaccttttctatgtttacatgcacaaatactcatggctgtgttacagctgcctactgtatccagcacagtgccatgctgtacacgtatgtagcctaggagctgcaggctacaccatatagcctaggtgtgtcggaggctggaccatctaggcttgtgtaagtgccctctgtgatgttctcataacaatgaaatcatctaacaacgcatttcttcgactgtgtccctgttgttaagtgaaacatgactattgctttttgtttaaagtcagtaaagaggcacagtttacactttacttacccatatatatgtatgggtgtatatatgtatgtattttttgcgacagggtcttgctctgtcacccaggctggagtacagtggcatgatcttgggtcactccagcatccacctccctggctcaagcgatccttccacctcagcctcctgagtggatggaaccacaggcgtgcactgccgtgcctactttttaaaaaattttttgtagagacagggtcttgccatgttgcccaggctggtctccaacttctagactcaagcaatctgctcacctcagcttaccaatgtgctgagattacaggcatgagccactgcacctggcctatgtgtatttatttttattgtcatatttatctgtttttttttcatgacttgtgattttgtggcatgtttagaaaggcttttcttgtttcaggattataaaaatagtcacctatactctcctctagcatttttattatttcacttttcagatttaaatttttgtttcatccagaattaattttggtcaaagagttcaatagggctacaatttatttttccctgaagaggcgggacagctgtcccaatataattcactaaagagcccatctttcctctgccaatctgcaatgccaactttactacaatgtctgcaacttaatctcaaatggtagagcaacaaacatatttagagtgtgtgtgtgttgaaattaaatcaaatgtggagaaatgttagcatagcaattattgaatcaagatagtacatttggccttcattacccacgggttctgtatctatctgcccattcaaccaactgcagattgaaaatactctggaaaaaaattttttaaatacaataataaaaaataatgcaaataaaaaccaatataacaactatttcatagcatttacatggtattagatattacaagaaaactagaaatgatttaaagtatataggatggtgcgtggaggttacatgcaaatactgtaccattttatcaaggatttgagtcttttcagattttgttatctttgggggtcccggagccaatcccctacaaatactgcgggacgattgtatgtagaagatcattacaccatccagtttccagttttgttttcacagtaaaattgtgtttaggccaggcgcggtggctgacgcctgtaatcccagcactctgggaggccgaatcacctgaggtcaggagttcgacaacagcctggccaacatggtgaaactccgtctctactaaaaatacaaaaaaaaaaaaaaaattagccggatgtggtggcacatgcctgtagtcccagctacttgggaggctgagacaagagaatcacttgaatccgggaggcggggggttggcagtgagccaagatcgcactgttgcactccagcctgggcaacagagcgagactctgtctctattaaaaaaaaaaatgtgtttaaaagtctaaaagaaaaggagcgttagaatggagatagagtctccactttcaaaatggatggttgagcaaaagttcctttcctgcagaaaaggcctggacgggtgtggccaggacgagctgagacccgatgagaaaggcagaagggcgtcaggcagggcttgcactgcaggaagctgctctggctgtccctgagtagagaagagagttgtgatgtgtggacaacaacaagacaacaagagctgttgggggcctccagctccagcttgaatgactgtttctattgatgtggagcagaaacctgtgggagccgctggcccctgtggacaagggcggtgaatgggccggcgggagcgggcagctgacttatggcgaggtggtgggtctggggtaggctgcggccttagggttggtggtgaccgtgtaccaaggcacacggctggcttccctctcacctgcaatagctgggccacggctcactgcccttcttcctcctgtcacaccagtcacactgagagagggccctgcacgtggtgacagcatgggctgaaccggttccatttgcccaagcaccagggacactcctttacctcctcaggaaggctcagctgtagaggaacagaaggaagatccgaagataataagaaggaggaaaagttggaagaagggcaggagtgcagagtgggccctccagggagggagggggcgagcgagcagccagccctgcccgaatcccccacccacaccctggccccgtcccagcagaactggtgacacttttcttcccagtgcctttcaaatttccagagcagctcagaattgctcagtagataacaggtttggggtttttatccttttcttcctaatgaccaggctcctgagaacaggagcagctgccatctgtagggtattcatcatcctcctgcaacggggaaatgagtcattttagcataaaatgtagaactgccatgaaattcaaattgcagtactttgacaagaattataatgtttgcagaaagtctcatctaggaggctgaagtggtcctgcgggaagcccccccagtcacctgagagaaacagctgcagtcgccagcaggatctgaccacctcgcccagggtggacaggactgaggccacctcttaatttttccaccctttttgttcctggacattaaataagacagagaaagcaggaaggtggggagagagcacccctgcaaataagagtcatcatccaagagagtatcaaccaagtaggcagaattcttgccaatttagttgactatgcatgggaagggaagtttctagggccttctggaaacagaatattttcttaaaggggccaccaatgataccctttggtcattccaaaatgacctctctgggcctgacgcccctgtgagacgtgaagccagctggacttcctgggtcgagtggggacttggagaacttttctgtcttataagaggattgtaagactcaccaatcagcactctgtagctaggattgtaaaacacaccaatcacctctctgtagctagcaagaggattacaaaatgcaccaatcagtgctctgtaaaatgcaccaatcagcactctgtaaaatgcagcaatcagtgctctgtaaaatgcaccaatcagcaggatcccaaaagtagccaatcgcagggaggattgaaaaaagggcactctgataggacagaaacagaacatgggaggggacaaataagggaataaaagctggcccggtcttcagcacttagccagccagcagcagcaacctgtagggttcttttctatactttggaagcttatttttttgctcttcacaataaatctttctactggtccctgtttgggtctgtgccacctttaagagctgtaatactcaccgggaaggtccacggcttcatttttggtcagcgaaacgaagaacccaatggcagcaatcaactccagacacatctggtcagtcttgttctagatccagggaaagcaatgccctaacggcaggagggaataacccttccagctgatagcagttgttcaaatagtagcaaaggcacataggaagtgtgttgccaagctgcagtctgacaattgctccaaacacgaattttgcttctaagaccctgtaagctgtgggttgtactcaaaagctgtaagttctttgtgcaaaggctggagaaggcagcgagcgggccacgtacctgtcttttcgcagagtgtgagaaacgagactgttctctttacgtggcaggacagttcagagtctctatacccagagcaaccagaacgagctccccttggagtcatggacccagtatctcagttgagcaaatggtaattttcaccaaggctggctggcattgggtgactttagtggcctgtgcacacgagcgccccaggcccttgggcagctgccagtgtgggctggggcttccttgtcgggagggagccaccctgcacctgtgggtgagttttgtctcctggcagcctggcaggcaggtgtggctcatggcagggtgagccactggcacggatctgctgctttccccaggtgagagtttctatgtgcccaaaggtcaccagaaactgacagccagccctgagcaaaccccagcccagggttcatgttgcccgagcagaacctgctggtgtggtctgcaggcgggggcgtttttcttggttggctaacactccttggaaggaggcatgggccaggccagtgtgcttagcagtaccccagagcagtgttgggggcgggagctcaagtgtggggtcagtgtgctcgcaccagagccaaacccaacacttcctgtctcttcctttcctgctgtcaggtggggctgttgttggggaaagaaaagcagggaggacagcgtgggaggctttctcagggccagccctgggaatggggcacagtgagggggtggcatgggtcacctggccccactaagggccagaggcgaggagagatgtccggctgggacttcctgggaggaaggggcgcgctgccacgcagtgcccgaggcccttgggtatctgcgagcatgggctggggcttccctgttgggagggagccacgctgcacctatgggtgagtcctgtcccctcgcagcctggcaggtaggtgtgccttgggaggaaggcacgccctgccacgcggtgtcgctactggctggcaactgttggagaatttattgaagcacgtgaaagagccccaccctgccatagcaatcacctgcctttggtgaggctgagcctggccgcgggaccccattgaccgctcctggcctcacactaaatggagttgcattgctcctccaaattccaaccaagaggaccgagaagttggcctgaagcaggcgcacacgtggaaaagaggagctgaagccacgcgggggctgctcctgcagaggaggtggcttggtctaacttttcaaagcaatggccactcggctgcatcaacctgcatgccacgttcctggctttgatcattgacatgtgcctggctctgctgctctcagctcctggcctcaaacttccttttgaagaaaatcgctgaagcttgtggcctcacttcttccaagaggcagctacagacactctccgggcctggctgcctgtttgttgggacggggcctctggcttgggtttgctgtgcttcaacgccatgtgactccgaagggcctcactcacgccagggcccagcaccggctcggggacaggccaggctggcatgactctgattctgcagatagcatttttagtgactctgctgggaattggttcctgagataacaaagccactgacacagggatgacagatggttaacagcacctcccgagagtaggtctgttctaaacacttgacctgtgacagagcatccatgccacgcggctgctccatgaagtagacgccatcatcgtggtctctgcaggtctacgatggggacactggggagagaggagtgactgtgctggagcatgcgtggatgaggggagggggaagggagggcgtgagcccggtggtccagcaccgtattgtcctgctccactttcctccgaggcttgggtgtgcacgcgctggagccctccctctctgggttggtcatggccctgtcctgtgagaggtggtgtgtggatacctcctgctcctgagtgagcccggcgctccgtaaggagtcagggaatggatccgccatgccagcccagccctgtgctgccaggagcctgtctttctagaaggtgggagtgcgggcacaggctgcctgcccagctgcagagttccctcctcaagtgcaccctggagtggggacggaggagcctagggcactcatgggctccaggttccctggctccctgccaccctcatggtgatctgtccttgcatctactggggtactcaagtaccccgggaggccttggagtatttccacctatttttccttcatggcctcccagtgtatgcttggggaaactgaggctggtaaggctgtagaacacatcacccacagcaagggccagaggggtacatgaccaggggaagaccaggcccttcagggctcatggccccagcccatggccacagagacagagagttttcacttgggtggacactgatgggtcctgctcccactgtgagaccgcgtccccctgccagctccacctggggcctaccctgggactgggaagttgtgttttaagtcttgccctgcctcagtgttccctaaggaatcctgcctggttatgacatgaagcacacgtgtggtgtcccttttgtgcttctggagctgttgccctgattggcatcttgagaagagtactggcagtcaggggatcctggtgcctgccctggctctgcccacctctgtgtgtgtgtcagccaatgggactctctgtgtctcagtttctcgtctttatttatttattttttgagacagggtctcactctgttgcccaggctggagtgcagtggcacgatcacggctcactacagcctcgacctgctgggctcaatcgatcatcctgcctcagcctcctgagtagctgggactacgggtatgtgccaccacacctggctaattaaaaattttttgggggagagccaggcatggtggctcacacctgtaatcctagcgctttgggaggctgaggcagttggatcacttgaggtcaggagttcaaaagcagcctggccaacatggtgaaacctcgcctctactaaaaatatttaaaaaattagctgggcgtggtggtgggtgcctgtaatcccagctacttgggaggctgaggcaggagaatcgcttgaaccttggaggcagaggttgcagtgaaccgagatggtgccattgcacttcagcctgggcaacaagatcgaaacttcatctaaaaaaaaatttttttttttttgagacagggtctatgttgtgcaagctggtcttgaacccctgggctcaagcaatcctcctgccttggcctcccagaagtttctcatttttaaatggaccctgacactggactgagatctcaagctggtatcccaagaactgaaccccataggaacctgcctttctgaaggaagttagagaaaggtgcttccccaggacatttggccctacctcttcctgtggtttgcagcccctggcacccacacacagcctggaaagaccccacattccctgctgagggtcgtactgtgtgctgactgtgcagaccattggaacttgtccttccctaggtaggtcagggtcctgtcaccacgttgtctggaggatagcaggtgctcctgaagtgtttctgaattggaccatatgcaaaatgtacatcaaacgagtcttaataacctattgctcctagagtaattgaattcaccactgttgaaaccccgactggcctgagaaattggctcaggtgaaggagactgaagacatgtggcacgtgcaggcaacatgggccctgcgctgggtctcactgaggggaagtgctctacagggtgtcagtgggtcaaatgtctaactggaatatgggtaggagaccagatgcatgcatgcatgttacatctcctaaggctggagttggaacggcagagtaaagagtttggcaaatcctctccctaaaaggtaacagcaaaactggataaaatggtcaaaaccatcattccaggactggaaaacagccaaaagcagacagcatgttgagacatgtttacttaaggaaaaaacccctgcatgagaaatggcatttttgcctgggcttctcatagccccacttcccacctcagttgtgtaaatctgctaggcagggcatgccatggagcccagcagctttactgccctgtggggctggctggatttgaagcaggaatagtggcaatcttgggaaaggtcaatattgtagctagcctgatgtggtaatctgagttgggcaaacatcggaccagtagactagccagaaatctgggagatttggagaatgagaaccatagtgggccttgataagtgcccacatgtccatggcagtctggaagaccaggtgcatgtgcagggctgtgcacaatacccaggagagactgcacagtccccgctatccattgagtcagccttgcatttgcagattcaaccaaccatggattgaaaatattaaaaaatggccaggggaggtggctcacacctgtagtctctgcactttgggaggtcaagatgagcagatcacttgagcccaggagttcaaaaccaggctggccaacatggtgaaaccctgtttctacatgaaatataaaaatcagctgggcgtgatggcaggcgcctgtagtcccagctgctagggaggctgaggcaggagaatcgcttgagcctgggatggggaggttgcagtgagccgagatggtgccactgcactccagcctgggtgacagagtgagactctgcctcaaaaatcaatgaaaaataataatacatggggtagtgggggagcatggaaaatgggaaagattaatgggtacaaaaatatagttagatacaacgaataagatctagtatttgatagcacaacagggtgactatagccagcaataattagttgtacattttagaataactgagggagcataattggaatgtttacaacatgaggaaacaatgaatgcttgaggtgatggatatcccatttaccctgatgtgattattagattgcatgcctgtatcaaaatatctcatgtactccataaatatgtacacctcagtacccataaaaatgaaaatacaaatacacaatacagtgtaacaactatttatatagcatttacattgtattaggtatgataagtaacacagtgatgatttaaagtctgtgagaggactgcacaagttatatacaaatactattctattttatgtaaggaaattgagcatctgtgagttttaatatctgtgggatcaaattctgggtcctggaacaaatcccctgttgatgccgggggttgactatatatctctggctgaacatgaggccttgtgcctgtgcagaggagatgtgaaacctgacagactgtgaaagctggggcacatttgtaacactgcctcaactccaaatgcattccctaaaccacacacaaatccactggcgaagcgtggaagccttagtggttaaaggtgtttaagtacatttgaccaatcattggctgaccacatatgctaacccacaggcaaccactagaggaagctagagttgaaaataacaacaacaacaacaataataaaaaccccaaactgaacagatacatcagtggctgcacactgaggttgagactgattctacaggatttgttcagtgaagtcactaaaacaaaaatacagcaacagtcccttgggggtaaggggaaggagcagaatccagagttgctacaatattacataaagtgtccagttttaaaaattatgagacatgcaaagaaacaggaaagtgtgatccctatttgggtggtaagtcgggaggaagctgggaggaagctatcaatagacactgtctgatggggcccagatgtttgaatttagtagacaaagatttcaaagcagctatgataaaatgtttaaagacctaaaagaaaccgtttcttttaatttgatgtgacttttttttttttcttggagtgacacagtctcactctgtcacccaggctagagtgcagtggcacgatctcggctcactgcaacctctgcctcctggattcaagcgattctcgtgcctcagcctccggagtagatgggactacaggcacatgccaccacatcaggctatttttttgtatttgtactagatacagggtttcaccatgttggtcaggctgatctcgaacaagtgagaggtgattcgcccgcctcagcctcccaaagtcctgggattacaggcatgagccactgcgcccagcccatttttaagagcaatgactcatcaaatacagactatcaataaaaagataggtattgtaaaaaaaaaaaaaaatcaaatggaaattctggggttgaaaagtacaataactgaaatatttagggtttaatagcagatttgatttggcaggagaaagaatcagtgaacttgaaaggagattaataaaacccatccaaattgaagaatagaaagaaaagaaaatgaagaaaaataaactgaaaaacagacctaaatttgggactcatcacgcataccaaatacatgtcatagaagtcccagaaggaaaagagagaaaagggaagaaatatttgaacaaataatagcaagaaagtcccaaatttgatgaaaaatacaccagtgaagcacaacaaacttcaaataggattaacagaaagagatctatagctagatgcatacagagttgaaggacaaagataaaatttcaaaacagcaaagaaaaaaaaaaaaaacccacaaccttatcacatacaagggaagaactacgtttaacagctgtctcaagtgaagaagacattaaaatgacatattcaaagtgctgtaggaaaaatatttattaaccaagaattctttagctagcaaaactatccttcaaaagtgaagacaaaataaacaaaaattgaagaaattcaatacaagcagatctgtcttataaaacatactaaaggaattccttcaggctgaaaagaaatgacaccagaagataacctgcatttaaccccagcatagtagaaaatacctatatttcttatatgctgtatatagatattttctagtatgcttttaattccttttttattgcttcattcttacttttttgttggaattggttgctctaggaataaagagagcaataaaggagaaagaagaacaaaaaagcctaagtcatataatctttaaataaatagagaagtggcaggaagaaattaaaccataacaatagttagattaaatgtaaatgggattaaacactccaatcaaaaggcagaaattgatagtaataaaacaagatccaactacatgttttgtataaagagacaccatttagattaaaagacacaaataccttaaaactaagtaagaatgaaaaaagatataccatacaaacagggaccataagaaaatttaactgatattctaatatcagttaaaatagactttaagacagataatattgctagaaacaaagagggatatttcataatggtcaaaaggaagatatagcaaatataaacatacatgtttctaacaacagagctccaaaatatgtaaaacccaactgacagaattgaagggagaaaaaggcaatgcaataatagttggagccttcaataccccactctcagtaactgagataactagacagaaaacaagcaaggatacagaagacctgaagaacagcagcaaccaacttgacttctcctctatctataaaaaaccccacccaacaacagaatacacattctcttcaagagcacatgcagcattctccagatagaccttgtactcgaccacaaaaaaggcctcaatgaagaggattcaaataacacaaagtatgttttcacatcagaataaaattaattaaaaacaacagaaagatatttgggaaagccccaaatatttgaaaattttaaaaattacttctaaataactcaggggttaaatcacaaggaaaatagaaaatattttgaactaaatgaaaatgtaaaaatatcaacatttatgaagtacagctaaacagtatctagagggaatttatagctttaaaatgcctattttaaaaatatctgaaatcactaaacccagcttcctccttcaaaaattagaaaaagaactgaacccaaagcaagtagaaggaaagaaataataaagactagcgcaaactccacgcaatgaaaaacagagagccaatagaagaaaatagatgaagccaaagtcaattcttgtaatgctttctgaggttaagtgtagtgtagttatataagagaagactcttgttcttaggtaatatgcatcatgtcttcaaccttatgctcgaatgattcagaagaatattgttatgggcagaaatgtttatatcccttaaaattcgtaacccccactgtggatgcatttggacatggggtctctaaggaagtaactgaggttgaatgaggtcctaagggtgggcactgatctgacaggattaggatcctcatgagacaccagagggcgtgtctgctctctccatgtgcatgtatcaaggacagcccactgaggacacagagatggtggctgtttacaagtcaggaagagaacccttaatagaaactgaccatgctggcaccttctagcctccaaaacgatgagaaaataaataaatgacagcacaaactgcaaattttccaaggaagcatcttggacctgatctaagccactcagtttaagccactcagtctgtggtattttgttaccgtagccccagctgactacatacctacctacctagagtgcactgcacaggtggaaaattggcaacactcagggagtctaggtcaagggcagaagggaagttctctgtattattctcgcaaatgctgtgttgttgcaactgagcgtgaaaatatgctaaaaaaaaataaaaactaacctttcccctgcctgggtggtggacacttaagttgctgggctgtgatgggctggaggctgtgctctcctggttccctgactgaggtgagggccttcggtttagtcctgccctccctgcacagggttctttttgcctctatcccactaagtcgtcaagacggtggacgcagatccactttctgcttcctcctggtgcctgccctgtgtttcccgtggtcctccttggaaaggccacaaaagtgtttcaagaggactcaggtccaagatgcttccttggaaaatttgcagtttgtgctgtcataaatgtggcacattaatggttgctaaaactggggagcaactcctcaaggcttggtgggagcatttcaactgagtttaaatattcaaaaacataagaaccaaatcctgtcccccaggggcagcagcactggatcctactgaccaagcttccaccctcctccctgggcctatcaagaagaaaccaatgggccggacacagtggctcatgcctgtaattaatccaggcactttgggaggccaaggtgggcggatcacttgaggccaggagtttgagaccagcctggccaacatggtgaaaccatctctactaaaaatacaaaaattagccgagcgtggtggggcagtgagccgagattgccccactgccctccagcctgggtgacagagcgagactccgtctccaggaaaaaaaaaccaatgaagccctgggactgtttggtgcatgtgtcctctactgaagagcaggctgcaaagaaactcaattttgctttaaagcactcggtttcaaatgtttctgaaagccctcagcttcccactacaacggcaaccgctgcttggtaggtatcaagactggggctgctccctgggtctcaaccttcatgctttccacttggttcctgctcatcttcaagctgtccttatccaacatggaagacactcattctcagaagtgctctgggaaaccccatgtcctcaaagtcctctctaggaaccccactgccgtcgttccagccggtttctgccacacccccactgacaagaaatgaagagttgctagggtgaatacttggcacgcccctcaacactaaacagcagcagcatactgaccacatgtcagtttccacattttctttccttctctgtttttaagggggtatgaaatgatttatacctgcatgttttcaaatccacttaagaccaggaggtgctatgtggacaaatagatcaaactacctcaaaactttacggtgacaatcaagccaaggtaaaacacgctaaaatcaccacctgtgcacccacctcttcctatttttccgcgggtgagtgccagaggagggcgttccacatgggggctctagtgcgtctcacgaggtgcacttctctcatgcaccaagtgaaaaccttacacatcttccctgcctggcattgcgccagtaggcagaaaacttggtgcaacaaaactcaatttttgtctttattggcacgtggtttcctagacaactatggacacaattccctcagaacagcctatggtgcaaagggagggaagggagagtgtcagaatgtggaaggcttgtcgtagttggttacagacctctcttctgagcaccttgtttgtgtcaacttctggctaacctgaatgaacacccatcagctgggagaaacaagcactagggggcaccttcatggtcactggtaaagaaagccctaattatctacaaaatggaaatggaaaacaaacatttaaagttttatgcattttagttttgaactagaaatcttccaagtttaatatataccttcctagtgaattcccctgccaaaaacaaacaaaaaacccctcccctaaaccaaatggtattcctgcatcttgggcaacagctccttcactgtcaagtagttccaaaggaaagcacgagtaggtaagagtcaaaaatgccactgagtttttgctgtgatcaaattgatcaggagacaacaatgtggttctgtaaaaatcagcacatcaacaatgtgtcttcccacactccatctggggaaacccggctaagcagcctggaaacagagtgccaggtcactctctacatgtagggctgctgggcagccgcagtaacgtgtgcccggatgcatctgtgtacacagctctctggtttgctttctgcaaattggacggaaaacagagcctggcttcccatccagtaaatggttttcaaactgcgagtcaagaaaaccgaaaacttactccccatctgcctgctaggtggccttcctgcatttactgccacatcccttcctagccaactgctccctgtctagacggaagccacccagtgtcaacgtctgtgtctcctcacctgagtcatctccatctgctcagtgccttgtgtactgcattaagtacttgctcagaggtcaagaggaggaactgactcacgcagcattagtggatgttcactaagccttctgttgattgtaacgttagtataggggaagggcaaaagcagaattctgaccctaaagcttggccatctgaatgaactcactgcaccatgctcagtgctgtgggaagatggttaggcaacagaaatgtccttaggaaggagctctaggtatctacacctgaccaggtgttcatgccacatactaaaaggtagggggacaaaaaacagacttactgagttgtgtccctttcacaataaattgtttccctaatttatctaaatgaaaactgtcttatttaggccttatatatgtgtgtctgtgtttacaataaggacacatttaaaacagaaaactcaacacctatatcatactacacataaagttaactcaaagtggatcacagacataaatataaaacaaaaaattctgaaacttgagaagtctttacactttgggctaagtgaagatttctcttaggatagaacatcttagtgaagatatgacaaaagcataatctatgaaagaacaaactgattaaactagacttcatcaaactgaagtcaagcgaaatgaagtaacgtttacacaaaaacctgtacgcaaatgtttatagcagtttactaataatctcccaaacctggaaacaacccagaagttccttaactggggaatggataaacaagctctggtacagccacacaatggaataccacctggcaataaaaaagaacctgcaacatcatacatgaatctcaaatgcatcatgctaagtgaaataagccagactcaaaggcaacatattgtatgattccatttatatgacactgtcaaaaaggcaactatagaaacagaagagatcatcctgccaggggctggaagaagggttgagtataaaggggtacaaatgattagagaagataaagaaactgttgtatgtattaaccgtggtaaataaacagtatgtgtttgtcaaaatttgaactatacattttaaaaacagtaacttactctatgtaaattataccttaacaaagatgaaaaaaataaaatccacatagatggattcagtccacaaaggtgtttactgaaacactatagcaataatccaaatgtcaacaggggtggcagttaagtaagtaggatgtccacaatggaatatttatgctcactaaacccattttcttcccccaaatgtgggtgacattaaacaatgcccgtgctatttatctggggaataaaaccatatacaaatggttacacgcacacacacaaacgcacgtgtgtccccatgcaggggtgtttctccacgcaggggtgtgtgtttacccacagggggaagtcggcctgctgccttctcccactctgtctccaggtccttctgccccacttcagtctgagcccttcagatgagcactgcccacccatctgtacatgctggccaaggggagaaattctgcatgcaacaccagacgacgaggtggtaggtgacgctgggtgatagggatttgtgtgcaggattttaaaacaggattataaagctgcatgaaactagaaaacagtgggcaaacagaccaagccagcactttattttaaaaagttttattttggagatttagaaatttgagatttttaataacggcaaaagaaattcagtcacacctaatgattaacagaatgtagtggtgtattatctaaacagaaatcgtgctgatgtgccataataaattgtctattagtaaaaaaatacactttagggcacagcattgtatcacaaattacagtagggatactttgcaagaatttaatcaaactagagaattctgagtaactgtatcttttaaatgcagcacttaaaaatgtaacaactctgtgcatcctttttcttaaaaaaaatgaccttgcatgtgtcatagaaacgctgctttattgctgcagaggtcaaagttcaaggctcaagaggtacaggagagaatacaaaggtagcctttagaaacgtggtcttgtttatgtataaaaaaggtaaagtttataaaagttaatttacaaaccaagaacaaaagtggtatgcacgcattatgtacaagcatccttaaaacatcaaaattttcaaatgcatagccagaaagaacagaaaaccaccactgccccttgtcaaaaaaaaaaaaaaagaaaagaaaagaaaagaaaaaaatatccccaaatcacaccactattttcttctgggtgataacacatttctgaaaccaccaaatgcacaacgtactcagtctttgtcatgatacagtatctagataatgcacaaaagccataaaaacttagtaacacaaggagaatgagctaagaattaagaacatgagggtaaggcatttctgctggttagtatgtctgtggtaatatggtgaagttagagatctgaagaggccatggaaccagtctcacatgcttttgtatccttccctaagaaaaatgtgttttcatgtacagtaagtcattgtcttcacttcaccctcccccagttgtaaatctccttgctgtacatttctgttaaatccacaacactggttatatattccaggtgcatttaaaaaatgtgtgcatattacttcatgcataataaaataaaatgtgtacgtatgctaggccagggccatagtaaagtttgaaacagtgtactttggaaagaacagacctcaaatgcacccccatttactggctggtattttaacggaaatcaatatgtgaagttaagcagtgacgataaaaaaattacaaaaatcacaaagcaaaatatctttgaacctctagccaataccaacagtcccgtcaatcacaaacatgcagtgtgtagcatgttttccgaccatggttcaggggcatgctcactcatctttatcagttcaaacaaatgcctcatactaacaaactgtagtatcaactctaaaaaaggtataatacttgatagagtggttccatttagattaagtttaatccagtttcacattatttaagttcctatatttcaagagttaaaagtggtcaataaggacagaaacacagtttgctccaacgagataatttggatctccgggaagacacttgttttgccaggttttaggatcacctatgagagaaaagaagttgatgtcatttacagttcagtaaactgctatccgtaatgctttgcaattatagggcaaatacgtatatttagacataattttcttctgtttcttcagcatattgaatttgtatcaaaacacattgctgtatttcaaagcagatctgctggcatctaacaattccaaaggtgtttcacacttctaaaaaaattttttttaaaacgttctttctaactcacaccattaagaacagttttttgttttttgtttttaattttcagacttctcctttattacattatcaagtgcattggccttttcaaaaaatgaatacaagtgagtgatggcaatcttatgcctgggacagtcccagtttgccagagcccacataattatcagtagcactttttttttttttccagtttcgaaagtctggaggataattatgtgatcacctatttgagctgagaatgaggacacatttctcacactcaactataaaccaacaaatgaagcccagttctgcagaatctagttcttgaagactgtcttcccccttacaaaaaacaagcaaaaaaacgagactgcaccagagctgctcagctctgattccagctggacaacaaaattaatcatgcagcttcaaaaactcattgactgggtgttagttaggtctcaggatttaagtttttaataagctcttggtgatttctattagatgtgaaggcagggacgactatatgtctctgtggtgtccaagcaagctgagagtcacagctgtggacgtttgcttcccttacagaagtagctctcaaacaggaatgaccctgcccctgatgggacatctggagacagttttgcttgttaccactggcatctaggggtagaggcccagggaagctgctaaatattccacgacgaacaggagggccctacaacaatcatttggccaaaatgtcaacagtgccagctgagaactttgcttacagtacgttagacattacctaagcaatatctggagccaaaagcatttcatttttccagaaaatggggtacttgtaaatatgaggaaatatgtatttacatgtaattttttcctctgataacattaaaatatgctcttgctataatctttagaccacaaacttttatttcatactgtaccaaactaaaactaaataatgctcatctgatttatcaaagatttggaagctagactttaaatcaggttcgcttaaagtgatctacacccaaaataaaattctaattattaactgacttaagtcactcaaggaagtgagaaatgtgaaaatgcagtggaagctttgaaattatctcaggagaaaaagtcatttacaaatagtgtataaaagaagtaatttagagtattacactgaaaaaccatggccaagtatgatcacaacggaagatcttgttaagtttctctggtatacatacgttgtagattaagaaattaaacaggccaggcacggtggctcacacctgtaatcccagcactctgggaggccgaggcgggtggatcactttaagtcaggagttcgaaccagcctggccaacatggtgaaaccccgtctctactaaaagtacaaaaattagccaggcatggtggtgggcacctgtaatcgaggctgaggcaggagaatcgcttgaagctgggaggcgaaggttgcagtgagctgagatcgtgccaccgcattccagcctgggcgacagagcgagactccacctcaaaaaaccaaatcaaaacaaacaaacaaaaaataaattaaacaatagtaaccaaaaatagaaatagttatataaaggaacaaagtcattttaataaggtaaaaatgcctatttgtgcaggacaatatctcccactgcatcctgaaaaatttgacagaataaatcatttttctgaacaccaagaaatagtcaatatttggccatattatcaaaaaaaaatttttttgagacggtctcgctctgttgcccaggctggagtgcagtggcacgatcttggctcactgcaatctccgcctccctggctcaagcaattctcctgcctcagcctcccgagtagctgggattacaggtgtgtgccaccacgcctggctaatttttgtatttttagtagagatggggtttcaccatgttggtcaggctggtcttgaactcctgacctcaggtaatccacttgcctcagcctcccaaagtgctgcgattacaggcatgagccacggcgcccggcccaaattatcaatttttaaaaggcagaaagtcttctacctttccatatttatttacaatatatgcaccacaaataaatgtgaaaacactggtgatgcctacaaggccacaggaacagagatagagatttgctaacacacagcatgggcagcatcatcagcccaggtattaatcaacgacagtccccaaagctcccaaaggacagagtgaagacagcatacccgacgaggagtcggatgattttagagcaaaagaccaaccgtcaggagtcatggacgcacagtgtggtaagcgcagctccacaggcttcaggaacttgaggccatggggaccacacatcaccaaaggactcagcagtgtttcacctggagttggaaaaggggataggcagagaggatggatgtggtctttcttctagaatcccagttttcctcaccctgcttctaattatatgcttgaaagcctaatggagttagttctctacagtcgcactgaccacaaaaaaacgtaacagcagccacatatggaatcttaaatttcccagtagccacgttagaaagtaaaaagaaacaagtgatatcaaatcttacaatattttaatattttaactcaatataacgaaaacactgttatttcaacatgtaatcaatatatgaaatctttggaacttggtgtgtatttcacatttccagcatctttcaatcccaaattgtcacacttcaagtgctagctagccacgtgcaggcagtggctactgcattcaatcatatgggtctataataaaaaacatattcaaatgtgcttgttgcgaatgtgatatattttccattttcaaaatgttttgtttgctccataggtggttaaagagattcatgcagggccaacacagtcagtcctactggtttttaaaacaggatatccccaaaatcagagtacagaatcagatgtcagtattccggcaaaatacaaaaaagcgaactaaatttgtttaggaagtaaaagcactgctaaaagatgctaaatcacaacacacttcgttataatatcctggtagatccaggaggattatgaaaataagtttccttaagaagctcagaaacatgctgtcatctcctctgagactccttcatgcactctgctgagcatgtactagtgctaggttctggggtgatgaataagacagtacctgtcaagaggtttaggttctccaatcaggtgaaggcacagcaaagcctttctgagtgggtgttacctaacccatctccagagacgcaaaggctgactgattcaaagacaaatttggttaggtcagcctaggctgctcagcaggtgagacatcccgtggcctgtcctatgccatcattttttatttcacaccaaaagtaaaagcaggcagtgtggtcaccacagccttgcttcaggccacccactgcttgcttgcaacaccgtccccagggcacccctcgctacagcactcatctggagatagagaggtgctgcattattagccaagcactataagctctgaagtgcacacagggcaactcttaagttatcaaaactaaggagaaaaataaacacatttacctttctctttatctaaaggtggaaggatgctgttgtcccggcagaccttgaaatagatttcctgctcaactccttcgggaatggctccttgagggataattatactaacaccagtttctatggaactcagcacgcccccattgctgttaaatatgcctcgggctgtggccaccacagtatgaccatcttcatcttcatcctcttccacagctgaaggactgaaagttcagaaatggctagtgagtgaattcctaataatacacaggtgctttgcttttactactactgtattacgtgctttcacttttatttctccatataatcaagaagttactttaacaagataagtttctggcaacagattttactgacagggttatcgcagagaatattatttcttttttgtttgtttgtttggttttgagacagagtctcactctgtcgcccaggctggagtgcagtggcacaatcttggttcactgcaacctccatctcccaggttcaagtgatttttctgcctcagcctcccatgtagctgggactacaggcgcacgccaccaagcctggctaatttttgtatttttagtagagatggggtttcaccatattggccgggctggtctcaaactcctgatctcgtcgtgatccacctgccttggtctcccaaagtgctgaggttacaggcgtgagccaccgcgcctggcgagaatattatttctagagaaattccattctagaaaatttcaaaaattctagagaaatgtcaaaaattcaatttttgaaggcaattagtcaaacgaccttcattaatgaattgcaacctgaaagtgtaaaatctgatgccttgaacacccaactacaggtgaagcatccctaacctgaaaatctgaaatgctccaaaatcggaaacttttttttgagtgtcaaaatgaagctcaaaggaaatgctcattggagcattttggcaatattccaaaatccaaaaaaacccaagatatgagacacttcagaacccaagaagtttggacaagggatactaaacaggtacagagttttatgaagcacattttaaaatccatgaaattggaactttaaaactggtaagtcacaatttaattggtagccctgttcttcccttcctgttgttttttgaaatggagtgtcttgctgtcacccaggctagagtacagcggtgcaatcttggctcactgcaacctccacctcccaggttcaagcaattttcctgcctcagcttctgagtagctaggattacaggcgtctgccaccatgcccggctaatttttgtatttttagtagacatgggttttcaccgtgttggccaggatggaactcctgacttccagtgatccgcccgcctcaacctccgaaagtgctgggattagaggcatgagccaccgtgcctggctgttcttccatttttagtgacacaaaacaatggtgcatctcacggctgacagcatctcagacttgataaaatctccctaggattttaagtgtgcctgagtatggtcctgcctcagcattccctgaggaccaagcgcccgctctggctgtaggaggcaaggcttccaaggttccatgaggcgaagacccttgtatgggcatatcccaaacatccacgaaagagagacagtagattaacttagtaatcacagaacgccaaaggcaaaggggatgtggtatcaatgactgcttcaaaagtagaggctatcaacttcctgaaagtacagttttgagccagggctcaaaggtgagcagaaagaccaacgaaacagaattacatgaaggtagctgccgtttcactccagcatgaccggagtgccagggacgacatcctacgacacaacatcaagggagcagagcgcagcctgagctgcagagcagaggccagctctgtccgcccctgaccatctgtggatgtgcagagctaggaaggcagtgaccgccataaccatcctttctcttggaaagcagactcaggtggccatcctgacctttggttctccctgcctgcaagtgcttctgctttatggtggcgtgaaaatggaactggctgtaggaggctgagatgagcttttatgtatggccagaatccatctggtcaatcgccgtggaatgaaagacaggaaagaggagctgcagggaggctccaggtgggctcactttgtctcatttgctcagccatctcactaactgctgctctttaaacagtcagaggttattctatttttcttcttagcatcattgtggaacaaataatgaatgaggaacatagatacttaatgtttttagatgtcctccacatgcaccttaccagtaggtcaggaggttacaaaaggtcatggctggttaagagtatgggctcctggctgggtgcagtggctcacgcctgtaatcctaacactttgggaggtggaggcggatggatcacttgagatcagaagttcaaaaccagtctggccaacatggtgaaaacctctactaaaaatacaaaaaatttagccaggcgtggtggcacacacctgtagtcccagctacttaggaggctgaggcaggagaattgcctgaacccagggggtggaggttgcagtgaaccaagatcgcaccactgcactccagcctgggcgacagagggagactcttgtctcaaaaaaaaaaaaaaaaaaaagcatgggctcagaggtcggatgaccagcagctaaattgaggctcacctcactctagctgtgaccctgggcaaactgcttactgtcactcaacctcagttcttagtaaaacagggatgatgacaatacctaccaaccatacacgactgttagctttattattttaccaacatcttgtacctcctggaggaccttctatgtaacagcattcattgcaacaacactcttcagtttaaaggttgagttaaaaagatcactttaaagtcccaagtcaaataaactacaacaaactcacatgagaaaaatcacagggccaatgctttgagcaaaggcataagtcttacctcacaggaatagctttaggcactgtgctgatattatttatttgatatttaggcttctctgcatggatagagaaagtttcaactccactgtcaaactcaggaggctgtgccaaactgtgcgatttcacaagagtttttggagaagtgggagtttttgaagacaagtcaggtttatgtgcagtttcacttggcagaagattgtgattgaatttaggactttcaaacttgcgttcaaatggtcgggcagaacttgtatatggttttggtgtgaatcgattgtatgctggagtgactgttttctgagtctgttcagttccattaactggggctttatctggaaaacttttctggggatagaaagctgcctgagcagtatcttctcggtttggtggtctgaaagttgctggcttattctgagatggaggtgggtctggtttggacactaaggaattctgaaaatccaatgacactgaattacctgaaaaacaaacgtaagcatttaaataactttctgaaaaaagttataatagccctgtcccagcttaacttgtcctggtgctggagtcgaggcccaaatgtgggtcgcacagccagagcctgactcttgagccctggaggctaggtgtgatgctgagggatgagggcagcatggacaggtggtgccatgaatatatataccctgctgccctggagtcagggtccagctgctaagattcctggcctccaaagattggcactagtctttgtgaaaactagaatgcccaataatcatataataaggatactcactattaattagaaaaatgtaaaacaaaaccaacaaaaagcattaaatactatttcacacccactagaatggaaaaaccgaaaagtctgatgatgccaaacattggttaaaaagtggaaccacaggattttttatgcactgccagccacagtgtaacacagtaccaactgaactctgtgaaataattaaggacactacaagacaggagaattattaatccaaatacctcatgaatatagtaatataattttccacagtacgagaagaaaaatcatatggtcatcttaatacatgcaggaaaaacatctgactgctttcagcaaactctgaatatagggaatgtcttaaacatgataaaggacatctacgaaaatcctagagctaacattctaaaggataaaacatgaggtccttcctccttaaaatcaggaactagcaaaagaggtccaatttcaccacttacatttcagagtttattggaggtcctggccagtgcaatcagcaagaaaagaaagaaggctaggtgcggtggctcatgcctgtaatcccagcactcttgagaggccgaggtgggcggatcacctgaggtcaggagttcgtgaccagcctggctaacatgatgaaaccctgtctctacaaaaaatacaaaaattagccgggcgtggtggtgtgcgcctatagtcccagctactcaggaggctgaggcaggagaatcacctgaacccgagaggcagaggttgcagtgagctgagactgcgccactgcactgtagcctgggcgagagcaaggcttcgtctcaaaaagaggaaaaaaaaaaagagaaaaggcataaggactggaaagtaagaattaaaactgtctttatctgtaaacatgggcatgtgtgaaaaaaaatcttaataaaagatagcctcaatccagaactataacacatctgcttgaagactcacaagcccaaggaggtgcctcctaagggaataataagagaagtctgtgctaggaaaatgcctgtccacagcagaagagataaccactttgtgttatatgctgagggtaaaatgttacaaagctcttaagatgaataatctggagctatatgtgatctacctggtatgtaaatgcaaaagtcaaggtgtatgggatacattttatatgaaacattatggcttttctatttgggtgtgtgagataaaacatagtaggttttacaaaccatctttacatatactggcaaacactacttccagaagatttagagactagcataaaatagattaaaatctgtttagctaaaaggcttgtccaaaataatggtcttgtaaaaacaggagacatacttttaacaaaattcttagtttttactgttcccagcccaaaggtttcaagcatgtattttttaatgtaaaaaccattttgcctagaaaccaccagaattttacttcataagcattactgtgttaaaatgtctacttccgaacttcctaccttcaccatgtgctcccttagaatgtatgtggagagacgcgctggtgacaggctgagatggctgggcatactgcgagggcaatggaggaggagggggagtggcctggatgggttcatagcgtttctcgccaaatgatctatccacaccatcagcttcaggaggctttcccctgttaacaaatgaagaaaatgccaacacctgaaaatggactcacatttacaaaacaagttctcatttctccatgtatctctaagttaaaaaaaaaaactagaaatttcacaatttattctcatgagtatgggtagctactctaccaaaatataaaaacagattcgaccattcatcggcacaagaaatgtccagacacacaaaaactttaagaatattagtaaaacatccagaagatggcaaccaaaggcaggtgaaattttgggtatagtttaattgttatttacaaaagatagtaatgttgacagatttaagaaagtcttgcaaatattctgaaaacatatcatggcacaaattttcctgagacccactttttttgtttttgagacagggtctcattctgtcgcccagactggagtgcagtggcgcgatctcagtttaccacaacctctgcctcccaggctcaagtgattcttctgcctcagcctcccgagtagctgggattacagatgccagccaccacgcctggctaatttttgtacttttagtagagatggcgtttcaccacgttgtccaggctggtcttgaactcctgacctcaagtgagccgcctgcctctgcttcttaaaagtgctgggattacaggcatgagccaccgcacccggccctagacccacttctgattttgtatctggcatctggcatactcggagcaccataaaaacagatgtcacagactaggggttggcaaactttttcactgaaacaccagagagtaaatgtttgtggtcttttggcccatacagtctttgttagaactattcaaattatgcggttatagccttgaagcagccacagacaatgggcatatctgcgtttcagtaaaactaaaaaaactggagcttttactttaaaatttccccttgagttaccaggtccattttttggttaaatgactgctagagcagcagatcctgctttattttacaaggttcatttaagtcaaattgtgccatgtatgtttattttttcagattgccaattgttaatatgtaacacaaaattcacacaaatctttttaaaagacccataattgcaacattgccatctaaaccttactgctgaatgccaaagctgcactagctttatgtgcaccaacaataacatatacatttggaatactcctggtcattttcataaattttcattgaagaagtcttatgattggcttttttatcttgctttcatgaatttagactaagcccttgatgatgacattaaaatctgaaagtgcacataatgccagtgacacagtgagggacaccttatggaacagcctcacattaattgccagtcttaccacttgacgttccttttcaagtagtcatagctagtgtaagagccaagaaatctaggtgatggcaaagcaagcgcaatagaaaaatgaaagaaaatggtcaatctaactaagtaaatttgcagcaaatggaactcaaatgtcatttaaaaatatcaaccaacatccaccatttcaccataatttggtctataaaggaacatatcactaactctcatttggccaaggaaattgaagataaataaaacacaatcacttagttatgtcccgtctgctggcccatccttcatgtactttaactgttactgcagtgaaaagcaatgtgtttgaactttgctccttctccacctctgttgcagctgctaatagtgagcaaagaaatttatcaaatcaaagagtggtgatcaaggataattagcaggttctgaataagtgggagtgacatgtcccattaaaaaaaaaaaaaaaaaggctgggcaaagaaattctgcaagtgaagacacaggaaaaagtaacacaacagaagagctacattgagcccctgggaggggaatggtaaatggagagatagaaatatgcctggcttgaaacctggccaggcttcacatgttcctttctagcaagacctcctccatctccaatcgtaagctgggccctgtggtggtggagtcttactggtgaagctgcatgcttgatgctcaggctctctctcatctaatgatgtctcacaaacacaaaaacaactgaacatcagtctctcacatttagttctttaaaagctacaaaccaccatcatttattgagacctggaagtctcacatagtgagttgagtcctgaaaggtagatttgataacaaaaaatccctggttgtcctgaagaagttgactcaatctctggactgagacatgtgcacagccctggagggacactgctcttcttgcactgttttagaatcctggaaacttctaatttactttggaggtgaatgtctaagctactgtctcctaacctttccagttctaatccagctctatggaactgttagactgggtaatatctgcttgcttcctggggcatctgtcctgtgctaacaaagattattttccatatctaattctcaccatttctgaggtgtgtttttaagtgaagcataagcacacatcatctgaaggaagaaaattttgctactcctgtatttactgaaagaaagaaatgcctgaaggcagtcttatttagtgacaaacagtaaatggttttgaaatgcaggacagaatcctatattttaagctattttccagttgatgaagttgtactcattggacaagagtatgaaaaagcattacaagggaaacttacagaaacaactaccctcttagttatcttccatgacccttattctcctttccatttctctaaccattaaatacctatatgggaaaatgcagcacaattataaagagtttcaatttcacactacaaaggaaaaaaaagtatactggtatccagcccaaactatacttttctctctcacagcagcagggagtaaaatcaaactgagttctgagtaaattcacaaagacagatgtcatctgtttcacaatatatccctgtgaaaacaatgaccaggtaatacaggttccttccagagctgtgttaatgaaaagaagggtggtggatgcacctagtataccatgccctgttttgagcttcattcactcaacaattactgagcccctactgcatgcaaggcaatgttctacaccctaaagttatacatcacaaataagctaagtcttctttctagaaaaacaaattaacacagaaagcaaacatgcattttgattgattccctggcaaaacaacttactttttagacctaaatatactcctttttttttttgagatgagtctggctctgtcgcccagactggagtgcagtggcgcgatctcggctcattgcaagctccgcctcccgggttcatgccattctcctgcctcagcctccagagtagctgggactacaggcacctgccaccatgcccaggtaattttttgtatttttagtagagacagggtttcaccatattagccaggatggtctcgatctcctgacctcatgatccacccacctcggcctcccaaagtgctgggagtacaggcgtgagccactgcgcccagcctttttttttttttttttttttgagacagagtctcactctgttgcccaagctggagtccagtggcacgatctcggctcactgcaagctctgtctcccgggttcacgccattctcctgcctcagtctcccgagtagctgggactataggagcccgccaccacgccccgctgatttttttgtatttttagtagagatggggtttcatcgtgttagccaggatggtctcgatctcctgacctcatgatcagcctgccttggtctcccaaagtgctgggattacaggcacgagccactgcgcctggccatataatctttttaaggttgtattctatttaccaaatatgtaaaacgataaataagagatatctttaaactaaacacctgagccttcttctgacaggaatgaatgtgtttaacggtgtttagtaaaaataataactaaagggtacacccttctgccttaccaaaggtgagctcctatggctcagtgcctagctcactttaggctagtcaccatttagatgttactgtgataactgtgtaaatgaattcctgtaacactgtaaatgtaaatgaattcctaatgacaaatccacatctgtttttgttcttgtgggttttgttctgttgaggtatgaacccagctgtgcacctgtgtgggtttatattgtgctagctcacttcagtccagacaccatctagatgccacaacccctttctagtgttgtgctaaggggtggttcacaacactagtacaagacacgttttgcatttaatacaacccccactgcagcactctcagtttgcatttggattctcataaactgctttcttctgtaaacataaagccttaaatataggacagtgaaaaaagtcttcactacaaaggatgtcttagaaaaaagcagtggtaattaaaattaggttttaatgttagtggttttaaagtatgttctaaaacaatttacactcaatagtaaatgacaaataggtcatttcccaagataatcccaagcccacgcaactaagtaaggaaaaatctaggtgcttttaatatagacacaatactatgtgtgatgaattctaatatgtcaatctggctaggtactgccatgaagggatttttcaggtgtaatgtccccaagtcagttgaggggagatggtcttgggagggcctggcctaatcagcagagccctctgaatgagaatttaggccttccctgatctcacactccccagtagctcaaaatcttcccttcctgaccaactgccctctgaaataggacttgcttagccagcccctgtaactgtgtaaatgaatttcttttgacaaatccacatctgtttttgttcttgtgggttttgttctattgaggtatgaatctacctgtgtgcccgtgtgggcttagacacaactatcagtaccaaattctcttatcagtcagggttcaaccagagacacagaaccagtaggagacacaaacccacgcaggcacaagaaaggagaacaaaccaacacgaaacccagggatgagtaaacggaggggagcagcaagcacagggaaaagatgactgggagtcaagaaacttggggttcagtcccagctctgccctgtcattttccctcacctgtaaaactggatcagaaatcttacaaaaacaaaaaacaaaaaacctcttcagtatttccctcaaacaggatcctcctcacatctgtatttatatttaaaaaataaaaacagaaaagaaaaagaaccagcatgacatcattaggtgtgtgtacagaagtgaagactgatgattacctatcgatgagggtccttgtggttgacactgtcttccgtcaaaaccctgtgatgttagcatctttgtgaatgcaaaaactatgtacatctaatagcagactttaaaaacaaaacacacatcccagaactaaaaagtatgtacaatgctgaaccactagagcctacagaaatcatatattacacttaaattatttttcttcaaaatatattgaactgcacgggattaatatgctgcatcctatttttaaaagccaggtgaaatagcttactttgaagaataactagaaaaatttgattgattctgagaatgcgctggctttgcaggctcggagagatggctggcggcaatgtgtgcaggaggcttattctcaaaacttcttcggtcaaagtatgacagctgttttcgataatattcttcatcttcttcagggtcataatgattggaccgaacaatatcttcaggtggcttcagttgaggtttttgaggttctgggatcctaacagataatgaatgacaaacggaacacctttttaaatattaatgttatgaaggaagtagaatatgtaagtcttatcttgactaaaaggtcaataattactaactgctgtgattactgaggatctgagcagtcccaacagttaaaatggatatttcaaatcccatgtcctcacagagtatactcaaaaggcagcccccttctggctcatgagtcctttaacacaatataataagctaaacgattacatgattagggaacagcaggttagaagtagttaatcagaaagacaaagggcaatgtaaccgagacagtgaacatcttgagaagtacatataccaaggtcaagaacagtaaatgatagactttaagaactttcaaagggatttttaagaactcagtccaggatctcaatgattctcatatgaacaaataactctatatggtctaaagttctagaaggcatacaaagcagatgaggaagaaagcaagtcattaagtaaattcatattagacagttctcttctttatcctaagtgcaaacatatattcagtcaaaaaacaaaatcagaagagctgtattcaaatctaatctgtcacttattggcagtgcaatgaggccatgggaaaaagctcaggctgaggagcagcaggccaggtttctcttccagctctaagtcttgtaagctacttgcccctctcagcctcagtgtctctctctacaatgcagaacaacaacagtgtcacctcattatgctgatgtgcttagcacaagggcaagcaccttatgcatgctcactaaatgatttagttatcttaaccaatctgagtctgtttcctcaccactggaaactaagagttcacatgtcgaaaagcacttttaaaactaaaaaacataatacaaatgtcagagcttaaaaatgtttatttaatcatctgcttggagaatatctttccgaaagtctgctaaaggtataaagatttgtcagatttgtcagaaataaagttctactttttttccccctagaatcactgtttaggagagctgatagtttttatttaaggacaaactcctcctattcacacctctcctctactaacacagtaaaaggttttcttattgactaagagggttaaattcctggtcagttctatgccacaaagagcacaaagtgtactcacctgtacagagttttgtcatgttcactgaattgattctgagaagtgggtttgggaccaatgatgggagcacctgaaggtttagatgctacttctggaggctgtttaaaaaaaaaaaaaaaaaaaagacaaatatgcctaaggaacagataattaacagaatagatatcatgtaatggcggaggggagagccaagaagccttttaaacggtgtgcccatgcatccaaggcactaaagacatatttaccttaaaactgccagtgtcatttacatccttcttggtctctaaggatgcagatcttttgttttcaaacatcttaactctggtgagtacagactgtggcttcattgctggatcttcctcttcttcggtttgagttgggggtggaggcagtggtttggtgtttgaaggcagagcttctggcttatgctgagatgaaggtatcagcggagggacagctgcagcaccatggagaggctcaaaatgacctgctctagaggtaaatccttggggtggtacttgctcgtaactgcgtgaatattgctcaaaatactgcttggactctgcaggcttgggccctgctgaagggtggggctgggcttccggtctgagtctaccatgtgtgtcatacccaggagctggctgctcttcgtgccgcagggcggatgctctaggtgcctgttcgtaacgtggtctgctgtcgtaagacagaggggctggctcttcaaaacgtggaaagtaccctcgttctgaggactcttcgggatgctgtctggagtcaaggtcttgagagtgctgattatcaaaaggtggccgagatgggtagggctgtttgtcatcataatatgaccactgttcttcatacatggggacgcgatcttcgtatcgcagacgatgttcatagtttcgagaaaactggtccgtatagcttgaggactcgtatctgtatgtgggctgctcgaggtctctgctggcttgtttctctacgtatgggagttggggttcataggtcagattaggctctttgtctggcctgtgccctgggtgactaacggctggctgtttcaaaacatggttctgcctcatcatttcctcgggatatggatcctttctatacacctgtataaaaaattcacatttaaggacaaagtcttgtttctaattctagtctattttattagactgtgattaaatattaaactacgatttaatatgtgaaaatggtatgttttaccatttattatcaggatagacaagattagtggaaaaagctggtttaagtgaaagctcaaaatttataatgcaggtaggggcttttatgtttcagcatgtactaaataaacagtgagttaaagataaatattaaatttagtagaaaattaatgcactattgattacacttcattttgacactgaaaaatcctaaagaagatttatgggcatcataatttgtattaacataaatatgtttatgatgggtttcgattacatattaaggaattctggaagatactgaaagccaaaaataaaaataataagcacaaatctcaattaaaaggcctgttttcaaataatcagtataccaatggaagccatgcaaactacgaaactgaaatgatttgtattgatttgaaagcattacagtgtataagcctgcagtaaaaaagcaaaaggaacacttaaagggcaaagcaaaaatgatcatgtgccagattgatggacagcaacaaattagtgcaacaccgcagcacaggtacctttgttggatctacatgcgacgacaatgatggttcttgatctcttagcattatgtgagctgcctcagtacttggtgttcttaaagaatcagcttgtggtgagtaagaggtggaaggagctggggtgggctcctccagtctgacattagttaaatttacattatgattaacagcagaggttgatgatgctgggtttgtttcaggcgaaaggtaagggactggagatgaagcttctgctttctgtgaagtgtttaaaatattttaaatatagtgtttctgtttactgctaactttccacttcaatttatagtgattggtagacatacattttaagtgtgctgaataacaaaattatgacctcatgtcctaaactttttgggaaaaaaaaaaaatccagtacattgctgtgttaagacaaacacacaaaatttagaattaagcccttggtactctcaaattgaaattgaagattaattcttaatctggagaaaggacaacatatatatttttaactcaatcaccacattctaaaatttaataatgcacctctatctacaaaacgttgaatgcttgctgcttacctgttgagaggctggcttaaatccaggggagtctattctatgaattggttgtggctgcgcttgtggtgagtaaggaggatatgtttggttttcatgatgcattccagaggagtcctctcttacaggctcagaggaccgtgtaatggcagactccggtggagtcccaacctcatcattaagagtttcatctagttcttgatcagtgtaggccccgccttctgtgtctgtgtcttcatagtcagaagtgtgtctactgtccgtgctatacattgagtattcactacctggagctgacaggtaggacagacgatcatcatgcaaatcaaggtcatcacttgtagcaccatccgcctgggtcaaataaaagtaaattacaaattttattcagtagttctttaagagatggcctttatcgtacaaggcagattgaaaaggatatctttctctggagaagtcacatctacttcttgaaacttctggtaaggaaaagtcaagaagattgtacaagcacacacgcagacacatggagcaccccttgagatctgaagggcatggatgaaggaaacagtggccggtaagccaggacaaagttagactccagggcccagccctggaagacaacgaagaaactctgacactgctcagatttataaaacctactcactagctcttcagcccttttaagcaaggggaagagggagaatgttaccaaactaagctcacagaaacaaggacacactgacagaatagcacatggaagaatacctatgaaataaacccaacagttcaaaagttgaataagagctaatatatttatgtttaggaaacaactgatatggtttggatttgtgttcccacccaaatctcatgttgaattgtaatccccagtgttgggggaggggcctggtgggaggtgactggatcatgggggtggtttctaatggtttagcaccatctccctcacacagtcttgtgatagaattctcccaagatctgtttttttaagtgtgcagcacctccccaactctcttcctcctgctccagccatataagacatgcttccttccccttccgccacgattgtaagttgcctgaggcctccccagaagcagaagcctgtacagcctgcagaactgtgagccaatgaaaccttttctttataaattacccagtctcaggtggttctttatcacagtgtgagaatggactaatacagtaaattggtaccagagaagtagggcattgccaaaaagatacctgaaaatgtggaagcagctttggaactgggtaatgggcagaggttggaacagtttggagggctcaagagaagacagaaaaatgagggaaagtttggaatttcctagagacctgttgaatggttttgaccaaaatgctaatagtgatatggacaataaagtccaggctgtggaggtctcagacagagatgaagaacttactgggaactggagtaaaggtcattcattcttgctatgctttagcaaagacactggtggcactgtgcccctgctctagtgatctgtggaactttgaacttgagagagatgatttagggtatctggtggaagaaatttctgaatagcaaagcattcaagatgcgacctggctgcttctaacagcatgtgttcatatgtgtgcacaaacagattatctgaaactggaacttatatttaaaagtgaagcagagcataaaagtttggaaaatttgcagcctggctatgcagtaaaaaataaaaacccattttctggggaggaattcaagctggctgcagaaatttgttaagtaacgagggacagaatattaacagacaaaacaatgggggaaaatgtctccagggcattttggaggcctatgcggcagcccctcccatcacaagcctggaggcctaggagggaaaaaatggttttgtgggtgatccaggcccggccctgctgctctgtgcagcctcaggacatggtgccctgcatcatggctgttctagctccagacatggccaaaatgggccaagttacagctcaggctgttgcttcagagggtgcaagccctaagccttggcagcttccacatgatgctaagtctgcgggtgcacagagggagacagttgaggcttgggagcctctgcctagatttcagaggatgtatggaaatgcctggatgtccaggcagaagtctgctgcaggagcggagccctcatggagcacctccagggcagtgtggaggggaaatgtggggttggagccccccaccagacagtccccactggggcactgcctagtggagctgtgagaagaggcccattgtcctccagaccttagagaggtaggtccaccaacagcatgcaccatgcacctggaaaagccacaggcacacaatgccagtccatgaaaggagctgcaggggctgtgccctgcgtggctacaggggcagagctgtccaaggccttggtagctcaccccttgcatcattgtagcctgggtgtgagcagtggagtcaacggagattattttggagctttaagatttaatgactaatctacttacttttggaatttcatggggattggagctcctttgttttggcagacttctccattttgaaaagggagtatttacccaatgtttatgtcccctttgtatcttggaagtaactaacttgtttttgattttacaggctcctagacagaagagactagccttgtctcagatgagactttgaacttctgagttaatgctgaaatgagttaagactttggggcactgttgggaacgcaccatcatattttgcaatgtgagaaggacatgaaatttgggagggaccaggaacagaatgatatggtttggatttgtgtccccacccacatctcatgttgaattataatcctcagtgttggagtggggcctggtaggaggtgatcacgagggcggtttctaatggtttagcaccatccccctaatactattttgtgataagagttctcccaagctctgtctgtttaaaagtgtgtagtactccccccttctctctcttcctcctgctccaaccatgtaagacatgctttttccccttcactgtcttaagtttcctgaggcctccccagaagcaggagcctgtacagcccacagaactgtgagccaattaaatctcttttctttataagttacccggtctcaggtagttctttacagcagttcaagagcagactaaaacaacctgttaaacatttggcccttaaagctgttatgaaacacaatggaaaatcatcacctacatggtggttgctacattaagaagaaattatttattatttttcatagaaacagtatccaacagatggagaggaagaaatacagtaatgcttttcttttgttaagtaattaagaactcagtttctaatagtttatgttgattatcttctgagtagatcagaaagaaagtgagaagtatttgagggaaaggaagctacagagttgcaatcaacaggttatcactggacactaacgtgacactagtacctggatgaaaaagaacactccctgaagaccctgcctagacaccgtgctcagttactcatgagagctgaaggatctggaatccaggaatcagaaagtatttcttccacttcagtatggaatgaaggacaaacatgaaactcttgtcctccagaaagatgcactgctattaactagcaggtttggtgtggctctgcaggtctgctgtgccagaagcatggtcttgggagtcaagttgcctgaatggagctttccacgcagtccccatgcttggctcgttaagactctgaccttgagcactgccttcctgataagaaagactagggtgtgtcaggtctccccatgctccagttttcaagagagcatctgccaggctgggctggggagagtgggaatccagggatctatcctgttagagcacaatccctctgaacaagtctcaatggcttctcaactcggtaacagctgttgcagaagaaaagtcttcttgctatctactctaatctttaacttgccagggttctgaatactataatccagtagccagtcaaggaaatattgaaagtctgggcaagaataacttagaactaatcaatccacttaagtttttaaagctggtttgaaatgcagatgtaagcaagaacgatgggttgctttgaactaggaaatatgttaagaaagcctcaggatgacttttcctggtttagcagggaatatgtaagactgtgtcagatcttgtaaaaaggaactctttctagcaattaggtcaaagtagttggttcaggaaagtcaatgtgaaatgaagtagttttagtttaagaatctattctatgaaatatacttgaagagaagaggacaggaagataagctgtaagttgtaacaaccttttctggcttacaaaatgcatcagtctagcctgataataaataacctatttttcctcacataaaaagctagaaagttggacctttattttaaaaccaagcaaagaaagcacacaagactatcactaaaatactttatagaaaattaagatttgtggattttaaaaaagcctctcagatactacaaatgtatactttgtgcattttgggaaaacatttatagactactttcattttaagaattcactagtgaaagctattaacattggacctgccaaaggatgttaacagaattgtgttgctatagaaggttagtatgaagactacaatcctttcaagtgctgcaaaagtagaaattagtaatagtgtgttcatgtaaagtggtgtggtttgtttccaccttcattttcctatccagttccagctgacatgttattcagagtggtcttaggctctcgtatgcatggtccatcccccagactggttcataatgagaaaaaccatagttctgacacattactataggtgagaacaatagacactgcctctcagtgttaacagctctccttgcagaggctgtgtatgtctgggtagaggacatggggggtcctaagcatgcagcatgcactgtcagagcatctgtagccacagccaggcagaggaaggtagggaccatgcgggggcaaaacacaacaaaaaccaaaccaacaaggaagtacaaagaacaaaataaaaaccagagatactctcaatcttccctaataaccaaaacttactgcactgatctgaaaaaggtaaaagacatttaaaaaaaaaaagcttccctcaatggtgtattctgaggaaatgattaactctccagacaaaataaacagaccttcccatcaaagattgctataaaaccagaaagactgacaatagaaagtagttattttaaagctggccatttggacgtatagaaaaccaaaattcaaagccaggaaggatctattgctttgttcaatatctcccagtatgttgtgagaatgttaacaggtgttgagtgaaaaataaatgcaaggaaatgcatgaagtcggctttttaacttttaagatgtctcagagcctttaaatgccagtgggtacgaggatactcgtgaggggtctagggtttatttcccatccgctgcttgccttcatagtgccttctctcttagagcaagtcctgaattgagcatgctgaggacagcactttgggagatgctcatctaggccatccaaatcccctcattttcagaggaggaaactgaagccaggctcaaagtcatcattcatagccagacaggggcagcatcagaactcaacctgctcttcattataatttaagattctttaggagacaatcctactgcagtggtaattcaacaggtgagaaaatttaagaattctcttaccatcagaaacaactttcataacccctacacacaaattataaaaacctaaaagctaactttccccaaatttctccaatatgttgatctaattagaaagcactggtatctcaaaagcatctctgattagttacataatttactgaacaagtcaaaaaagtaataggaaatgtcttacctttccctcggaaacccataccagctggttttgctgttgttgaattgcttctttcagcgcaccataccaaccatcattcattgaatttaagttaattgtagctgaaaataaattaacgatgtagttttatggttagagcactgccaaaagtcagaattaattcaaccctgcttacagctaaatcgtcattactgaaagatggtatctgaggatgcaaacatttgaaatttctattttgctactgtatattttcttttaaccaaacagcaggtgttaacacaacaggaagctttccaagaaagtatcatgtaagttttagtatttgaacaccgtaacattttggcctacttaatgttgcccagacattgtaagctgaaagaaggcctttattaacatactcacttgtaaaaagatggtgattatttttacgaagtttatgagatcgctcgtataacttcctggcacttttccgagattctggacataacctcattctcattgtttttactccttgcttagaatcagggttaagaaatacaacaattggataccactgggcatagttaagacgatcaactgcatttggtgttacatctaataaagcatgtttgtcctagaaacagaaagaaaaatatatacaaagacacaagacatcattaattaagaatcaccaaattcagctgggtgcagtggctcacgctacgcctataatcctagcactttgggaggtcgaggtgggtgaatcacttgaggccaggagttccagaccagcctggccagtatggagaaactctatctctactaaaaatacaaaaactagccaggcatggtggtgcacgcctgtaatcccagctacttgggtggctgaggcacaagaatcacttgaacctgagaggtagaggctacagtgagccgagatcacgccactgcagtcccacctgggcaacacagcaagaccctacctcaaaaacaaaaacaaatacaaaccaaaacaaaacaaaacaccccatcacattcagaaaaagtcaaaagtctgtactatatttcagtggtaacagatctctttgtattctaatgtctcaggagcacatattaaaaaactaattgtaagttaactcaattccatttctagccaaatttctaaaaacctttctatgaagctcacttttaagacttagccctaacaccgcaatctgacagtattatccacgtacagttagaataaaaatgtttaagaatttaatgttcctgacattccttatgaatgtaaataacaaactacaacttgaattgtactgatataatatataagcagtctgttaattacatctaaaaatcatacacttgttttgtggtaatgaaaaatcatcttctgatgcctacagtaactattctcttgaaagtaatcattataatgcttttcagtaagggcttaattttcttatagtatgtcagtaatagtctcagaaaaactaccttctactttcaaattaaccaaatcccatcccactcaaaaccacaataacataatgaaatgggtcaagttttaataacttacttgatctatgatttgctttattgtatgcaggcgaataatgccagagctacgttggtcagttccagcgtctcgtggttcactctctattcattatgtcaggacaaaaataagacatcaaattttcactggttagacaggagtttctcaactactggccacaactgatatgccggactggatagtactttgtttgtggaaactgtcttatgcatgcagtacttaaagtgagttttaatatgcatacttccctttttttttttcactattttttcaactactttaatattctggaaaaaaacttagccattaaagaagaaaaaatatacaggaatgcacatttttttcttttgcctggggctctaatatggctcaacagggcactacttcccaccctttttcacactgtaacatccagagaaaatattatttgtatggcacactgagataaactgagggggctgctcctttgccaagctctaaccagccactactggcttaagaggtcaataccttggcatgtccatcaaccatcggtaatggtgctatagtggattgcctagggagttctgggttagagaccttagttacatcagtagaaggggaacctgggggcaggaagctgttcatctgtaactgtgagacagcctatggcttcatcctggcaacctgtcttcactggtgtatactgtgccaaatgcagcttgggctggtttccaaccaaccatctcagagcacagcaacgtttgtgactctggtcacaaggaaagtttgaaaggaaaggaagagctttggtgtttcagagatcagacaaaggcagagatctggaaagacaagtcacactgaggttcaagataaatgattttggagaatgagactaccataagacaaagcaccatgggcaagcagggcagaatttcaaatctagtgaacactggagaattaagaagaaagatcaactgggaattttggctggaaaaaaaatgctactaactcctcaactcaaaagactgtcattagactcaaagaagatataaaactaagctacctgaattccctgttgtggagtaaacctgattaaaccaatgtattaccctttaaggcagagctttgtaagtcatcatacttgcttttcccatatctaaaaatcctaagtttggttatgggtaagggttaccaccaacttccttcaggtgaaatgtcatctacagataacttagccaggtgcggtggcaggtgcctgtaatcccagccactaggggaggctgagacaggagaatcgcttgaacccaggaggcggaggttgcagtgagctgagattgcgtcagtgcactccaacctgggcaacacagtaagaccttgtctcaaacaaaagaaaacaaaacaaaacaaaacttcttctgaaaaaactaagaaataaacattttctaacttgctcagattttactcaaatcatttgtctgcaaatcttctgatgttcagaaaataaatatccttattcaacttcattggcaatgaaatgaaaagcaatatattaaaaaaaaaagatgatgttctgattctttaaattaacactatgcagtttaaagatgttactgagggtcggctgggtgcagtggctcacgcctgtaatcccagcactttgggaggccgaggtgggcagatcacgaggtcaggagatcgagaccatcctggctaacacggtgaaaccccgtctctactaaaaaaacaaaaaaattagccgggcgtggtggcgggtgcctgtagtcccagctactcgggaggctgaggcaggagaatggcatgaacccaggaggtgaaacttggagcctggatctgagatcgtgccactgcactccagcctgggcgacagagcgagactctgtttcaaaaaaaaaaaaaaaaggttactgagggtcatatagtgccagtgggaacaaaatccccagcacaactctctggaaagcagaaacttcatcataattatgggaacagctatattcttaaggatttaaatcctttgggaaacaaagcagggcataaacaagcaaacaaaatatggacagatttctgtatcttttgtaatagtaatataaattcgaaacaaacgatataaaaaaagcctaactgaaccaaaaattgcaggataaaatgaaaatatgccattacctatgaaaaagaaaaattggatataaacttttctaaacagtataaataaaactttgccaaaatatgcttaaaagagtggaagaaaatacaatggaataaaatttagggtggtgatatgtgtaaaaattaactttccaacttttccaaacacagaatggcacttttataattacaaaaacagtttaaaaataaaacaaaactgggtacagtggctcacacctgtaatcccagcactttgggaggccaaggccagagatcacttgagcccaggagctcaggttcagcctggacaacctagtgagaccctgtttctacaaaaataataataataataataataataaactagccaggcgtgttggcatgtgcctgtagtcctagctgcttggaaggccgaggtgtgtggactgcttgaacccatgagtttgggactacagtgagcaatgatctaaccactgcactcctgcctgggcaagagtgagactctgtctctgaaaaaaaaaaaagaggagcagtgtgaagaagaggcgagaacgacccccggaccgaccaaagcccgcgtgccgctgcatcccacgtccagcacctacgtcctgtcgccaccgccaccatgcccaagagaaaggctgaaggggatgctaagggagataaagccaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtatttctggtgactgtacagtttgaaatacttttatcaagttttataaaaatgcagaattttgttttacttttttttttttttttttaagctatgttgttcgcacacagaacacttcattgttgtttttgggggaaggggcatatgtcactaatagaatgtctccaaaactggattgatgtggagaaaacacctttcccttccagttttgagagacttcctcttggctcccaggaggagggattccttgactttgacacacatggccaccttggcacaaaagccttgtgctatggaaaaacaaatttgtttttatgtcctcttctccctttccacgtttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcgtttcacttcctgaaagtcagggttggcttgtgaaaagttgttaaacaacatgctaaatgtgaaatgtcaaccctcactctcaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaagaaagtaaataaaacaaggatctgtaagcaaaacgtatttggcatacaaagcactgcagcctcaatacttatacttactatcttattataaatgtctgcaataacaacagctgataatattagcaatgttttattaccctttttaactatttgtgtatttgtcagtttaatgactaaaagagctggaatggagcaagaaagggctgtggtcaaagccgagtcttgtcacttgttcactgagggccaccaggaagtttagactgaagaaactggaaaggatccacgcaatgaccatccaagtctcaggctactcaactgtaacatggatattatactccttacctcagagcatgactgggaggattcaatgacattgtatgttatgcaattttcatatgaagccaagagtttcctaaacggtgacttttctcattaaaagaattggtggaacaaggacatggtcactggggttttctcaccaaattaaaagaatgggataaactgctaatttttcactgacaaaaagtcttatttttattgaatgagtgaatcagaactcactcactttagaggtgtaactcccaacctcatttaagttagccttgaggctacttacttgcaatttgataaatatctggttcttctcttgccagcttttctctggcaacatcagctattggtccaaaaatggttacaggcctcagaaatccagctggagagaaattcacatgaaaaacagcatattttataccttttctttcttaaacatattgacgttaaagggtattaggttagtctgtagaaaataaactaccttctcgaagaaccactctttcataagctggaaactttgtttgaacaggctgagcggacaaatcctctctgctttttcgaagatttctcttggagctgcgaagacctctgaatctccagaagtcagcacggtctccgcctgctgtttttggaagtgtatactgtacactggctagctgctcagctctacacaagaaaggagaaaattaaaataagggcatttaaaatgcaaaatggaaaaagacccacaatgaaatgaaatatacaatactggatggaagttcacatacagtttaaatcttaatggttataataaagaggagtttgtaaacctaagtcagttatagatacgttgaatacaatgaaaaagaattctttacattaccaaaatttcccagtgggattgaaatgatctatcatcatttacttgattcactctatgagaagtatccaagcattcatacctgttcttattagggatgatgcctcgttctacctccttatgatttttaccaattcgaatagcaagccaagagcccagttttccattgtacaaggtatccacaacacggaacacctctcctttgttaaaactaagtccatagggagattccttttcatattcaaaatgggttctaatatagaaagaatctcctacatctgattctacaatgcgacgataaactaaaaggaataaaaacaaacacattatcaatatttagtgggataacaatctgaaagacagtacattatgtaaagatgctatgataatatcaataataatatccaacaaattcttactatgtgccaggtactgtattatttcatgtattcatcactgtaagaattgaaactcttagtacttccattttgcagatgaggaaactgatgcagaaaatacatcaagtaacttgtcaaaagccacatgcttgttttctattatatcatctaacttatctgcaaacattatagacatttccatatctaaatcagcagttctcaaataaaggtaattttatccctcgccatccaacattggacatttgccaatatgcagttttgactgccccatctgtgtactgaaagggtaaggggtgtgtgctagtggcatctcatctagtgagcagaggctaggaatgcccctaaacatccacaatacacaggacagcccctaaaaccacattatttggtccaaaatgtcaacagtgccaaggctgagaaacctggctctaagtgaaaattgtatcacagaaaaaatggagttttctcttgaattaatgctaataaacatctgagtgtattgcttagaaacatcagtacaaaatctgaaagctgctcatatatacttttgtatggttctgatggctaataaatcaacactttctatcacttgtaaagggttggatggcattttatttaaattagaatactataaaggttagtcctattagcatgctctgctaatgagaatcatctgaaattctgtgctcctaaatgacttagaattacataactttctttgagattaacaaattcattcatcactcaactatgagtgacttattttttaaaaatggaataaatccctttgtaagtcctcaaactctacaggtttatctcctccattttctgacagcatctcaccatccttcttcttctgagccaatatggtcacttcttctcctttagggaggtcaagcaggaaaaggacggcttcttctcttatgatatttgtaaaatctacgttgtttacctaataaataagatttcataaatcattcttggctgtttaagaatatgaaaataacatacgcaggacacagatactctcagtctacctaatttgaaaatatcacatctttttttttttttgagacagagtctcgctctgtcgcccaggctggagtgcaatggcacgatctcagctcactgcaacctccacctcccaggttcaagtgattctcctgcctcagcctcccgagtagctgggattgcaggtgcccaccaccacacccagctaatttttttatatttttagtagagatggggtttcaccatgttgggcaggttggtctcaaactcctgacctcaggtgatccgcccgctttggtctcctaaagtgctgggactacaggcatgagtcaccacacccggccgaaaatatcacatcttttaagaccaaaaactttattttactttggagaaaagaatacactctaattttaaaaaaacagaaacaaataaagtgagttaaaggtataaatttatttaaatagtattcagtgtgtcctgacattaaagatctgtgtaaaatttaaccagtttagatgaaaaaaggtaactttttacaagttgctgagaaaaaaaatcaaaagaaaatgggactaaaaagacaatctgcactgtagcaaccctgtaagagcatctgtgtaatgcaggctcagtgtttgccaagttaatatttacttctattagaagcttctaaatgccaaaatgaacttattaaaatgtcaccagtgactgtgtgcaggattacaggcaggttttcttctttccaccttttggaaattttccagattaaaaaagaaaaaaaaaaaccctagaaacaaaaaaacctgacacgcaccacttacttttatgatacaaaacaaaagtgaactattaagaaacattttttagccaggcgcagtgactcatgtctgtaatcccagcactctgggaggccaaagtaggtggactgcttgaacccaggaatttgagaccagtctgggccacgtggtgaaaccctgcctctacaaaaaatacaaaaatttgccacgtgtggtggctaatgcctgtggtcccagctactcaggaggctgaggggaagaatgtttgagcctaggtgtttaaggctgcagtgagccgtgatcacaccactgcattccagcctgggtgacagtgaggcgctgtctcaaggaaaaaaaaaaaaaaaaaagaaagaaacgtttaaaaaaatgtatgccctgattacttcaaaacagggttaagagatgggtaagaaaataggtctctttactttccttggtatagtgaacgttattatacatgttgtatttaaatgtttttgacctaacttgattgacaacaatgtaaacatcatcagaaagaatgaccatatcagatcagatggaaataggtctgaagtcaccatgatgccttgactttttgacatgctaagtttgaagggaaaaggaggaggattcaatgagaaaatgacagagctcaggaaattgctaagtgaaaagactttgattacgagctgctcacttgagcaaccaaacccaagaaagaggcagtgtagcaagagaagcagagagttaccaacattctccaagttttaaaagtatcagtaaagaggcaggaaaagaataaaaaaatgtaccagaatggcagtattatggaatctaaggaaaaaagtacttcaaaaaagattaagacagtcaaaacgctgctaaaaaataaaggaaaatgaggcttgaggatgacattaactcagcaatggcttattgaaaactgagcttcagtgtggtgaaggtggaagccaggctgcaaaactgtatgaccacaatgattgaaaagaaaacaggcaagggcctcaaccacatccttcaacaagttaaacagcaaaaaaggacaaataagacagtggaagatagatgaagaaccagtggagagagaaagacaagaaagtgaacaaagctacaagattctggagcagacaggaggctgaatccaggacactggcaagaggcaggctgagtacagaaagagaccagaatagagaggccacggcaaagactttgtggtagagaagcagaataaatgtaggagctcacaatggacagataccttctgattaaaatgggacatagtttaatctagcaaatcaaatggaggtttggatattttaaaaagaaacaggagacagattaagatggtactatgtcactaggtgaaaccgtttatggggaaggaagggaggactctatagactctactgatactctgcatctaacctgggctttcctgatttgtgtaactaatcctgtctcttgtggagtatgaagtttcaaagccaggcagcttacacatttgcctttgatgtgaattccatctccctgtgtctgagccattatctggggttaaaaaggtcccagaggttgtgtggattgcttcaagatgactcatatgggagaggaacacttgatgttgcttgctgccaagttgtggcccatggcagagtcctgccagtctgaatgtttagttgaacttccaaagactacctggtagatattatcatcgggatataagacttattttcttttatttccatgaacacgagtggtagaaatgaaatgttacattctttactaacacaaaatatagcagtaaacaagagcaagatacaagaatgggaagtgagaagtccagcataaggtagacctgatggattttgactttcaaagtttaactggctcaatggagactgcttacagattacaatctaattacaatagtaagcttgttgtttgatacctttttctggtgatccaaatactttttaacccacataagttgcaatactgacataccctgagaatttgatcaccttcctctaagccttccttggctgcagggctatcttctagaacgccagctacaaatattccaacatcatttccaccagccagccgcaaacccacactatctccttttctgaattttaccaatttcatgctgggcctgttaaaacagatatttcatttgaaacagttaagaagagcttaaaacgttatagcaatcactacagtgaaaactatattcagaattaaataaagaaccatcatttctaaaacttctctcataccactattttactaaataaaatttagtgttagaattcaaatcagacttaataacactattttctgattaacagttttggaatattcaaatttaatatgcaagtactattttacataactaatttataaaattactttgtaaaacaatgttttctcaactctcaaagagttatggtacattccaaatggctaaaaacatcttccattttttccaccccaattcacacatcatttctattaataactgaaaagtcaaattttttaaaataaaggtagaaattgaagtataaattggctaattttcctaacacgatggactcaaaataaggctccaagcattgtgatttctacatgtaacagagagtgatttttaaaaaaactttgcagttggtggagtctttcagtagttcacagagtagttcacttactctgctgcccctctgagttttacaatacaaatcatatagtcattcagcctttctacattagccccatatccattctgtccctttctagttctctgaatggaaaaaaaaaataatgcatacacacccacctctagcatcagtgtagtgttgaaaccttgtgacattccttaaaacaaatactaaaggatgccttctaagaactgactggatagaaacagactgtaattaaaaattacccactatatttcccttctagggattcataagtactctcacattcctagcaagaaaatacactattttacctattctgacaagaagtgtagaaaaaaatccctatactctttattatgtaatactaaccaaattattagaaactaatagataacaataacaacaacaacaacaaaaagtcaaataaatgaatgaaatgtgttgaggaaggagagatttctagtctctttaagccaactaaagagatcgccttaactttcagaacttactatttattcatttctgattgggttacctgacctggaactaacatcagctagtcataaaagtaagagcctgagaaatcagatgaggtctctcactggctggtggcatccttgatccctccatgaaactatttaccagctttactacaaatggtccaagccccttggttgtagtggtatcctagccaggtcaaaagcattctcatagattcctctcctaaacccattgtactgaaacctctttaaatatttcctcaaagtccttaagactccaggtctcagttgggtgtggcagctcaagcctataatgccagcactttgggagactgaggcaggaggactgcttgagcctaggagtttgttcccagccctgatcaacacagcaagaccctgtcactactaaaaaaaaaaaaaaaaaaaaaaaaaaaattagctgggtttcgtggctcgttgcctatagtcctagctactccgaaggctgaggtgggaggattcctcgagcctaggagtttgaggttatggtgagcaatgatcacaccattatactctagcctgggtgacagagtgaggccctgtctctttaaaacaaagcaaaacaaaaacaaaaacaaaagataggactttggaaatcctcttctaaccctgacccatctaatgtgcttcaaaaagcaaaaacaactgagcacagtatccaccctttagtaaaacatggcttctgaaaaccactgttagaagacagctttaggccatatctcaccaacagtgtcatgtgccttagatgactgacattttatactttgtcctgcctgcattatattaactacttgcagtagcaaaacagactcactaacttctgcatcaaatccattcattggctttaaatgaaaaaccaaacctttcctggcacagctactaatcctgtccacgtcctcaaatcttccttggtatttgttctcccagggaaggaggtctctggaatttttcttttttcttttttgagatggagttttgctctgtcacccaggctggagtgcagtggcgcgatctcggctcactgcaagctccacctcctgggttcatgccattctcctgcctcagcctcccgagtagctgggactacaggcgcccgccaccacgcccggctaatttttttgtatttttagtagagacggggtttcgccgtgttcagccaggatggtctcaatctcctgacctggtgatctgcccacctcggactcccaaagtgctgggattacaggcatgagccactgcgcccggccagtctctggaatcttatcattacagtttcctaaacctcaaacacttacacaagttttcaagcaattcccaagaaaggaaaagaaggggactatctatgcctgcacaatttataaaaggttgaattatcaattacctaatattaaaattgtacagttttaaacttgtaaaaaccccatctctttcaggaactacttctatctacctagctgggtctaaatctaacccacttgaggaaatctgccaattttctttttttttttgagacggagtctcgctctgtcacccaggctagagtgcagtggtgtgacctcggctcactgcaagctccgcctcctgggttcacgccattctcctgcctcaacctcccgagtagctgggactataggcgcccagctaattttttgtatttttagtagagatgggttttcaccatgttagccaggatggtcttgatctcctgacctcgtgattcgcccgcctcggcctcccaaagtgctaggtttacaggcataagccactgcgcccggcccggaattctgtcaattttcaattattcacatcatgtcccctttaccagtgccaataaaaaactaatttgggctgggtacagtggctcacatctgtaatcctagcactttgggaggctgaggttggtggactgcttgagcccaggacttttagaccagcctgggcaatgcggcgaaacaaaaccccgtctctactaaaaatacaaaaattagctaggtgtggtggtgtgtgtcctttcatcccagctactcaggaggctgaggtgggaggattgtttgagcccaagaggcagaggttgcagttagccgagattgcaccacggcactccagcctgggcgacagagcaagaccctgtttaaaaaaaaaaactaaccaaacaaacaaaaaactaatttgataatcatgatggtttgaaatttgtttacaaatttacatctcaattctaccaagtatataatgtaaagtaatgaaaggtgttaagatagtaaaaacttacttttgggttgctaactaccctagaacaggttctcaaccaatctcaaccatgattttgcccccaaggaaacatctggcaatgtctagagataattctaattgtcacaactaggggactgctactggcatctagtggccaggattgctgctaaacatgccacaatgcacaggacagcccctcacaacaaatgcttacctggcccaaaatgccactagtgctgagattgagaaacactgatttttttttttttttaatgctccattggaaagctgtggaaattctgatgtctgaatagaatttttttttttttctaattcctaatttaaaagctaggcaggagacagcggtgagaaagaaagcatccaaaaagttcctttgttgtctaatttctaactcactatcatatataagtagcagaatgttaaatataaaaataatcatagtattaggtggtatgtactattttaaaaaatatatgcaatatggtttacaattaaattcctactctgaataatgttaataatgaacaaagaaaacaatacaactttaaaattgtattaccgaagaatcccatcttcatgagttgaattaggtaggacaccatcagatggactgacaggtaaatccacatctggttgcccaacttgggcatacacaggctttggttctaagaaaaaaaaaattgagtaggactcactttagaaaaacatggaataataatgcaagcaaccaagcaatatatgattcataagttcagagaacctgatgaggaacatatctaccatatgtattagagtacattttatagtaataaattctgaagtctttataacaagtaggtatgttacacagtcacctgtgttttccatagttccagcaatcagaatttgaaaaatctattctttaagaacgaataacaaaaaatagatatgagaagagagaattcctacacttcccagttaagactgccaaagtagctacctttcctcattatgataaaatgtttttaaataaccatatttctgccactcagcaagcagagcaagaaagatgatttgagaaaaggaagtgaaagacatcagaaacaaaatctccaggcctcccaggcaaccgatcttagcaccttgctgattctgttttgtcttcacagacagctttaaaaggatgcttgggtcagacacagtggcttgcacctgtaatcccaacacactaggaagctgaggtgggaggactgtttgaggccaggagttggagaccaacctggacaacaaagcaagattccatctctccaaaacaacaacaaaaaacaaagaaaacccacaaaaaaaccccagaaaacccaaaatagccaggtgcggtggtgcacacctgtaatagggaggatcaggtggaaagacagctggagcccaggagttttgaggttacagcgagctaatcacaccactgcactccagctgggtgacagagtgagactctgtctcaaaaaaaaaaacccaaagacaataaataaaggtatactccataaaatgtttatgaaaacactttcaaaaaagcaaaataacttttctttttaaatttttgaagccaatctcatgtttctctttaaggagcagtgttggaaaacaactttactaattgcaagaagttgttaatgataaatattttctatctagaaagtaaaggaaaacattcatgaaaggcaactgatttgtgccaacctgctacccataaggaaaacgctggaagtcatatgcagacaaattcacacatgagaagaataataattgcatctttaaaatcttctgtaaatcctaacaattacttcactctacttgcaaatgtttcttgaacttagtgtttcgttatgcttacctggaagagaaggtgtttgtttctcatttctttcaactgtaacttcttccactgttttaggtgtgtgatcatcagcatgctttacaggagttgagacagccccaggtttagaaattctctcttcatctctactccggagactgtgtgtcattaaaataaaaaatcaagagcataagaatgattctggaaagcatctgtaagagaacagtataagaagaggcaatgcaacttcaaaaacaatgacaacctgctctaacagataccaaaatattgtaaaaacctagtaattaaaaatagagcattaccacagaaaaaccaaatagattcatgtaataaaatcgaaaatgaagaaatatatctataatagcaaaatttatcatgaaagtagcattccaaacaaaactgttggagaaggaacataacatttaataaatggtgtcgggacaactgtccacaaatgtagaaaaattagatccgtatgtttaacaatgacaaaaataaactgatttcagatgaaatcaagtcctaaaaaaagagtttaaacattcacataatcaacaggagtcttctaaagtaagactcaatgaagccacagtatatcaacaaaagtgattacataaaaataaagtacgtgcaaataattgggaaacatatataatactgggctgaactaaatgaaatgggaattctttagttcaaacagctcgatgttaactatttcatacagtttaactaaatacaaatgttgactatgtactgacctaagtaacatatataagaatttggtacttaaaaaaagaaaagacaggcatgatggctcacgtctgtaattccagcactttgggaggccaaggcaagaggactgcttgagcccaggagtttgagaccagctgggcaacatagcaaattccatactctgtaaaaaaaatttaaaatttagccaggcactgtcacttgttcctacagtcctagctatttaagtggctgaggtgggagaattgcttgagccgaggagttggaggctgaagtgagctatgatagagccactacactccagcctaggcaacagaacaagactccgtctctttgaaaaagaaaaaaagaactataaatcaatcaagacaactcaagagagaaatgcaaaaatacaaagaagcttttcagcaaaaaggatgtacaaatacgtaataaatatgcaaacacatttaacctcactaggaactagggaaatacaaattaattagaaactgtattatcggccgggcacagtagctcatgcctgtattcccagcattttgggaggcagaggcaggcggatcacgaggtcaagaaatcaagaccatcctggccagtaaggtgaaaccctgtctctactaaaaatacaaaaattagcccggcgtggtggcatgcgcctatagtcccagctactcgtgaggctgaggcaggagaatcaattgaacccaggaggcagaggttgcagtgagccaagatcgtgccactgcactccagcttggtgacagagcaagactctgtctcaaaaaaaagaaatcatattatcatccatgagaactttcacatgataacatcactggtagggaaagatatggagaaacagacatattcacaaaatgatggtaaaagtgtatgactatttgaaggcaaaatggaaattatcaaaacaaaaaatgtaactaggtcatacactataattccacttctatatttattctagagaaatacaaatgtactcaagaaaacatttataagaacattcattctagtatcagttttagtggcaagaaacaaaataaaactaaatgttcattaataatttccccagataaacagaaatcataaagtgtaccaagacaatatatattttaaaagaagccaataaatatatcttgaataaaaagataaatcaagatctataattttacaaagtatcacgtatatatggttttacagctgcattctcccaacctcggaaaaacaaaataatttgtttaattatcctggaccacagaaaaatataaaaagctctctaattcacttaaaaaaaaactttatttccaaacatatacagccatacagagaacagtatcataaaaccccatgtactcatcgtcgacaattatcaatactctagtcatcagcattccaatctgaggctaccagaacctttaacatccaaatcttgatgacaagagtacaaagagagaaaataatatatttttcattatgaatggaggaaaaaattctaaataaataaaatactagctaggagaatacagtagtgtattagaagactatcatcagggttatttcaagggtgcaagattagttcgacattaggaatttactgacacaattcattattatgcacaaatatttacagaaaaaagtgttaatatcaaactggcatgagaaaatttgcagtcattcctaaacaaaaactgaaataagcaatataattatgaaagaaactattttctaaaaccaagagcaaacatcctatcaaatagtgaaatgctgaatgtatttacactatttacaccaaactcagtaacaggacagtgatacctgtgaacactactgttattcactctgattttgaagacccaggtagtataatcacgagctaatggtcccaaaatattgaaaaaaaaaaaaaaacttaatgaatattaaagactactgaaaaatttcctgaattaagataattttaattacataaaaaaatcttttgtcaatatcgtcaacaatcagatggaaatgaaagggaaaaaataacaccagtaacaagaacattaaacattctaaaactttagactgggggaagcctttgcaagtaggatagaaattcggaagccataaaggcaagataaaaatatctgacaagattaaaaacttttacttgcacaggaaaagatattataaagacttacatttgaaacacagctatatcagtaatctggtactagccattaaaaattttgaacaacacaaacacactctttaaggactttagaaataaaatgcaccagcacagtacatgaaatcaggtacgaaggtgcttactgccatgttttcgcaggcaaatacctagaaacaagatgtccataatacggaaagtttcttatcaaaagaataaactggatgttcaccttgtattgttcaactgaaataatttagctgagtaataattcaaatcctgatctcttaattattaaaagaaaaacccaaaccctatatatgataccaaatgtcagtacgagtctggagaatggcttaattcaagaagagtgagaactgggggtgaactgggggtgaagtggagttggtggatttgatctatttcacttgttctaataagcatgcattgtttgtaaaagactattaaaattaggtgtaatgaaatagaatgatatgtacagacatgaaaactttaaaacggctgggcgcagtggctcacgcctgtaatcccagcactttgggaggctgaggcgggcggatcacaaggtcagaagatcgagaccatcctggctacgggtgaaaccctgtctctactaaaaatacaaaaaaaattggctgggcgtggtggcgggagcctgcagtcccagctactctggaggctgaggcaggagaatggcgtgaacccgggaggcggagcttgcagtgagcccagatggagccactgcactccagcctggacgacagagtgagactccgtctcaaaaaaaaaaaaagaaagaaaataacttcaaaacaaaatgccaaataagacacacagattacagaatacatatagcaggataccatatagctatttaaaaacttttctctaaaatataaacagacatgtttgcacatgcccatgtacagacaagcaacagataccaaataagcaacagtggttcaccttggagggaaaaatagccaaaatagtagccaagaggaattttacagttatctctactatttcaacttttacaaaaatttacttattataataaagattgaaaaaatatatttaaaattatttttaaagactaactttaaacataaaatttggttttattaacgtatattattagtagtctcttttcaggaaaaggtttctttctatgttgtcttcctgaaggaataaaaaataagtactttgcatagtttctatttttgtattcttttaaccattctgtggaggtgtattctacttttaagttggtatattcttaatgagctgcactgaagtagaacaatcttttaggaaaaaaaaaaaagccaagatattttctagctcaaacaaggatgagctacttttaaattggaaaagattggccggttaaatatgcaaatgatgtttaacatgaaacatcactcctgtaatcccagcactttgggaggccgaggtcggtggatcacctgaggtcaggagttcgagatcagcctgaccaacatggtgaaaacccctctctactaaaaaaacaaaaattagttgggtgtggtggcacgcacctgtaatcccagatacttcggaggttgaggcacaagaatcgcttaaacctgggaggcagaggttgcagtgagccgatattgcgccactgcactccagcctgggcaagacagcgagactttgtctcaataaataaataaataaatacaataaattgtaaaagatcaaaatttttagccattacttgtgtaataaaatatcacaattagctaagtataaatcaacaaaattaagctctatccccaaattgtgctgtgctcctcagattaaaagggaagtgcaaaatagtaaattatcctgcattgtttgcattaaaaaatatgattaatatattataaatacaaaattatttttaaaaagagaaaagtgaaaaaataagttaaaatgagtatttttaaagagaatgagttacccacaaaattttaatagttctacagatttctattgctctgtacaaagcagaatttgtttagaaaaggtaagaattccaattaattttcttctttcttgtaactgatcaaaacttctaaaaattaaaatgtgattaacagacattaccatcttggtattttaacttacaatattttaactcaaatgctctcctcaatgataaacgataggtcgtcattggctatacatgtagggctcttgctccatatatcacacaaaacttctgggagtatttttatctttggccaatttgcataccccattgctaattacctttttgtcctgtgatacaatcattataacattaaatgcaattagccttccaaaacaacatttcacataaatgggactcacaccattctattcaatttttcatacaattaatatttgaaatattagcttttgttagtgcatttccattatctaccaaaagatggaggcatttttcaataatacataaagatctagaacagtactgtttaagagaattataaaatgagctgcttacgtaattaaaaattttctagaatccatgttaaataaaataaggcgaaatcaatttataaattttattactcaatgtatctaaagtagtatttcatcatctaagttattaatgaggtattttacattttttgcatactgtgttttcaaaatccaatgtgcatttcacactaacaatacacctcgatttggactggccacatttcaaatgttgaacagtgacatgtggctactggctatggtgttggactatgcagatctagagttacagcacaaaataaaataatcaacttttccaaacattaaaatgttctttcacaagcaaatgtgactatgaagtcaagataaaatctgaatttacacatgaaattagtcaacaatcagtggcaattattgaaagaaattgtgaggttgtgataatgaatcacatttttcccaaaccttcctaattcttttttttttttttttttttttttttttgagtcagggtctcaatgttgccctggctggagtgcagtggcacaatcatacttcactgcagcctcaacctcccaggctcaagcaatcctcccacctcagcctgcaagagtagctggactacagatgcgtgccaccataccctgctaactttttctacttgttgtagagatggggtttcgctatgttgcccaggcgagtctcgaacttctgggttcaagttatcctcctacttcggcttccaaaagtgctggattacaggtgcaagccaccatgcccagcccttcctcacataattctatcctaatggctctccatatttaagcttaaaaatgtgtgtgtgtgtgtgtgtgtgtgtgtgtgtgcgcgtgtgtgcgcgcgcgcgtttgctattatgaggaaagctttctataaaaattatgtgttcggagtcaggttcatgtttacgtattccagctcctggtagcctagaaggaaactttgggcattttaaggtacctcaagatcctcttatgggcacttttgcttttccccagaagggtaagacgagtttctgttgtttttttttttttgtattaacttgcacgtattaatctaaaggtaatgaccttgttatctggaggctatgagctagttgaaagctctagacaagacagctgacaaagatggactggaaaggagtctctgagagagattttataggtcacatgaacggactcactgttaagcagagcctactttaggtcttacccaatcaaatgtgtgaccagtgtagccgattaatacacactcaattagattagcaaggagtaacatgctgtttcaagtaaaaaactttggttgtgaaattgcagctgtttggagccatttagtagaggcagagggcatgcagcatggtcagtacagggtcctggggagacgctgtaggagagaaggtgcatcccctcagcatgctcctgcagtgcccagcatcctaaagtactcggtggccagcagcctgctccagagactctctcaaacggttctgttgtgtgaagtctcccatgagatacctccccagcacatgggagtacaaataccatgcaagttcgtctggtgacataccacagcaaattctcggccactcagtgagcaccgttgttccctttccaagaaggccagatctcagccctgaggatgagtgagtgggagcctcttcctttggcactctatctcagcaccaaggagagtagctgctccttctatctgtggttcttttgtgctttgtttttgagacggagtcacgctctgtcacccaggctggagtgcagtgacgcaatctcggctcactgcaacctccgcctcctgggttcaagttattctcctgtctcagcctcctgagtagctgggattacaggagcatgccactgtgtccggctaatttttttttttttttgagactgagtctcggtctgtcacccaggctggaagtgcagtggtgcgatcctggctcactgcaagctccgcctcccgggttcacgccattctcctgcctcagtctcccgagcagctggactacaggcacgtgccaccacgcccagctaattttttgtatttttagtagagacagggtttcaccgtgttagccaggatggtcttgatctgccctcatgatcagcccgcctcagcctcccaaagtgctgggattacaggcgtgagccaccacgcccggcctaattttttgtattttagtagagacagggtttcaccgtgttgcccaggctggtcttgaactcctgagttcaggcaatctgctcgcctcggcctcccaaagtgctgagattacaggtgtgagccactgcgcccagccctatccgtggttcttaatcttcagagctctctttagttcttaccagtcaatccctcattactcctgttatgtttaatttctttacattcaactttctctgttcatggaaactgtgctttctgtctcctgattgataagatatgcctggtcgccatttcatagccctttccctcttacttctagctctatgaacacctttccaatcaacttgatgtgccttattttaaaaataaccttaatacaggaaataaatgaagcgctgaacattcactctagtagaatatccttttataaagccaactccccattacaaattaaagacttatactacaaaaacggatttatacatacttttcacaagttcattaattgcataaggtaggcaagaacaccacagtttaggttgaaaacaaaagctagctactaatccctttaaaaggcattggattatctcaaccacaattaacaataaaaatatgctaagaatttaagttaactgtattccaaagttttttccactgacaggaaaatttcagcctggaaggctctattgcaaaaagacagaaaagtgaaggcacactccagtttcatacttagaatgttgcaatcactgctaatcctctgattttatatggaaacaaatatatacacattgaagttcccccttcacaacgattaaaaaatggtctctctctgcactggtacccaaagaattctggggatgagaaagcaagagatacagggctggtacttgggaacaaaaggtaaaaaagttgcccaggaagtatgctgagaaggcaagaaaataattaccttaattccactttgtcattttgtaagctaatttctcacaatgtaaatctgtcctttacatgtaatctgctttctaaaacatacatgtgttcatgagcatgcttctgaaaaaatctgagtctatttcactgtgatattgtttttaggcaataatttagatgtatgtgtttgtggagcttattcttctgtacaagtgcttctcatcttaaacattcatctattaatctagtccatccgcattagaagaaaaacaggtctgtggttcaaaagtaattttcatggatatggacaacttttagtaagaaacaactgaggaaagcccaagaggacttttgtctcacttaaagaattgtgttgttacaccttcattggtggtataatgattattctgtactttgactaatacttatgactaacatagcactttgtgcagtttatttggtagattttatagtgggagaccaatgtcacaaatcttattaggattctctcagagaaaacagaaaattgtctcacatttaaaaaatctgcaaataagtttttttgtatatttactattttagacaagtggagcagtttgtttttaaatttgccatttttaaatattgtacttgtagaagaaaacaaatctcagctgatggagtaaataaactttatacttttactttttatttttgtactacttatttttgagacagggccttgttctattgcccaggctacagttcagtggcgtgatcatggcacactgcagcctcaacctcttgggctcaagcaggcgatccttccacctcagcctcctgagtacccaggatcacagatgtgcaccaccacgcccggctaaatacacttttttttttttttccccccagacggagtctcgctctgtcacccaggctggagtgcagtggcatgatctcggctcactgcaacctctgcctcccaggttcaagcgattctcctgcctcagccttccgagtagctgggattataggcacacgccaccacgcctagctaattttggtatttttagtagagactgggtttcaccatgttggccaggctggtcttgaactcctgacctcaagtgatcttgcccaccttggcctcccaaagtgctgagattacaggtgtaagccatcgtgcctggcctactttcactttttaaacgggatatatgataaatattgaagcctgcctttctgctatttgatccatgatctcctcttaagggttaaaatctaacagcaatcactgaataccccatgactatacttgggtttccattaactagagaaacttaatcaactaaaatcttccctcttttggcccctcacaaaagcacactgaaaataaaacctcacattggaatttcaatgaagtaacctgaaatcccctcaaactgaaaataacagttcgttcacaaaagttcaggatgtcatcgatattccactcactttgaaatgttagataaaacatattagcaaaaaagcatttaataacatttcaagtaataaacaacattaaaaaaactttcatgttctaaccaaattttttaaaacagaaaaaattcacttcttggatctccaaatcactttctcccttgctcttatgatgtagccacatgggctatattgctgcccttccagtaggtcgagtttccatctcaggagcagtacacgctttgccttattccagaatgaccttcacctgccagggtctttcttacccagttcaaaatgatgtgacctcagagaagctttcttccctgagcctgttatttaatattgtcccctcctgcttcactattacactaccctgattctctttatagcatttaaccactaacgaaaatttactttttgtattttcaaatttatgtatttgctttggatatagagcttacatccaaatgatagcagggatcttgcctaagattgctcaggatatggccaggcgcagtggctcacgcctgtaatcccagcactttgggaggctgaggcaggcagatcacgaggtcaggagatcgagaccatcctggctaacacagtgaaaccccgtctctactaaaaaacacaaaaaattagccaggcgtggtggcgggtgcctgtagtcccagctactcaggaggctgaggcaggagaatagcgtgaacctgggaggcggagctcgcagtgagccgagatcgtgccactgcactccagcctgggagacagagcaagactctgtgtcaaaaaaaaaaaaaaaaaaaaaaaaaagattgctcaggatatttatcgccatacactgataacatatatgtgacattagtaagtatttggcaaaggacgaatgagcaggataacatccacattactggtaaaatctttcaaccttcactacagaaggaacattcactgtggtgccgcctgttgatcactcagaactatgcacattggtcacggtgtaaggtacaggagccatgggaaagaagtcactgattcgactcgctgattaaccattgaaatacttaatgaatcatatctttctaactggcaccctttctatctttctcagatgaaagggaaacagaaaaaaaaaaaaaaaacaaaggtaaaggacctcatggtgagcctaaaaaagaacacgtagtactaccaacaccatgttcactaccaacaatatatgtaattcttgtttagaataaagcacttatcaaattggagttatgaaatttatttagacaaaagactaacaccaatgatcagtaaataaaatctgaaactcaccaatcagggtatatacccaaggaatataaatcattctaccataaagacatatgcaaacaaatgttcactgcagcactattcacaatagcaaagacatggagtcaacctatatgcccaccaatgacagagtggataaagaaaatgtggtacatatacaccatggaatactatgcagccataaaaaagaacatgtcttttgccagaacatgagtggagctggaggccattacccttagcaaacgaatgcaggaacagaaaaccaaacactgcatgttctcacttgtaagtgggagctaaatggtaagaacttacgaacacaaagaaaacaacaggcactggggtctacttgaggggggagggtaggaggagggagaacaagagaaaactattggatactgggtttaacatctgggtgatgaaatagtacgtacaaaacacgatgacacatgtttacctacgtaacaaacctgcatatgtacccctaaacctaaaagtcaaaaaaattaaaaagaaattcactagtcagaagatcgttacctctccacatttgaaatagaaaaaaaaatgctcatcaatattaggatgtttcaacaataatttttagcctattggcaaagttgcacaggttaagcatcccttgcctaaaatgcttgggaccagaactgttttggatttcggattttggaatatgtgcatcatactggttacccattgagcagccctaatctgaaaatgcaaagtctgaaatgcatttcccttgagcgtcatgttggcactcaagttttggattttggagcattttggattttgcactttcagattacctacgctcaacctgtatgtaagtttcagagaaaattaagcaatatgtgacagaaactatatacagtaagatgaaataatatttatagttctcaaatgctgacgaaaacaattatggaaggtagaggaaaaggtgtgtaaataaaaaactagatctttaatttaaaagctaagaccacataaggatattttaatcaacaatggaccccacagacaatagtggtccctgaagattaaaatactgtagttgtactgtcctttcctacgtttaagatacacaaatgctaactgctgtttcaactgcctacagtatttggtacagtaacctgctgtacaggtttgtagcctaggagcaataggctacaccatatagcctgggtgtgtggcaggctctaccacctaggtttgtgtaagtacactctatgatgttcacacaaggatgcatttctcagaaggtatccccatcaagtgacacgtgactgcacattatatgctctacctgcatgtttatttggacttactcagcactcttggaaaactcctaatatggagtggattgtatagataagaggttttgatcccaaatatatgatcttaacttggccaaacgtgaatttaggctaaaaatttctgattcagaaaattcaattttactgtcatgtatttgctgtatcataagctgtatcaatgctgacacaccttttactttagaattcagtagaggcatttctcaggaggaacaatgaatgaagagattaaataactgttacaaagtttcaatcttctgaaaacactgcttttaagtttctcagaactaaccattttcgtaaaatggatttgctaaatataaactggactgtttttctatttgtgaaaacacattccccaaacactttagaaaacagtttaggccttagatgaactctgttggtttcagggaatgagtgtaacaaatgtaaatgggtagaatgccaaatgtaaatcttgacaatccaaatttcccacatttcaatttcatcctgttagtctgaacttttactgtaatagaattttttcaatattgtacctgcttatgactaatcatgctcacttttataaaaatttatagaataaaaaaggtaaacacctgttgttccctctaacatacaatgttagagggaaacataaaatgggtctgttaaaatagctgtaaatatgaggaagaatacaatctaaccaagcagaggcctagatcataccctgcaaatcaaatactctctacttatgcagggactacaggaagatcagtgaaatctcttttcaatgatacccactcagtaatcaccaagaagcaaagtgtcaccatcaactgtgggctctctcagtattcccagctcctacagcccaagtcttggcccagactgggctctgcaacaatactaagtgaaatacaaaacaaagcaaacaagcccagcaacaagcatcaagttataagaaaaccactgtaattattttccctatgtatatgtattttttgaatttaaaaacaaaactattttaacattccagacaaagcatttggaaactttttctgtaattgactcccttggccatatagtctctcttataacttcttgattatgccattgtggaatgggtttccaataaaactttacaaaaggaggaggctggatttagcccacacagtgcagtctgccaactccagttctagacaacagtgaggatactttgttcatctaattataatgaagaacaagcttgtgtgtttttctcagaattctctccatatgtttgctctctaagaaaagaatatcacacagaggaacataagtaggtcatgacaacaatggaacgctggtagattttagtttcctgaagattaagtagtaattaagctatgaaatttctttctctacaccagtaaggtcaaagatttgggtcaaagagccaacagttttaatcctggccccaatcccaggtcaacaacataaccctggactttattgcaacctctcaattttagtttgcttaactatatagaatgaggaaatctcagaaaatggttaaatacaagcagataagaaagcacatttggaaattctaacttatgatactattattactactatgaatcaccataataattacagtagcgaacacatgtgccaggtattgtaataactaatttctcaccattctgtaacgtatgacctgcctgcttcactgcatatggggatgctgaaacacagaggtttcaaggttatgcaagtaaccaaaggcaggctgggacatgaacccaggaagtccggctccaaagccctaagaattcactatattctatcacttctcacaaaatgaagatgaagaggttattattctcagcagataatcgcacatcctaaaaatatacaaaagtattcagaaatctaggaagagaacagggcagggctgatgtttgccaagacagacttccttttacactcaagtgaaacctttctcacagagaccaggtcatttttttatcacttctttaaagataatttacatacaatttgtaaaacaaaaagacacttatacagccaaaattaaataaaaaaaacaaaagactatatatggaagtcctttagtgtttttttacactagcattttactcttataatgtatctaagttgtttctcaaaatgcagggaatgctctaaattaaaactccacagttacaggatttgaagattcaactttggggtggaaatgaaacctttaagcaactggtactatttatatcttgtctgtaggcagattactaaattttcaggaattaaattctcaccacaaaaaatatgaaaagaacctgaagagatttttccttctgtagttgaagttaccttttcttttatacactatactttctaaccattagttcccacatctagcagtgcacataagagaaagatgccaggagcttaaaaacaaaaaaatacagttgacccttgaagagcatgagatttaactgtgtgggtccacttacactcgaattttcttccacctctgccacccatgatacagaaagaccaacctctcctattcctcagacgactaaatgtgaaaacaaggatgaaggaaatgagcagtgaaggaaaacgaggatgaagacctttatgatgatccactttcacctaatgaacagtaaatgtattttctcttatgattttcttattaacactttcttttctttagcttactttaagaatactgaatataatacatctaacctacaaactttgtactgtttatgttatcagtaagcttccactcaacagtaggctattaatagttaagtttttgggaagttaaaaatcacaggtggatttttgactgtgtgtcgggggtgagagggaggttttggtcccccctaaaccccaggttgttcgagggtcaaatgtattgcctgcttccgtctcagatcagctgaaagcaagccccagaagtttgtatttttaaaagctcccatattactggtgctacccatgaaaatacttaagatacctaggagaaaaaaaaatcacaatataacacaaaaatagtaattttaggggggaaaaaccctccacttttaagttaaggttacagattctaagtgctgaggaactctaaatgaagaaagtggacatcaaaaagaattttctaagattgaaaattttttacaatctaaactaatggcccaacatttgagattttgattcagattgcgttatttaaaaggggaaatcatgtccaaattacttaagcatggtttctagctgagaaatagatgttaaaattacagctgctcccgtgaatcatcaaaggtgctatatcactgtgtgtgtgtatgtgttgcggcagtaatccttttcctgataacaatctatgctgtgccaggaagatttttagaatatattaactgcagcaattaaaaatcatcatcagttataagataagccaactttacacgtaacatgccataatattcctttaaaaaatcattacatccttaaaataaacaccagggttctcataatttataaatctaggtttgaaatttagaaataatcagcttcacaaatacataaaaactacagtagatacgaattagcaaccacattcatagctcttacaagttatcctcttctcttactagttcccattttagtagaatgcgaaacactttacagttttaactaccactgtcactgcggttttttacaaactttaaaaaagctctctcctggctaggtacgcctcccttttcttacttctccctcgcctcttcaccttcctaaaagaacgtgctccctgttatccagttctctgccttctttccaaactgtttctcttagcaattttagtgacttctatggcttcagctaacacctctatgcaagttaagtctcaattcaacatctctaatcctaaatcatctcttcagatctagacccaaatttactttttctttccagctttactgaggtccaattgacaaataaacattgtatctattaaaggtgtacaacagtgatgttttgatatacatattcaaatgatgaccgagaccaagttaattaacatatccatacctcatagttacttttcttagtgtgtgtcaaaagaatgccttaagatctactctcttagcaaatttcaagtatacgttattaactcttgtcactacactgtaaattaggtctccagaacttactcatcttataattgaaactgtgtaccctttaacaaacatctccccattcctccccacccctaacccctggtaaccaccattctactgtctgtttctatgagttcaacttgcttaggttccacagtaagtgaggtcatgcagtgtttgtctttctgtgtctggtttatttcacttagcacaatgccctccaggttcatccatgttgttccaaatggcaggatttccttctttttaaaggctaaatcacatttcattgtgtgtgtgaacattttctttatccattcatgtgttcgacattcaggttgactccataccttggctattgtgaataatgctgcaacaaacatgagagtgcagatatctcttcgagacagtgatttcatttcctttggatatgtacccagaagtggaattgctggatcatgtgctagttcgttctggttttaattttttgaggaacctccatactgttttccagaatggccgtatcaattacattctcatcaacaacgtataagggttcccttttcttctaaactgtctcttcagccctggactcatgtttcaagtgatcttcatgtggactgcagttaaccatgggtcaggtggtggcctatagagccttgggagtctccagaaattgtatgcaattgctgcgtgtatgtgcacatgcacatttttctggagagaaggatcataattttcttcagattctcaaatgtacgtgtgactctaaagaaagataaactcaggtaggtcatatactaccagtataccagaacctttggcataaatactagtgttttgttttgtttttgagaaagagttccgctctgtcaccaaggctggagtgcagtggtgcgatctcggctcactgcaacctccgcttcccaggttcaagcaattctcatgtctcagcctcccgagtagctgggattacaagcatgtgccaacactacctggctaatttttgtatttttagtagagacagagtttcaccatgtcggccaggctggtcttgatctcctggcctcaagtgatccgcctgcctcggcctcccaaagtgctgggattacaggtgtgagccaccgcgcccggccaacactagtgtatttttaaaagagaaaacaaagtccaggttaatgtgtttattaaaggacttctgtagttaactttcccaagcagtagatttctgaagcttgctagcatcttctaatgcaatagtatgacaaactgcagctgcggatcaaccgcttttgtaaataaagttttatgggaacatagtcatgcccattcatttacacattgtctatggttgcttttgcagttgagcagtgaaaagaactatatggcctgcatgattgaaatatgtttactatctggccctttaagggaaagtttgcggttattttagatttaaaaaatgtctaagttgagaaaaacagatctaatcttgaataatcaaaagaaatacatcttttaattttatttgtaagcaatttcagatactggtatcaagcaaacaaaacccctgtattttttaaaaaaatagggtgtcttacctgccattgcttggctgctgcggcgagtgcctggaatgatcagaaggctctgaccgctggtcaggagatcgtgaccggctgcggcggggaggcctatcgtgtgatcgaccagaatgatctgatgccagtgactgaatttctgaaatgtctgttaataaaagggtgctacttattttcccacaaaaataattacagtcaagtataaggtactccagtaataatgaagataagctagtaagtaaaattatatataaaatggaagatttatgcattaatttcacctgccagcaatcatatcaatagtggtgagttgtctacaggaaaaaatgtatataaaacttatagattttgaaggtgtttggctggtagaaaattatcatttcattcaaagatgttcaatctccctagtattttaagaaaataggtcacttagagggaacgttcaaacagaatcacactcaccgtctctctcagaggcattagcagagtggatgctgtcagaaagatcagggacattcaatagcgtagcccgttcatctctttgaactaccatttttaatttgcctttagacctttctatcaatgtctttgcatctgtcaatgacatattttctgtcacagtaccatttatctgcaacagaaaataaattacagcttgaaagtaaataataaaatacaaatgttaacttagtttgttataaacagaaatatccaaaccactccttgctatgaaaaccaaaatattctctctacacttttccaaactgtcaaagtattccaccttcttgagatgataaaatctttactgtactgttgctgtcagaaaaacccatagtagcatcccctaactccttctttgaggctgtcactttctattacttataaacaaacgaataaataagcatttcaatagtatctggaagcaattatcagaactttttaatgtgtaagaacagacatatctatctacaaagtagtaccggcctgtgaataattatctcaggatgaccctgtgatacctaaagcattggtgtcgacatgtaataatgcataaagggaatttatatccctctcccccaaacactgatttttaattctctttggcaaaactgcttcaaacaagagcacagactacatggtaactctagaacttgttttctatttcagttcattaaaaagtaagaatatgattataccttcaatacaacatcaccttcttgaatattgccatctcttgctgccaaactatcttgtgaaatttccttaacaaatatatggcttgccaatcgaagaccatattctgaaataatgtaagtaagtgtttttagtataacatcctaagacacctaaatagattttacaagtatacaactaaactaattaactactgcatagagttttcaagtacaatcaataacaagaaatatttcttggccatcctgcaaataagacattccctctaattagcaagtctgcaatgtctccgtgaaagccaagggaaagtgtatggttcaaacgaaggactgatagaccgtgttcccatattactgaaaaggagaaaatccccaagaggacaccatttctttttgaccaagcattgatacactagctcttcagaatgattaaggaatacaattttctttaagagacagggtctcactatgttgcccaggctggacttgaattcctggggccaaaaaaccctcctgcctcaggctccagagtagctgggactaacagacatgtgtcacactatgcctggctagagatataattctaaagagtaaactgcttgaggtttgaaaaactttgaaaagattgaccattttattgatgactattatcatgcatatactacttctatttttcccagctcctagaccaaaaatatttctgatcctatacaccccatgacactggatagacatactcagagtactagcatgtactaagcatgagtgcaaaggcttacaaccagccaggcagatgtgggcaggagttataatgccaatcctttcctttaaacaaccaacaaagtatccaagagtgagaacatcactccgtctgtgggtaaggaatgttggaagttgaggaaattactagcagagtccagagaactgcccaggttcctgcaacagctgcagaaaaacatattttaagaaaaataagaacaatgactacaactatcaatataatgtcaatagtaaaaggattgcccctggttctgtgaggagagtcttactgcattaaaaacaaaatcaaaaaccaagatggaaaacagaaaactgttttaacatgggataaattaacagacctattacctaagtgtttaaaaattacataagagtaggctgggcatggtggctcatgcctgtaattccagcactttgggaggccaaggcgggcggaccacaaggtcaggagttcgagaccagcctggctagcatggtaaaaccgtctctattaaaaatacaaaaaattagctgggcatggtggtgcacacctataatcccagctacttgggaggctgagggaggagaactgcttgaacctgggaggcagaggttgcagtgaactgagattgtgccactgcactccaagcctgagagagagagtgagactccgtctcaaaaaaaaaaaaaaaaattacatcagaattacagtttaacttaagacaaatatacaaagagtactcacagccagaaatagaatcagggtgaagaaaacggccttttaggatatctgggcaaggaatgaggcagtcatccatatggtcattacatcacagaaggatagggtattggttaaaagactgttcttcaagattaaacacttataaatgaccattacacagatgaccccaaaatatttcttgtatattagtttgttcgttcattctaaatatttcttggggtatatatgaactaggtaccaggcattagggagaaagcagcaaatgagatagttcctgcactctggcaatttgcagtcagtgaaaaaaaggatgttagcatggtaatcccaaatgcggtgagttcagagggcagaaacacaagggttcttcacttactagggggaaggagaaggccgccctgaggaagatatactaaagttaaaactttacctaagaaagacctaaacctgaagggtatgtttgtgggggaggggatgcatggggtgagtgacggctgaaaagttcaaaacaaatgcatcaaagtaatgaagaaaaaaacctggtggacctaatgaagtcataagtctagtgtagctgagactgagaactaataaagaaaggggcaaaagagtaagacagaagtgtcacagaggatctatgaagaaatctgcagaatcaacttaaagggatccaagagacaacctatgagaccaaatgagtctatgtaagagatgacagtggcttggaaaagggtggaggcagtggagaaagagtgggatggataagagtggtattcaggagtgaggacattcatcatgcatgggaaaaaaagagaaggcaagggtaactaccatgtcatctgggaatggcctgagaaactggatcaatagaaacacattcaactgaatacttcatgagaaatacaaagaaaaattttaagagggagatgagtttcatttgagatgtgctgtgtttcagggacctacaggaacatctaagtgaatatgcctaacagttggaacacaagagtgtaaagatttgggctggagaaagaggttctgccatcatcagcagtgactggaagcaggggagcagatgagattgcctaaattaattgttattcaacctgaggaaaagaaaaaaaaagttaccttaagtggaaaaaaagattctaggagagaaactgacagaacgttataaagggcagggtgaggagaatgagcttgcaaaagatacagaaaggtgggggaaaaaaacagaaagatacagtactaccaaagaagacattatttttgaaaataaggagtggttaaccatgtgaaatgatactgaaaaggcaagcaagctagagactgaaaaacttccactagatttagtgtgaacatttttgggggcagagcggaaaagataccagaccagagaggattgaggggtaagtagtgaagtaaaaacagcaaatgttgacaacttcactgagacttcactgaatgggggtatggaataccacctaggagatatgccaagtggtaaagcagatcaaagtaagtcttgataatattccaactgtaacaccctttatatcaaaatgatcagtcatgcatgcccacagaaggagcaagccacagtcagatccattttttatcaaatttaatgaggcatgagggaaagcagctgagtttcagtttcaaaaacttcaaagaagtactgcattatggagaaatgctctataaggggttcctttccttaaattcctccatttaaaaaaaacagtctggagtgagggggaagaagtcccagcagggcacagtggcttcccgcctataatcccagcactgtgggaggccgaggcaggtgaattgcctgagcttaccaatttgagaacagcttgggcaacacggcaaaaaccctgtctctacccaaaataaaaaaattagctggacatggtggcatgtacttgtacttccagctaccagggaggctgaagtgggaggactgcttgagcctgggaagcagaggttgcagggagctgagattgtgccactgcactccagcctgggtgacagagccagaccttgtaacaacaacaaaaacaacaacaacaacaacactcccaagatttctctccatgattacactactaacagttaagaaaaacactgaatttccatttggtgatggtgtgacatttcttgttagcataatttgtacctggctattctcatcacaacaaatccaaaagccaagccctggacaattcacttgaagtgttatctgttccaacggaaaaaatgaacagtccctgaagcctgccataacaggatttgacttacagtgatagaacacaaacacaaagacaacaaagcaaagacatgaagagacagcaactgtacttctcattaaaattagttttaaattttcatgtgaaaaaaacagcaagagttggcagagaataccttcatttttccgggatttcaccagtgtgactttagtaggtttagcaggctggctggaagccactgaccgcctgtctgaccgcggggacaagctcctctctctacttgcacttctatccctcggccaaatcttctcactccttctgttaaccacaccactccggccacttcttggatcatgtatttcctcatcataactatcttcttcattatcagatactggttcaggatcaggacgacttactggtatttgaactttcttcttccttctaattgtctgcaagttaaaaaggttaaaaaataagttgactgattttcatatatgtacgttcagttccaaagagaaaggaatattacacttctcatcccatattaactatgaaccagcaagaaacaatacacaaacaactacaacaaatttctaaggaatacatttccataaaggctgtgttttctgttctcctgataaacagatctggttaagcacaaataagaacgagtgggcctaaaaacctctttatttacttcacacagaaagatcttcctggtgtaataatcacaagcttacagggaaactaacaactgttggtggtttgaataaaaaggacagcactgtactctaatgccatcaaatatactctaggtgctaccaaaaccacagcaaacttccatgcccaacttgcttccttaaaaattttagaatgcatcaatatcaaagcccacaattgccccagacctctaagagataatttattctatagccgcactaacattcaataatatgttggagctaattaactcagccgtacttcaccaacacaaactgctttcagtctctggatctcttcaatttgtactcccagtctaggtgcaaattcttccctctggcgttcttttctcaatgattctggtaactggctctgtattgcctgtccacttatttccttcattctctgcaagctgacgatctacatgtattacacctgctgactgaatggccctgtaatctgtggactacactttgccttctcacaatagtatacacttgacctcactgtagttctacaggatctccttgtgtatcactccttgtcttctatgtcggacaccttgagctactgaaacttttcactatcttatttccaattccttcatcttagttcatcagttccatcctggtttcactcgcattccccctaagtttgcatgagacatcctgttgccatatttaaatgactttttcttgacccctcaatcatctgccctgacaaactccagtcctattattaccttcacttccacactttgctgatgaggccctctgtaaattcattttacagaagtcttgctcttgttcagcaatcctttcatctacatattgttgcctctctgtggaattcgctaatgtaggtattctacaaccattcttcaagatcccagccactcagcctgctttaagatcagtgccattttactccccctcccctcctaaattttttcagtatttcccctcctaaattttttcagtgtctcatttatttggtcctctttccttctggtctcaaagaccaaggcaatcttctccctggatgaacaaaacccttgtatttgagctctcattctcatccctacctacctctaagacttttttcttcatcaattaccatactccaggttacctgaaacttcaatctctttatttacctaaaatctgtcctctacctactaagctcccccaattaatcttctatttctctgtcttgctattcacctgcatgttatcatcttttctctcttctctatgtgcctaaacttcttcaaagggctgctctacacttaatactactgcttcctatgactactactattattatcagatactggttcaggatcaggatgagggcctgagcagagggccattctgaggaaacaacgctgaagctcaaggatgagaaacagcagaggccagcatgtgaaaaggaggacagccaatgccctgttatgaactgaaagagaaaggctgcccttctcctattggagcaacccacagctgaagtccttatagggtaatattttctgtaaagcattcctaatgctagctgcctgcttttacatctcacttctatttaatttccaacatattatattggaagcaatacctggtattagtattttaatcttcagttcctccctagtaataaacaaaaacaaagttgagcagatgagcactcaaggctttccctatcattcctgtaagagtgcgccacctctttgggatcctactgtacctgacctatcaacctgagatgacgtgcattatatggttatcagtatgtatacctatccagcccactaagatttgagttttttgagaagttccttaccatgcatttaactgtacatataatgcaatgcttgcatctagtaggtgcttaacttattgaaaggtaaccagtcctattgtgattctctacttatgaatcaacagttataaacatgaataataattagtaggtgtgacaactatgctcgattttaacactatgaaaaatttggaatcaaaatatttaggaaaaaaaatgcctacttcaaaatagtttagcttaactaagtctcaaaggtaaaataaaacaaaatgatgccatgtaagtactagaaaaaaatacaacagagaggcttttgcaattaaaaggcttttggaagcatgacaccaaggcagaaccaataaaatgaaagtctgacagacatgacaaaataaaaatgaaaacatttcaatgttgtaataaaatgatacaaaacaacaaacacaaacaacttacaagcattcacaaaagcaaagaggataacaacacatgaggtatgtatgacaaaaggctaataatctgactacagaaaacactctagtatgaccatcaccaccatataaatgcaaaggacatgaacaggtaaatgaaaaaacaaatgggtagtaaatacaccatgagaggatcaaatccacttgtgatttaaaatgtttcatttgaaacacttgtttagtttatcagtttggcaaagatttaagacctgttgaaaactgaactctcaatagcctattgattttctgaaggacaaactggcaatacatacatcaaaagtcattcaggccctttgactctgaaaagtcactcctagaaaattattctaaacattaactaaacaagtaggtagtaatatgatgatttttgcagctgaattttaaaaaaatacttgcggactggacactgaaatgcctgtgaatgagtgggttggataaatatatatgcatagtgaaatgctgcatggccatgtggatacctacacagtcatgcaccatgtaaaacaacggacagcacgtactgcaggggccccataatatcacaatggagctgaaaatctcctatcacctagggacgccacagggtcataatgtcgtgggtgcactgcagtacttatgttggtggtgatgctggtgtaaacaaagctactatgctgccagtggaatagaagtgtagcagatacaatatgtacagaatataatacttgataatgactatgttactggtttatgtatttactatgctaaactttttatcattactgcagagtgtactccctctacttatttttttttctacatgttaactgagaaaacagcctcaggtaggtccttcaggaggtgttccacaagaaggcattattgtcacaggagatgatggctccatgcgtgttactgcccctgaagacctcccactaggacaaactgtggaggtggaagacagtgacactgatgaccctgatcctgggtagccctaggctaatgtgtgtgcttgtgtcttagtttttactaaaaaagtttaaaaagtgaaaaataaaaaattttaggctaggtgcagtgcctcctacctgtaatcccagaactttgggaggcggaggcaggcagatcacttgaggcccggagttcaataccagcctggctaacatggcaaaaccccatctctactaaaaatacaaaatacgggcttggtagcggtcgcctgtaatcccaaggctgaagcacgagaatcacctggaccagggaggcggaggttgcggtgagccaagatcacgctactgcactctagcctgggtgacagagcgaaaccgtgtcttaaaaaaacacagcctgtaatccaagcactttgggaggccgaggcggggcggatcacgagacagcctccatcaggagatcgacaccatcctggctaacatggtgaaaccctgtctccactaaaaatacaaaaaaattagctctggtggcgggtgcctgtagtcccagctactcgggacgctgagcttgcagtgagccaagatcgcgccactgcactccagcctgggtgacagagtgagactctgtctcaaaaaaaaaaaagaaaaaaaccaaaaagaacccaaaaaattttaaatatttttgtacagctgtacaacgtgtttgttattacgagagtcaaaaagttagaaagtttataggttaaaaaagtttcagtaagctaaggtttattattgaagaaagaagacttaaataaattttataaatttataaaatattaaatacattaaaaatattaaaacgttaaaaatttagtgcagcctaaatgtacagtgtttacaaagtctacagtagtgtacagtaatgtcctaagatgtcacattcactcaccactcactcgctgactcactcagagcaacttccagtcctgcaagctccattcatagtaagtgcactaaacaggcatataatttttttatccactatatatttttactgtactttttccatgtttagacatacacatacttaccattgttttacagctgcctacagtatccagaacagtaacataatatatctattatgagaagtgaattatcaggcaattctgtctttgtgtgaacatcacagaacgttatcttcccaaacccagatggtatagcctactacacatctaggctacttggcatagcctattgctcctcggttacaagcctgtacagcatgttagtgaactgaatactgtaagcgactgtaacacaatggtaactatgtgtgtatctaaacacggtaaaggtaaatacagtactataatcttatggaaccactgtcagatatgtggtctgttgttgaccaaaacattgtcatgtagcatgtgactgtagaggaggaaaagaggaggaaacattaagccaaaaagaggtaactatttggccgggcgtggtggctcatgcttgtaatcccagcactttgggaggccgaggcaggcagatcacgaggtcaggagatcgagaccatcctggctaacacggtgaaaccctgtctctactaaaaatacaaataattagccgggcgtggtgtcaagcgcctgtagtcccagctactcaggaggctgaggcaggagaatggtgtgaacctaggaggcggagtttgcagtgagccgagaccgtaccactgcactccagcttgggcgacagagcgagactccgtctcaaaaaaaaaaaaaaaaggtaactatttaactgtcccctttcctttttcaattgaaaaaaatcctggtatctaaactgagaaaatacacgtaccagtgacataccacaccagtgttagaagaaacactcaagtgtaaacaaataactttggaactattgtttcagttttccttaaatgggaaggataaattcaaataccagaaatgtatcaacaataaagttggggtacctttactaaattacagagaaaagatacttacaatttttgcatttttcccacttttccttagttgctgaacagcaaaagcatgttcaacattatccattgaaactccgttaaccattgcaactcggtcattttccctaaggggaaaagggcacaaaataatatgttagagaaaaacattctggtaagtttatgatgatatttccaagataggtacttctaaaatgtaatctaattatgagccaattaattaatttctcttcagatcaatgataaaataatgtcaactgacttactttcagatttctctgcagaatgtttaacaagtaactaaccacaggtccttaatttttttaagtcattaacaaagtatttccccaaaagactgaacagatatcacatacacgaaatgattcttggtagtacagttacagggcattaaatgatactaagtcatacagctggaaaacttactcccttttaagtttttcatcttttaattctcttttaattcttctaattatagtgccactattttgctagtgtattttgtgtttctctttatcttactaatcttcatagggaataaaaagggtggcaagacttggggaggaggcttctgaaggctagattctacccaaaaggagttatacattttctttttcactatttttacagttacacattctatttaaagtgagtgatactagctttccaattttcatagggataaagcttcctttattttctttggagacagggtctcgctctgtcacttgggctggagtacagtggtgcaatcatggctcattgcagcctcagattcttaagttcaagggattctcctgcctcagcctcccaagtagctgggactgcaggcacaagccaccatgcccagctgatttttaaacttcttttgtagagatggggatctcactgcattgcccaggctggtctcaaactcctggtctcaagtgatccccctgcctcagcctcccaaagtgctaggattacaggagtgagccaccacacctagccagtttccctcttaatatatgttaatttaaggaaaaatatatgaagcatggcacaggtggagtgtgaatatgacaaaatcactaagacagtgtaagacagtacgccagtgcctgaggagaggaacactgcttgttgcacagtgcccacgataagcagcactcttactgtagctgtccttcagctggtcctcctttcagcacatctgaaatcactattgacgtttccccactctgaaaatgaggattatctcgtccaccagatattgcaattccaaatccaaatccaggagcctaaagtaaaaattacagtaaaatattgctattaaggacaaaaataattgttatatcatactctacaatctagagaagccaaaatataaaaattacaatcttaatatatctgtgatccataaacactcacctgcatggttacctattagaattatccttgtacaagaatgcatgctctaataactactggacataacagaatattaaaaatcgccaactatatacatgttctttaaaaaccaaaagacaattaaaaattattaacactgagatcctgactttatttttgatcagaagaggtcctgaggagactggcagagcccagtgtgatcatcagccatcctggcaactgatttagaagatgacagacttatccagcatacacaccctttgtcattttacataaatatcaattgctttgaaaatcaagtattagttatttcaacttctttcaacaacttctgccaactcctaaaaatctctgtagaatataatgccttgtgcacactatacaatagaaggtgtacattagccatattgaactaacattgtaaaattacctttttaaaaaactaaattataataagctacacacttctgaaagagccaagaatctttaccacaatgactcaggacaggccggtatagaaaaaattcaaaatattttccaggttgttaaaaaattacctaatctcaaagaaatcactattccctagaaaggatatgaagtacttaagagtagtttaaagagacaatatacattttcttaaggctacagaatcattaagccagaaatgtatgtttttgtataaaactgtacaattcaaactgcctgaggacaaaggtaacaacttcctccctcagctttccagtccgcaacagaggagactattttcaccatgaatagtgcatacatcacctttcctcccatcccaaagcctatagaagtagcaaaagaaaaaaaaaaatcttcttaaaaatgaataaataccaactattccaagtgtccatcaactgatgaatggataaaacgtgatatatatccatacaatgaaacattgtgtgtaaaaaggaatgaagtactcatacatagtataacatgaatcaaccttgaaaacatcatgctaaggtgaagaaaccagtcacaaaggttaatagattctattattccgtttatataaaatgctcagaaaggcaaatctataaagacaaaaacctgaatggtggttgtctagggctacagggattggagggggtgataattcaatgggaggtgttttttttttccccagtaatgaaaatgttttaaaatggactctggtgatggtcacacaactcggaacacgctaaaaaccaatgaactgcatactttaattgtttggcatgtgaattatatggcaataaagcgaacacaaaaaagttaatatgaaaaaagaaaataataaaacagggaaatttctgagtaactgaagataatggcaaccatctgaatctgtttctctatatattctcccaaaatttaatagaacaaaaatagaccaactacagtggttctcccttatcctcggtttcatgttctttgctttcagttacttcaggtcaactgcagtgtgaaaattttaaacggaaaacttcagaaataaacaattggtaagacttaaattgcacaccgttatgagcagtgtgatgaaatattttgccatcctgctacgtcccatctaagatgtgaatcatccctttgtccagtgtctccacgccataggggctccccacccattagttactcagtagctgtcagttatgagatcaactgtggagaggtaacacaatgcttgtgttcaagtcacccttattttacttaatcatgaccccaaagtacagtagtagtgatgctggcaattcggtataccaaagaaaatctgtagtgtttccttcaagagagaaggcgaaagtcctccatttaatacagaaaaaaaaaaaaaaatatgctgaggttactaagatctacagggagaaggaatcttctattagtgaaattgtgaaggaaaacaaaatttgtgctggttttgctgtcacacctaaaattgcaagggtttcgccacagtgcatggtaagtgcttatttaagatggaaaaggcattaaacttgtgagtggaagacaggcacagaaatgtgctccaattaacagcaaaactgggtttgatactatccaagaattcaggcatccactgggggaacatacaccccatggctcagaggggactactgtacacaaaaccatacactcatcataattcaaagacaatatccaaatttcaaattaaaagcaggactaaaacttcaaaaataaacaattagagacaaatgactattagaacagcattagaaaacataagacactacagaacaaattcaaataaatttgaaaacctaaaggaaacataattcctgaggaaatatagatggccaaaattgaccctattataaataaaaggcttaaacggcccaatttctggagaaaaaagcagcaaaatttatgagggaattatcccacaaaaaggcaccaggcgcaaatgatttcccagagaaattgtgccaaaacatgcaatatccagacagcctcagtacaatatattgtttcagaacactgatatcaaggaaagcttctaaattctttttatgaagcaagtataatactgacactgaaagctgatgactgtccatgataatgactaaccccccaatattacagctcaacataatttatttgtatcagtgcaaaatacaaaataaaaataagcaaacaaaggccaacactacataaatactccatgaaaaagggattaattccaggaatgcaggattagtaggaaatccactggcataatatatcctattaataaatctagagaaaaaaattatatgattatctccaagatcctgaaaaagcctttgacaaaatttgactttcaccgctgaagagaaaacaaagtttgtgaaaaggcactgtaacaaaccctgtaagtatgttgctttttgttaaagtacacaaagaaaatccagcttttcatacacagatacagtcattgaaaaagaagagttattttagtagcctttttaggtaattacgaaaattcatgtttgactttatgccaaaaacttaataaatgatagtttcctaaaggagagtaacaatgtacagtttgaaaccatatcattcaactgtctgtactgttgcatgaattatctattggcctattttacactctgaatgagtattttatccatgtataattttactatagcatgccttagtctttcggaaaatactggttccctgagttaggtaaatcttccaaatgatgccacatttcaccacacagtgtattttaaaatcatgtgttaatatcactatcaaggttatcaaaagagtctttaagtactgaaaagctactgagcttatggtggcagataaaaatttctcaaattttaaattttgttttaaaaatcagttttcattgttagcaacaaatactatcaagaattgttctccttgaagcaaggtactcattcattttggagaaatatgtttgtcaaatattcaagtttggataaccatacattccttcaagtaaacaattgttcaagtaaaagtgatgcctgccttccaccccccccactcaatacacggctgcaattcaaataatcacacaagtactttagtacaaggcagaagtactttaggcacacttcctgtttgcatacctagactactgaaaacgtgtgtattcaagggttggaaagtaacaagacacagttcttactgtttcaagtcattcttaaataaaactgaaattgttcttttaatctacgagtgtgtgacaatgactattatacggtttggtgcccctgccttgatttgggctacaaagcccacagttttaaccgccattgtttctgaaccttcagtcaaataattacacagcgaagaagataagaaataccttcatattgaataaaaagagttttgcccttgaacctaaaaaggtttcagggacctttaggagtccacagaccatactttgaaaatgtcgatattaagaactacttaaacatgaagggagaaaaataaataaataaataaaacaatgaaacaatttacaaaagatatatgagatgttaaaacccacagataaatgcaaattaaaaccaaagaacaccaagaacagaaacattaaagtataacatatttcagaaaagggaggctatagcaaacagtctactactgatgggcacacaaattgctacaactttcaggagaggaatttggcagtaacctaacaaaactacaaatgtactattcttttgacagagcaaactaacttctagaaagtaccctaaagatacacatacctctctcacaatacaaaagtaacaaacgcacaaggttattcattgcagactgtttgtaattgcaaaatgctgggaaaacacctaaacaccccagccttagtaaacgattatcctttccctttttttctccttcaaagaagttggggctaatctttgtaatttagtaatttgaaaaattactctatgtaattttacagtatgaacttacatcttgtttggtagttattttattttcctcttttatttaaaagttaaaaacataaaaagattaaaaaaaaccaaaaacattaggaactttcaataagcaaggcagggatgcgagcatacatttaaaaaaattacttgtgagcaagtaaatgcagttccggcacctagtagggcaggtaatcctgctacatcagtgcttaccacagttcacttaatgactatccaggagccctgcgacttcttacccaggctgcaggtaagaatcacttgggaacaatttcaaaactgcttgctgatgcatgatcctcaatctataccaattaagtaaaaatggagaagaggagttggtggacttaaaaaaaaaaaaatagcccccaggtgattctaatgagcagccaggaacgagagctgcagctttcaatgttttctgaatataagatcagttcattaaaaatttcaaaaggttcaacttttccccactttcccttccctctaccttcataattgtcttatttggccctttcaacagatttctcacctccactgcactacaagtgttggcagtgctgtccctctaacacaaagaccctaatccaatagatccttgccccaagtccaaattccttagcatgcagtgcctttgaatacaactccaaacttgcttcccagcaccccagtctttgctctaaacccacctaaatactgattcctgcttagggagatcatgcaatatcaaactatggcttaacatctcctctctccctaggatttccttactaccttatcaatcttgcaagcttcagctcatctttcaaaacccaggttccatgtcacctcattcataaaactacccttggctttcacagaagtggtccatcctgtacatgtgctggggcacatgtacacacttgtgctacttaacacacagcacaagtagcctcggttagcaaggccctatttgggaggaagtcacatatttaaaatcgaaggctaacctgattaagcccgccaaacttaacctgtctttttcatcgcttacttctagttgatctattttaaactccccactagcaagtcacatagcaaatctcccacgaacttccttacagataacttccgaatgtgggtcactacagtaacggttgcttaaagttatttccaggaaccagttggcagctcttgtccacttcaagctgattaagaccaccgaaccttcaactgggcctgcatgaatgcccaaagagaggtgactgtttgatgtcagagggccaaaacctccttcctcagatcatggtgatactgccatttttcaaacatgcattctatgaagagctgtgtaacttgactacatgtatgcagatcctaactaactcacttttccttacccccaatctttctcccccacaccttggagaaccttggtactctattccaaaaacatccttaaaatcccatctttggagaggtgggtttgagatttgttctcccatctcctcatttggcagtcttgtgagtaaaatcttttctctttgccaaaacaagtcatcgcagtgactggcttgctagttcaatatattcgtatacatctttcaactcaatgcaaccctgcagaagcctgacacaaagtggttcacgaagttagtgaacctcaacaagtatttgattgattattcaatttaactttaattctatttccctttatagagactctttttttaaactagccctaattagagcactaaaaacagaattctggaaaaattagcagcaatgagagtaggcatgaatgaatcttcctgaataaaaacaggcagtcgactacataacaaaccaagaatccaagtgcaacatttacaacaaaactagggggtcaatgtatcccccttgaagtgcaaaatgcaacgaggaggggataaacaaccagctatggagacttccttagcatgtgaacgaagccatattctaaaacaaacaaacaaacaaacaaacaaaatcctccccgccacctcccgaaggaaaaaaaaaaaaaccaccacaaattacaggcaaaaatgagaaaaaacgatcagaatcaaaccctctataccagcagtcctcaacctctttggcaccagggattggtttctttgaagacaatttttccacagaccggcaggtggaggggatggtttcgggacaatccaagtacattacatttattgtgtactttatttctattatgattacactgtaatatatgatgaaataatcacaaaactcaccatattgtagaatcagtgggagccctgagctagttttcctgcaactagatggtcccatctgggggtgatgggagacagtgacagatcatcaggcattagattctcataaggagtgtgcaacctagatcccttgcatgcatggctcacaacagggttcacactcctgtgagaatgtgatgccgccacaggaggcagcgctcaggcagtaatgagagcaatggggggtggctgcacatacaggtgaagctttgctcacttgcccgccactcacctcctgctgtgtggctcagttcctaacaggccaaagatccgtacatctctgtggcctgggggatggagacctccgctctacataaagttactatataatggatactgagtagcagaataacatctctgcagacaataaaagtatgcctgaaagaaggcttaaaagagggagaggattaaaactgttattagcacaagaagatacaagacatgaaagaattagaaaaaatgtagaaatgaagaggaagaattcgagaccaaatctgaaattttaaaaggtcattttagataggaatataagaccaaaaaacatcttaagagaaaaagtaaaaaagaaatcaacctaacatcctaacattaaatcaacaatacatacgacattaacaacattacatacattaacaacctaacatcacaacaaaaagaactataggaacaagagcaaaccaactccagagctagcagaagacaaaaaataacaaaaagagctgaactgaaggagccaggcacgaaacaccattcaaaagaccaacgaattcaggaattgtatttttgaaaaaaaatcagtaagataaactattagctagacaaagaagagagaagatccaaataaacacaattaggacaaaggggataccactgaccccacaggaatacaagtaaccatcagagaatactatgaacacagccatgcacacaaactagaaaatctagaagaaactgataaattcctggacaaacccaccctcccaagactgaaccaggagaaactgaatctctgaacataccagtaacaaacgccgaaagtgaatcagtagtaaatagcctaccaactaaaaaaaaccccaggaccaaatgaattaatagctgctctacatgtacaaacaagagctggaacaatttctactgaaactattcccaaaaactgaagaggaggaacaataccccaactcattctatgaggtcagcatcatcctgagaccaaaacctggcaaagacacaaaaaacaaaacttcaggcaaattatctttgatacacattgatgcaaaaatcctcaacaaaatactagcaagctgaatccagcagcatattaaaaagctaatccaccacaatcaagtaggctttatccctgggatgcaaggttggttcaacatatgcaaatcattaaatgtgattcattacataaacagaactaaagacaaaaaccacgtgattatcttaatagatgcagaaatggctttcaataaacttcaactcccttcatcttaagaactctcaataaactaggcattgaaattgaaggaacacacctcaaaatagtaagagctgtatatgacaaacctacagccaacatcatactgaatgggcaaaagctggaagcattctccttgagaaccagcacaagacaaggatgccctctctcatcactcctattcaacacagtactggaagtcctggccagagcaattaggtaagagaaagaaataaagggcatccgaataggaagagagaaagttaaactaccctgtttgcagatgacatgattctgtatctagaaaacctcatggtctcagtgcaaaagctccttaagctgataaaataacttcagcagagtttcaggatacaaaatcaatatacaaaaaccactagcattcttataaaccaacaacagccaagagccaaatcaggaatgcaattcatatggaaccaaaaaagagctcaaaaagccaagacaatcctaagcaaaaagaacaaagctggaggcattaggttacccagcttcaaactaaactacagggctacagtaaccaaacagcatggtactgtaacaaagacagacacacagaccaacggaacgtaacagggagcccagaaataaggccacacatacgaccatctgatcttcgacaaagctgacaaaaacaagcaatggggaaaggattccttattcaataaatggtgctgggataactggctagccatatgcagaagattgaaactggaacccttccttataccatacatagaaatcaactcaaaatggatgaaagacatcaatgtaaaacccaaaactataaaaaccctggaagacaactcaggcaataccattctggacataggaactggcaaagattgcatgacaaagatgccaaaagcaactgcaacaaaagcaaaaattgacaaatggaatctaattaaactaaagagcttctgcacagcaaaagaaaccatcaaaagagtaaacagacaacctacagaatatgagaaaacatctgcaaactatgcatctgacaaaggtctaatatccatcatctatacacaattttacaagaaaaaaaacaacccccattagaaagtgggcaaaggacaagaacagacacttttcaaaaaaaaaaaaaaaaaaacacgttgccaataatcatatgaaaaaatgctcaacatcagtaatcatcagagaaatgcaaactgaaaccacaatgagcggccgggcgtggtggctcactcctgtaataccagcactttgggaggctgaggctggtggattacctgaggtcagaagttcgaggccagcctgactaacatggggaagccccatctctactaaaagtacaaaaattagccaggcgtggtggtgcatgcctgtaatcccagctattcaggaggctgaggcaggagaatcgtttgaacccgggaggcagaggttgcagtgagccaagattgtgccactgcactccagcctgggcaaaaagagcaaaactccatctcaaagaaacaaacaaaaacacaaagatatcatctcacacctgtcagaatggctaatattaaaaaaagtcaaaaaaaaataacagatgctggcaaggctacagggaaaagggactgcttatacacgttggggaaggcagtatggcagttcctcagagctaaaaagaaaactaccattcgagccagcaatcccattactgggtatatacccaaaggaatataaatcattctatcataaagacacatgcacgtatatgttcactgcagcactattcgcaatagctaaaatgtggaatcaacctaaatgcccatcaacgaaagactagatgaagtaaatgtagtataactatgcagccataaaaaagaataagatcatgtcctttgcaagaacacgggtggaatgggaggccatcatccttagcaaactaacacaggaacagaaaaccaaacactgcatgttctcacttataagcgggagctaaattatgagaacacatggacacagaggcaacacactggggactaccggagggtggagggtaggaggtgggagaggagcagagaaagtaactattcggtactaggcttagtactaggtgacaaaataatctgtacaacaaacccctgtgacacaagtttacctacataacaaatctacacatgtaccctgaacctaaaatgaaagtttttaaataaacaaataacatttttaaaaaaaagaacgccagagattttataaaaaggatttgaggaacattacaaacactaaagacaagcaaaagcagcatgatatatatgaacagtaggagtccctaaagaagcaaatcaaaagaagggaagagaaaaattagtttaaaaaacaaaaaaaacttcgctgatactatttttgaaaaaattgaaactaggtactgaaagagtttacatcactgtaaatatgtgagttatctgagaatatcaactcaggaggactaataccaaaaatatatttaaatgactaaattttaagaaaaaagaaatagcaactcaaggattttttttttcttttgagacagagtttcgctcttctcctccaggctggaatgcaatggcttgatctcggctcactgcaacctctgcctcccgggttcaagtgattctcctgcctcagcctcccaagtagctgggattacaggtgcccaccaccaagcctggctaatttttttttgtatttttagtagagatggggtttcgccgtgttggccaggcttgtctcgaactcctgacctcaggtgatccatccccggcttccaaagtgttgggattacaggcatgagtcaccgtacccagccgagtcaaggattttatattcaacacaactgaccttcaagtacaaaaaacacaaataaaccagtcaacatgcaagaacacaggaaatattgtctttatgatctcatcctaaggaatctaataatattctgacaatcaaaatgacgagatacatggataggactggtgataagcatcacatatatactgtacttatttataacaccaagattaaacgaggattaaagggttaaatgatgtaacagctatatgatctagatatggtaaaaaccattttaaaacagagaaataaatgatagcatgtgcaaaaaaaaatttttactgtttccagtaatcaaagttgacagaggtagattactctgaggcaataatatgctctctgtattagacttactaagagactatcatggtaccttcccaaggggttttcaaaagaaatggaaaatgtgccatttttttctcatctatcttcaacgtaaaaattgtatagttctgccaagacagttgatttttaaaagtatgtttacatgagaaaatgtacaggataacttttagcttctggggatggaagaaagagcatcaaagacttgccgtatttcaaacttttgaaaccttaagcaaccatgagcagcaataacttctgtgtttatatgtctacgcctggctagacaactgaatttatgttagaacttggaaacagggtcctggaattttttcagttatgtgtcctgttttactggacactagccatgcccattcctttacatataattatgactgcttttgcactgaacagttccaacagggaccttgtggtgcacaaagtcaagctatttacaatctggcctttcacacaaaaggtctgcccacccactggttaaagtatttcttggttccttaaaaaaaaattcctgaaagttgctcctgtttcagaaataactgcttaatttattctccaaagattcctctctgttcctattgaatatgcccaattacctacttaaggattccacttgttgccttttattttattcttccatttttccatattaggcttgtacaatccgctaattataactttcctcactaattctagtcttacttttctcctcttattcttcctattaacctttcaatggaatttcaatgaacattcaatggaacctgttctagccatttgttttcacagtggccactgagatcacagaatttgaaaaccagatggagcctcagcaattgtctgttccagctcccttcttacagctgaagtcagcaggcctgggtcctgtgtgtctctatactacttgccaatcatgaccttatggaagacctccacagatttgagttccctcatctgaataagagagattttaatgttatcaactttaatatactttgattccatggggatcccaagagatttaaaggccttttcaaaattagttagtggtaagcccaaacagattagaagtcacaagatccaagcactgcagattttctaccaacttggtagttctcaaaatgctgttcaatcttctatgactgtcagattgattcggttttttaacagttatgtcccttggctagtcaaattgtgtgtgtcttcctgtttattcttactctcattcttttagttctgatacccaaatcatagttttcatttctcattcctgttccattttcttatttccagcttcttacagaatacctccaagtccccttctttaagactgtcattttctctataaaattagcctcaccaccaatgttctaaacaaacattggctcctctattgccaaattacctaccctttattttatttactttattgcatgtatagagagacctttgtttagtttatgtgaattacatgagttcttaatttcagaaattatgttccataaactttttgttttttagagacagggtctcactctgttgcccagaatggagtgcagtggtgcaatcacagctgactgtaacctcaaactcctgggttcaagtgatcctatcgcctcagcctcctgaagtaactgggactacaggtggacacgaccatgcctggctaaattttttgggggtgtgtagagatagggtctcactatgttgcctccactggtcttgaactcctggcctagagtgatgctcctgccttggcctcccaaagtactggaattacaggtgtgagccactgtgccagccacatttaaaaactgtaaattaaacgtgacatataaatggaaagagcactgtatgctgagtccaaacctgggttcaagttctcgctcttaaggggcattttactagacctttctgagacttaccttacttcacatggttaacacctacttcacagacaaatataatgaagggtctgaaaaacttataatgtactaagtacaaacaatagccttctaccagataaagggagtgtatcttagattacatgtttgcttcagcttaaatactttatcagacagcagtttggagctgcttgaccgataaaattccttttatcactttactgatatataattcatatatcataaattcactctttaaagtgtatgattcaatggtttttagtatgtacacagttgtaaccatcactggttacagatggtgccaggacagctggttaaccacatgcaaaataatgaatttggacccctacctcacaacatctacaaaaattaagtttaaagaaccataggtctaagtataagagcttaaactctaaacctctttgaagaaaacacaggaataaatcttcatgacctgagttaggcaacagcttactgaatatgatgtcaaaagtataagcaacaaaagagaaaacacatacattggaccccatcaaaattttataacattttcaccaccctaaaaagaaactccgcattctttagccatcatctctcaatcccctagcctcatcaaccactaatataactctctattcacctattctgaatacttcttataaatggaatcacataatatatgttcttttatgactggcatctttcagttagcataatgttttcaaggttcatcaatgttgtggcatgtatcagtacttcatttctttttattgctaaataatattccattctatgtatatatcatgtttattcattattcatcagctaatatagccagatctattatgaataatggtgccattaacactcatgtgtaacttattatgtagacatttgctttcatttctcttgggtgtatacctatgagaggaattgctatgtcccataataattctatgaggaattctcaaactgttttctacagcagctgcaccattttacagtcctatcagcaatgtacaaaggttttaatttctccacatccttgccaacctttattgtctttctgagtacagccatcctagtgggtgtgaaggggtatttcactatactttttgatatacatttccttgaaggctaatgatactgaacatcttttcatgcatttattgcacattcatacatcttctttgaggaagtatctattcaaatcatttgctatttttcaactgatttgtctttttattgttcagttataaaagttctttatatattctagaaacaaatcccttatcagatgtatgatttgcaagtatcttttcccattctgtggaatatcttctcactttcttgatggtgtcctttgaagcacaaaagtttctaattttgatggggtccaatgtatctgttttcccttttgttgcttatacttttgacatcatatccaataaaccattgcctaacccaggtcacgaataattatccctgtgttttcttcaaagaggtttagagtttaagctcttatacttacacctatggttcatttaaacttaatttttgtaaatcttgtgaggtaggggtccaaattcattattttgcatgtggttaaccagctgtcctgggtctgttaatgactgttcttccctccagtgcattgccttggcaccccatcccaagtttacctcttatgcaatcacctccctagtttaaacactcactggctcacccttaaaattacctgactagtttccttgctttctatactcatcttttaatactttagtatacaaatatttaatcttttacataattctattttagaaaatgaaaaagcagagtaacgacgagcaactcattcctgaggaattcacttcatttcccaaagaattagaaaaatgtatgcattttctaagggcgagtatctgaaaactaaaaaggtgtgggtgtgttacagcagcaggagaggtgaacacatgtggttaccatctgaagctacacacctacactaatacgataagcatcagacttgtgactattaagcacttcaaaaatggctagtgttacctgaaaggtgctgacattgaaaagtgaacaattttgtaagatcaactcatcaatttttaaacttatcacatgttgaaatatattttgtgcatactaaataagacctattataaagttagtttcacctgtttttctttttttttacagtttttaataagaagactaaaaaatttaaatttacatatgtggtttatattatactgctactgggcggtgctgttgtagacctcccaagagtgactttattcgacatggttagtgtcctagggaattaagttttttggggcagaactaggtaccaagcactaaggagatagaaaacggacttaagatttccaacccttgtgaaagttataatgtagtaggagatggggtaaacaactatctgatgtacatattcaactgtcactgaggaccagtagagagatcagaatccatgaggaggcaaattctgcctgtttttttctgatataattccagggcccacaagagtacaacagtgcttggcatacagtagaacactaaaaaattacttagtctttaagaatgaatagggtttcaatggtttctagaaatataagatgaagaaaatatcttctggaaatacaaatgaaagaatgaagcatatattattctagacagtaaatagcagaaaatgttaggttctcatcaattaaatggcttttttataacattacctccaactttcataaaattgactgtcagatgtcaaagaatatggatttgtctttatttggcaatacagagtatctatactccaggttattgccaaaagaatacagtttcaaattatccccttcacttactaccactgccaaaagcccacttgctcacctcagagagaacaagctttctgattcctctgtgtttcttaaaagtgggatgccagaggccatagccctccatttcaaactgaagcctatttaaaatacgtgttagggatcccagcccagacaaactgagtaagaatctctgatgggcagggactgtgcagttgatccctctttacaataaaacctggagagccactgctctaatcagcagtcagcacactatggcccacagttggaatacagccacattcgtttgcctgttgtctatggttgcttctacaatacggctgcagggttgagtagttttgacagagatttatggtctgcaaagcctaaaatacttatttactatctggctctttatataaatactttgctgatcctgctctagatagtctaaattttattcggcatcatcttagaacaccaaacaactaagacagttgaaagtaccattctgtagcctcagagaatgaagtcaattaagttatgctttggcataactcagctcccactggcaagactttttcattgtccaaagattttaaaaatgtttttatttttaattattatagtaaacagtagttgtatatatttatgggatccacatcatacattttgatacaagtataatgtgtaacgattaaatcagggtaactgggatattcataacctcaagtatttatcatttctttgctgttacgaacatttcaattccactcttctagttactgtgaaatacacaataaattaacgatagttgccctattgtgctactaaacactgtatcttactccttctaaccatatttttgcacccattaaccaagtcttccatccctacttccctaccacccttcccggtctctggtaaccatcattctactctctgtctccgtgagttcatttttctttttttttttttttttagttcccacgagtgagaaaatgtggtattcgtctttctgtgcctggcttatttcatttaacgtaatgtcctccagtctcatttatgttgttgcaaatgacaggatttcattattttttatggttgactaatattccatggaacatatttacattttctttatcccttcatcaactgatgtacacttatgttgatactataacttggctatcacgaataatgctgcaataaacatgggagtgcagttatccctttgatatactcgtttcctttttttttggacggagtctcactctgtcaccaggctggagtgcaatggcgcgatttcggctcactgcaatctctgcctcccgggttgaagcaattcccctgcctcagcctcctgagtatctgggactacaggtgcacaccaccacatttggctaattttttgtattttagtagagacgggatttctccattttggtcaggctgatcttgaattcctgacctcaggtgatccgctcaccttgccctcccaaagtgctgggattacaggcatgagccaccgcacccaggcctttctttgggatatatactcagcagtggaaatgctggatcatatggttgctctattttcagtttttgaggagcctccataatattctttttttttttttttttttttttttgagacagagtctggcactgttgcccaggttggagtgcagtgcagcaatctaggctcactccaagctccacctcccaggttcacgccattctcctgcctcagcctcgcgagtagctgggactacaggcgcccaccaccacgctcggctggtttcaccgtgttagccaggatggtctcgatgtcctgacttcatgacccacccacctcggcctcccaaagtgctgggattacaggcgtgagccaccatgcccggcctccatgctattcttcatagtgactgtactggtttacattcctatcaacaacgtataagagttctcttttttctgcctgctcactagcatttgttattgcctgtctttttgataaaagccattttaactgggatgaaatatttcattatactttcgattagtatttatctgattagtgatgttgaccattttttcatatacctgttgaccatttacccatatgtcttcctgagaaacatctattcagctcttgtgcttcagatcttttgcccatttttaaattggatttctttttcctatcgagttgtttcagctccttacatattctggttattatctcatcagttgggtagtctgcaaatattttcttcattctgtgggttgtttcttcattttgttgactgtttgttgtgcagcagctttgagcttgatgtgatcccactgtccattttgttgtggttgcctgttctttggaggtcacactcaagaaaccttagcccataccaatgacctttagtgtttcccaatgttttcttctagtagtctcataacttcaggtgcttaatccattttgatttgttttagtatacggcaagaaataggggtccagtttcattcttctgcatgtggatgtccagtcttcccagcaccatttattgcagactgtcctttccccaatgttcttagtggctttgttgaaaatgagttggaggtaaatgtgtggatttttttctgggctctctattctgttccactggtctgtgtctgtttttatgccagcaccatgctatagctctggagtataatttgaagtcacataatgtatgtaatgtgattccttcagttttgttctttttgcccaggattgctttgcctactctgggtctttgtggttccacaaaaattttaggattgtttttccaaccctaaaacataattctgtgaagaatgtcattggtgttttgacaagggttgcaatgaatctgtaaattcctttgggtagtgtggacattttaacaacactgattccaacaatactgaatccatgaccatggagtatctttccactttttggtgccgtcttcaatatctttcatcagtgttttatagttttcattgtagaaatctttcacttctttggttaagtttattcctaggtattttattttattttatttgtagctattggaaataagattattttcttggtttattttctagattgtttgctcttggcatacagaaatgctgctgatttttatatgctgactttgcatcctgcaattttactaaacctcagttctaacagttttctggtagagtccttaggtttttctaaatttaagatactattgtctgcaaacaagggtaatctaaatttttccttccaatttggatgccttttcttttcttctcctgtttaattgctctggctaggacttccagtaccacgttgaagaaaggtggtgaaagtgggcttccttgccttcttccagatcttacaggaaaggcttttagattcccccctcatgatactagctgtgggtttatctgtctgtggcttttattgtgttgaggcatgttccttctacatccagttgagtttttatcatgaagggatgctgaattttactgaatacttttttggcatctatagaaatggacatatggttatgtccttcattcttttgatgtgatgtatcgcatttacagatctgaatatgtattaggtggttctcacattgctataaagaaatacctgagactgggcaatttatataaaaaaagagttcattggctcactattctgcaggctgtacagcaagcatgacagcatctgcttggcttctggtgaggcctcaggaaatgcataatcagggcagaaggcaacaggggaacacacatggccagagtaggagagagacagagagcagggaggtttaaacaatcagatctcatgagaactcactaactatatagtagcaaggggagatggggctaaaccattcatgagaactccactcctatgatccaatcacgttccaccaggcccctcctccaacactggggattacaattaaatgtaagatttgggcagggacacaaacacaaaccatatcagagtatgttgaaccatccttgcatccctgggatgaatcccacttgattacaatgaatgatcttttaaatatgtagttgaatttggtttaaggattttgcatctctgttcaaagatactggcctgtagttttctttttttgttgcgtctttgtctggttttggtaccagggaaatactggccctttggaatgaatttggaagtattctcttcttagcttttgtgatataattcttctttaaatgtttggtagagttcagcagtgaagccatcaggtcctgggcttttctttgatgattttctttttttcttttcttttattactgcttgctctgaaaatatttcttttttaattcaaaaaaccaaaaacaaacaaaaaacaaccaaaaaaccattcctggagggatggctggtgaggactttgattttgtcatagtctctctgtgatgaggctcagaggaaacccagctgttttcctagtacaacagttagcatattcaacaactgaagaattgtgagttatatacctctcttatctcaatgtatcttctgatgacattttctgggctgccctctcatggcaaaaaaataactgaggcacagaaagaagccaggtacaaaatggaacctacattaatcatctaaaacggcattatcataacagacttgcctgagccattacttaccacaatgaattggtatgacacttctaacaaggtcagaaaaatcagattctgttttcttaatattgaggatctttcccactttccctgagctaatgagacacaggtctgtggcaaatacatttagtattttcctacacatgaattcctaacaaaaccaagcaagagcatacaaagggaaacatactttagctaatttaaaggtgtcttatgttattttgcttattgaaaaaactgaaaaggtagtaaggaaaagatgtaatgtggtaatagcaaattgcatctgtggtctctaatgaataatctcgcttccagtaaaaaaaactatcaaaagagcttaaactcaaggtaaacaaaaggatgaaaatattaaaataagagcagaaatcaatgaaacagaaaacagaataaagaatgtcactgaaaacaaaagtaggtattttgaaaagatcaataaaattgtcaaacctctagccagactgaccaagaaataagacacaaattaccaatataaataatgaaacaaaacaaaacagcattatagaaccatccaaaattaaaaataagggaatattatgaacaatgttatactcataattttaacaacttacatgataaagacaaatattttgaaagacacaaactaccagtcaggcatggtggctcacgcctgtaatcccagcactttgggaggctgaggtgggaggattgcctgaggtcaggagttcaagaccagcccagccaacctggtgaaacaccggctctactaaaaacacaaaaactagccaggctggtggtgcatgcttacagtcccagctactcgagaggctgaggcaggagaatcgcttcaaccgcagaggttgcagtgagccatgatggtaccactgcactccagcttgggtgatacagcaagactctgtctcaaaaaaaaaaaaaaagactaccaaaaaacaaaacaaaacaaaacaaactgtaacaaggaaaaaatacataacctgaatattcctatataaaattaaagaaactgaatttgtaatgaaaacccttcccacaaagaaaactctagcaccaggtaactctactagtgaattctaacaaatatttaagaaaaaaataaaatcaattgtacatgaactctaccagaaaccacaaaaggaaggaacacgtcccaactccttgttttgaggtacagcttttccatgataccaaaaccagatataaacaatgttaaaaaaaagtactgaccaataaaacaagaatcttcacaaaacatcagcaaatcaatccagcaacatctggaatggataacatgtaaacaatcaagtagaatttatctgaggaatgcaaggctgttcaacaaacaacaagaaatccaccatatcaacagattaagaagaaaacccatataatcccagtcatacacacacaaaaaaaagcactgacaaaaattcaactttcattcatgattaaaaacaaccatctctcagtaaactaagataaaagggaacttcctcaatctaacaaatggcaaaatagaaatacaagggaacttccttaacctgataaaaggcatcaaccaaaaaaaaaaccacttactggtgaaagacagcttttacccagtattaagagtaaggtaagtatgcctgctcaccattcctaattaacaacatcctgaaagtccaaactagtgcaataaggcaagaaaaagaaataaagagcattcaaaaggagggaaaaaaactgcctctatacacagatgacatgactgcctacacataggaaaacacccaggaatctaaacaagaaagttcctacaactagtaattttaagactgcaaggttgctataaaaaaaaaaacaaaaaaaaacctgcatttctacacagtaacaaggaacaatcaaatattgaaatgaaaaaaaaaaaactatttacaatagcgccaagaaacatgagatatttaactataaacctaacaaaaatgtgtgcaggatctatttgccaaaaactacaatacattaaagaaataaaacaatgaggagataacattatattcatagtttggaatattcaatattgttaaaatgttaattatccccaatgatttgtagattcaaatgcaatcccaataaaatcccagcagttttattttctttgagggaaggaagataaaagttgacaaaattattctaaaatttatacagaaaggcaaaggagctagaatagccaaaataattttaaaaagtatttggaggatttgccctacctgatttccacgtttaatataaagctacagtaatcgatgcataagtaactggtaaaaaggcagacacacagatcaacagaccagacaagggagtccagaaatatatggtcaattgatttttgacaaagcgagaaaggcaattaaacggacaaagtataatctttcaaacaaaatgcttcttcaaaataaacactggacatctgtatgaaaaaaaaaaaatctctctgcccgtatctcatggcacaaacagaatttaactgaaataaaacttttaaaggaaaacagaggaaaaattattcttgattttgggtttggcaaagatttctgagatacaaaaccaaaaacatgattgataaaggcaaaaattaacaaactggactttatcaaaaatttttctttctttccttttgagacagagtcttactctgtctcccatgctggagtgcagtggcacgatgtcagggtcattgcaacctctgcctcctgggctcaagcgattctcctgcctcagcctcccgagtagctgggactacaggcacatgccaacactcccagctaatttttgtatttttagtagagacaggctttcaccatgttggccaggctggtctcaaattcctggcctcaagtaatttgtctgccttggcctaccaaagtgttgggtttacaggcttgagccactacacctggccagagctttatcaaaacttaaagcatgtactgcaaaagacactgtcattaagagaaagaaaaggcaaatcacagaatgggaaaaaaatacttacaaaataatacctgataaagaatctgtatcctgaatacgttaaaaaaaaaaaaaaaaaatctcaaaactcagtaacttctgtgtaccaaaaagaataatcacagagtaaaaaggcaatccatggaaaggaaaaaaatatttgcaaatcatatatttaacaactggttaatatccaaaatatataaagactactgcaactcaacaactaaaaaacaagcaacatagagcttaaaaatgggcaacagtcttgaatacgtgaagtctatgttgtattttgccgcaattttataaaatctcaataataagaaaaacccaattaaaaatgggcaaaaggtttgaatacattttaccaaagatatatggacaacaaatgagcacatcaagagatcattaatcttcagagataagcaaactaaaaccacgtgtgataccgctagatacccactgaatggcaattggtcttgctctgttgcccaggatggaatgcaatggcgtgatctcggctcattgcaacctccatctactgggttcaagtgattctcctgcctcagcctccaagtagctgggactacaggcgcctgccaccacgtccagctaatttttgtatttttagtagacggggtttcaccacgttggccaggctggtctcaaactcctggcctcgggtaatccaccagcctctccctcccaaagtgctgggattacaggtgtgagccactgtgcccagcgtttttttttttttttcttttctttctaaatctgacaatacggattgagtatcctttacctgaaatgcttgggaccagaaatgtttcagatttcaaatgttttggatttgggaatatttgcgttatacttaccagttcggcacccataatctgaaaatccaaaattcagaatgttccaatgagcatttcctttaaacatgacgtcatcactcgaaaagttttgaattttgcattttagatttcagatctgggatgctcaacccatatcaagtgctgatgaggatacgcaacaacgggagctcttatacactgccagtggtggtgttagatggtacagagaatttgaccatttctttaaaacttaaataattaccatgggacccacagcaagtcttttcctaagtatttacccaaaagaaataaaaagttatgttcatacaaaaacctgtacactagaggtttgttcataatcaatggaaactgcaaaacacaaatataccacaactggagaacgaacacacaattatacattcatacaatgaaatgctactatgcaataagagaaactactgatagagtaacatcatggagaaatcccaaatgcattaggctaagtgtaagaagtcagcctcaaaaggctacatgttgtatgagtccatttacatgacattctagaaaaggcaagaatgtacaaaaagaaaccatatcattggttaagtggacgtgaggggaccgggatgattaaaaataggtgttaagagaaagtttttgtattgaagttgtcttgtattttaattgtggtggttacatgactgtatatgcttgtcaaaactcagaactgtaagggtcaatttcactgtatgtaaattataccaataaaaacaataaaagtcttaataaaaataaatgtaatatgataaaaaaaataccaaatcattgacatcgccactagtcataaggtaagaagttattttatatgtttaatcatatgtatctgatttaaatatgctacctatcaatacatttcaaacaaaggaaggccatgttgcaggtttatgaaagttaaggttagtattagataatgatttccttcaccatttaataatgaaacattaaaaagttgactatatcttatcagaaaaaaaaatttttttttttttttgagagggagtctcgcctctgtcacccaggctggagtgcagtggcatgatctcggctcactgcaagctctgcctcctgggttcacgccattctcccgcctcagcctcccgagtagctgggactacaggcacccgccaccacgcctggctaatttttttgtatttttagtacagacagggtttcaccatgttatccaggatggtctcaatctcctgacctcgtgatctgcctgcctcagcctcccaaagtgctgggattacaggcgtgagccaccacacccagccaaaaacaactattttttaataattaatttacccattatctactatgtgcagatccaaacattcgtgagataatcaggggcagagtccagcaacatgattctttcccctttccatcttcctaataatggatatagctggtagaaatagtaagtgtaaagtgcaaggccagtatttaaatattctctctttccatacattctctaagaaagggagtaatcagtagattcagctctcttgaaagagaggaaagagaattttgagagacacttaactttacaaattggtaaagcatgaactggtgtcaacttgttccattttaaacttgtgaaaaccaaggttttcgaaggtgactgaatcacttccccatttctaaagcaagagaaaggcagaaccagaattcaaattgatagcagtctcacttcggacaaagttcttagtcccaccaagtaagaactcatctcttactactactcatctctcttctcgcatctgcaattgtttaagcaacagcttgggtcaacatgtttgaaatcaattaagtatcttttaggattttattatgcatacaacctggtttaatttcaaacttcactcccacaatggatgcatatatactcagaaaggttgaagcagtttataataatttatactaatgtacagagtcttttatctgatcactcaaaattttaaaagcaaatcactttttaagtcaggaataaaaacagcaaatactcaaaaggatatatgaaaaagtaatcatgctcacttttgaccttaataaaaaattattgtaactctaattttaaacaaaagaatatagaaaaagtttcctcctccctctggcttcctgacatctggctttcctctattgttttcaaagctgccagtatcctgagttatacacagattacttactgcaacacaaacttaccctgtgaagcgtcactgtatgttgttcccatatagctgtttcctccattgctgtgctctgataaaggaaaagaaaaacaaatcatttaccttttaagaaaatgtccttaataaggtgagcaagaacatccaacaattcagcacactgaaataccaaaattcacagttaatattagagacactctgaaaggaccttaataattatggaaagttttttgtttgcttttaagagacaggaaacgacacacaggaacttcctttgtttttaacttaatttggacagctgctctatattcatttcatgcaagctgaaatcagtattcaagctaattctgcaactttatacttagaaaagaataaaagttggagcggtattatcttaaaatatctaatggcacgtaaacatttaaaagcatctcttatgttttacaaacgaagggaaagttaaatgcctctgaacacagtaattataaatatacatgtcacaggaaaacagataaaaccattaataggtttggcaaatggctgctttaacgtcacaaacatgactactctacctagtttcagttttgctacagaattacttctcaagcttcatttataaccaaaagaaaaagaacagcttttctagtatatgtatcacacacgtagatacacacaagaaacaaaaacaaaaaagaacaatctcccaaactcccccaagaatcatcataaaataaaagcagtaagagctccaatacaggtcctgcccaaattatagcgtacttcagttttacctcctgtcatgagcctctcaatagagaggaaaataaattattattttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtacagacggggtttcaccgttttagccgggatggtctcgatctcctgacctcctgatccgcccgcctcggcctcccaaagtgctgggattacaggcgtgagccaccgcgcccggccgaaaataaattattatctaaggcaggggtgtccaatcttttggcttctctgggccacacttgaaagaagaagaattgtcttgggccacacataaaatacactaacactaatgaaagctgatgagcttaaaaaaaaaattacaaaaaaaaaaatctcataatgttgtaagaaaatttacgaatttgtgttgggccgcatgcgacctgtgaaccacgggttggacaaggttgatctaaggaattagcagtaaggaattcaaaataaatttcttttaaatggggttaattgctcttggagacttaaaatatttcagtctctcttaatgttaccattttatgaaactgggactcctaaaatgtatttacaagtaaatttaaaaaagattcttcagagttatcaaaaggtaaagtaaaaagggagaaggctaagcatgacactctcagatcactagtcacccattactataaatgcctatttcataagtgaggtctgttttctcttactgctgtcattagcatcatgagaatatgcctaccaaggtgccatgggcccattctctcctttcccacagcgactttaattgaagattaatgccattttagaaagtaagtccctataaagaaagcctgcttccctaaattcaaagcaactagattatcctgccagatgaataagagaggagagagaaaggatctctctgttcactcccatagataagaactgccaacctcaccagcatttgtttcaatcttccaatgaagtgcaccaaaacctccctttaatgagacctccactggaaacaaagctgtttttttttttttaaacaaacattgaccgggataatgcactaaaaaaaaaaattcttccatcaatgagaagcaacaatagtatgagtaaatcagctaaacatcaacagtcccactaacatacacatgataaaagtatctgcaagagttgccagtttgtccaatctcagctgatattaagaatgagaactgcttgcatagctctcagttcatcttttcttgatctatttcattaaccagtgacattgttttactgcctttttaatctttttcctatcagtccaaatggcaagtgatgtgataacatgcacttaactctctttgataacatactctatggtatgaaacagttcatcatcctctctaaggtcttaatgaacacagttttccattttgtaagaagatgttaatcaaatgggaaaatttatttaacattaaggggggagcaggttgtaaaacagcgtgtacatggttatcctaattttgtttaaacattagtagggaataaaggctcaaaggataaacaaaatgttaacattgtttatcaccttcaaagtaaagggactgtgggtgacatttttctatcaggtgttttatcttcctgctttcctttctccattccccatcagaacaaactggcaatgtattttaaactatattcacaaaatctcattcctatttgacatttcgaatacagacagtccctgacttaggatgggtcaacttgattttctgactttacgatggtacccatacaaccattgtttttcatttccactacagtattcaagaaattatatgagatattcaacactttattgtgaagtaagcttttgtgttagataattttgcccaactatatactaatgtaagtgttctgagcatggttaaggtaggctgggctaagcttatgatactgggtaggttgggtgtattaaatgcatttttgacgtaaagtattttcaacttacgatgagtttaatcaggacattgttctaagtgagctgagaagcatctgtatctgtttttccacttggcttttaggaaaatcaaataatgcttaagaggattaatgttcttattgttaattataaaaaatgtttattctcctgttagtaagcaatctatacattaaggtcttaatgtacagtctccaggaggagtgcaataagagaaacttgctttgtacaagggagaagactaaaatactaaaacataattgctctcaccattccacatcaaaatcaatatagtttttctttggaggactggaaaagtccacatctcaaaaaacttctctgttaaacatcaattatagcttgatttatctgaaggaagacctatgtagaagaaagtaattgagaatgaaacatcaaaagaagtggttaggctcttgaccagccactaaaccaacttaatccataatataagtgagttactatgttttaccactccttatctttaaaaaaaaaaaacaaaaaacagaaaaatatattcctagtttaaatgatggaccatgtcatctctctccattctctagcctttcatttgcttctgtggcaaaagtagcaaattctatccatggttgtttatataaccaggcagtactgatgaggagttctgaatgaggaatggaaggatgaacaaacacgtaaatatgtaataatgcaaatacagtaaaatgataatggtagaatcttagtggttgggattcaggtaaccatggcagactgctttcaatcttgttacgtgtttgaaagtgatcataataaaatgctgaggaaaaactaagaaatccttctagtaaatcactcagaaatcaaagctaaaattgatatgagacatttttagtaccagtaaatttattaaccactattttaatgagcattccataaagaaaaaatgttcactaatgactgagaattttgatgcattagaaaagcaaggggtgtggaggttcctttggaagaatacctaagaaacgcatggcttctggagtggagaaaggaaaaccaggtaggaggagtctcacttttcactgggagccctttgtacttttaattacattcatctattacttatcaaattatttttaaaacttaatatccttattgtaaacttgcttgtcattttctcatttcaaacatgcacaagggataactgcataacttgcacaaaaagcttctggtaaattaccagtctcaggttcaagacatttaggcttgtaggagaccaaggggaaaatgtattactcctctaagcatgattctagcactaccattccctagtaactcagacagatgctggtaaacaggaaatgaactagaccaggcataaggagaccagagccgaaaggtatcatcaactagaaacgtgatcttaattttcctcacctacacaattagggaaatgggtgaaattatctcaaatgaaaagacttttctagctccaaaattctatcagactataattccaatgaacaggctacaaattcaataattagtgaagcactgcaggcatcaaaagtgactgcaattcatggttgctggattctgagttctgcgcacatttctaagtcagcatcaactgactagaatcacaatttctgaagaagcaaaaagctgtatttcacaatctgccaagagtttgtttagtttctttgttctaagctccagctggcaaagacactactcagatcaccaactctgaagggcttcctgccaaaacttcagatcccagttctaggcagtttcactgtccttcaggactgattactgaatggggaaagataggagggcacaataactgaaaagacaggatgagcctataactgggagaagaacaaatccaaaagagaagatataaagtatactccaaatgaagaactccttaacattatctaaatacacagccagttaaattttactaaccttatggctgtaatttcaaaaccaatccatgtatcattcattcattcattcattcaacaaacatgtatcagacatggtaagtgttggggaggccaaaaaaaggtccctctccctccctaggggctcaaagaagcagctgagaacactaaatggtatttaggttggtgcaaaaataactgcagcttttgccattaaaatggcatcaaaagatatgagctttttgcaccaaaataaataacttttgcaccacatagataagagctgttatggaagatgcaaaaggactgtgtctgctgtgaagatcagagatctgttccctgagacagcaacgttttgagttcatcaagcttgaaggatgtccaggaaaaaagtggagaaagatgtttcagaagaaacagcatgtcagcaagattgtgtgatgctacacatgacgctggctttgatatgactaagttgtacaatttatggaacaaggagagagtaaaaggagagaaggtgcaagggtaccagatcacaacaggctttataatataatgccaaggactttaaactcaaatggaagacactaaagaattttcgacgatcaaatgatataagaattcatcctgaaggctgtaatgggaaaatgatttgagaaagggaaaccagttagaaagttagtgagaagtgtgggtggagttcaaaatggctcttgagtagtcaaccaagtagcagtgctgaagtcaaaaggaaaagatgtaattacccaaggactaagataaccctgtggacaaccaaaggaatttgagaagaagcagacaatgaggatacatgaaaaccaatggagctaatacaaaacactacttactgtccagagaatacaccaaagcttaagatccctcaattttttagatcaatacacctcatttatctgacatcataaaataataaaatttccacaaatcttcaaggaacaccctttcttgatgacatgcagttccccattaggaaaaccaatagtaaaggtattaagaacactctgtgaaccctccaagttccttctgtgagcaaagctgctacactgaacggcttctcattccttctgaactccaaagtgtttctgttttggtctttttggcttttttccatccaaattgaaagcaagatcatctatggagatgaggttgagccaggaacttaaggagaaggacaaggtaggtttcagtgaataaaacagatgacccctgcccttcaatgaagtttcaattacataatttcaaattgtgatcactgcaacacaaatgaagtacaaagggaatagtgctacatgttaaaaggtaaggcaaaatatgtatatttggactgatctgatgggccgtcatttaaattcccaaaatagaaatgtccaggaggtagtaaaaaagatcactctaaaataaaatgaagaagggtcctaacgatattcagggattcaacaaacttcatgaatagaagataaaaattcaggaaacataagaattaaaataatgatcaaaataagaaggcagcaaccataggataaaagtctcaatagaaatttagtaaatttagcatccaacaccccactgtattcaacactggttaaatttacaaatgtatcactgtgtccatcccttggttaacagtttaggaaacaaatgatgagatggatatgattaggaaatattagtcggaaagacagacacagtgaacctgtaattttctggttgatcaaagctgaaggtctgctaaaaacattaagttcacagataagctgctacattagctataaagtaagagtgaaagaacatcagcttaaaagttaccattatgtgtacattaaatattgagaaaatctcagtagggacagttacaaatattcttggaaacttaaaatctagagtgctttcaagttatcaaaaataaaactatttttaggtatagcatcttctaaaggttgaagatagatacaaagatctctcacaatttattcaggtagacaggaggaggaagggaatggcatagcagagatgaagagagagtgacagtcctctgagtatatctttttgcataactctctttcttagaccacagtattgtttcatgacattacccttcacagatcaaaaaattaaactattaaaaccaaaaagacatgaggggaggggaggaaatcaaaaacagaataaagacagtaacaaatgaacataactatattacagatggagaatgtaaccacactaaagaagagtttaacttttctataaatctaatattttaaaataaaaagtttaaaaaagttataatggtatagaaaaatgcagaaagataccaattttggaaaaaatatttacgtactcagaaaaaaaacttggtttcagagttgtatattttaagtttttatatatcctacaatgaacacatgaatttcataatccttgaaaactggtaaacatcacatctgaattacgaaacaaaaaatgggcaaaagtggccaggcatggtggctcacacctgtaatcccagcacttttggaggctgaggcaggcagatcatttgaggccagatgttcaagatcagcctggccaacctggtgaaaccccgtctctactaaaaatacaaaaattagccaggcatgggggcacatgcctgtaatcccagctacttgggaggctgaggcacgagaatcacttgaacccaggaggtggagtttgcagtgagccgagattgcaccactgcactccagcctgggtgacacagtgagactgtcttaaaacaaaaacataaacaagaaacagggaaaagtgatctacactgttagaagttgggacagggttacctttgtgtatgaagtaactcgaagggatggaggtgggggagcttcgggacgtaaagtaaatgttcttccttgatctgagttgtgggcaaataggcatattcactttgaaaatatatcaatctgtgtacacctatgatttgcctaatgtattatgttatttaaaaattcaaaataaagtaacctgacagaactgtaagtaatttgactgcaatggattaaaataaatcaaatatgcttccatccatccatatgcccacagtgattttaaaaaatgataagtgctggcagaactcattattttgagaaactggtacgtatagggaaagaataagatatttactctgtctttcctatacaaacagtaccagtgggcgatcaaaatagtagatgaaggagagtttctttttttagaagcactccagctaaccaatgaaaaaggaataataaaaattgaatatcatcattttgtaacacctagtgaattaagggatctacacactgatcatcaatggctgcagacatcatccaaaaacaacagaaaaaaccctgggaccgaatgccacttatgaagtagaactgtaaaaacaaacaaaaaaatcaaatctgaatctgatcaaggctctagatctgtgctatccagtacagtagccaccagccacatggggctactcagcacttaaaatgtgggtagtccaaactgagatatggtatatgtaaaatatatatatgatacgaaatatgtgatatgtattatgatatgctatgtgcaaaatatacatgatatgtaaaatatacatgcaacagtattcagagactgaatatggaaaataatttaaaatatctcacctataattttatatcattgcatgctaaaatggtaatattttggatatgtgtgttaaataaaacatgaaaattaattttaccttaaagttttggtgtggctactacattagacagaattgctctagctacagttaaccaatttacaggaaatacagtgggccaaccaccattgtaatcaccacaaggaagcaaataccaaaattcatactgttaaaatttctacaaataatcctgtttctcaaccaataaagctgcaagggaagaggggaaagagagagacagaaatgggggacctcatatgcctaagagaaatgttaaacaatcacagtaagaggacctcatcaaggaaagttgacatttaacacaattagaaaacactaaacatggctgggcgcggtggctcacacctgtaatctcagcacttgggaggccaacgggggtggatcgcctgaagtcaggagttcgagaccaggctggccaacacggtgaaaccccgtctctactaaaaatacaaaaaattagccaggcatggtggcagatgcctgcaatcccagctactcaggaggctgaggcaggagaatcccttgaaccagggaggcagacgttacagtgagccaaggtcatgccattgcactccagcctgggcaaccaggagcgaaactccgtcttaaaaaaaaaaaaccaaacacttaagtacttgatttggagtttattttaaaagtgtgctaatgataatgtagttatagtacttttaaaaaagacatcttttagagatatatattcagacacatgttgagtattccattctatctcttctctgaaatgcttcaaaccacgtgtttccgatttcagggtgaaccatccaaaatccaaaaatctgaaatctgaaatgctccaaagagaattttctttgagcattatgtcagtgctcaaaaagtactggattttgaagcatttcagatttgggatgttcactatgtactaacagatgaaaagatatctggcatttgcttcaaaataatggggaagagaagacacaatgaatgaagtatagatgaaatgagactggctgtaagttgttaaccatactgggtgacagtaatgtgggaattcattatattccccacatccacttttctataggtttgaaaattttccacttaaaagaaggtaacttgaggggactagaaattaattactgatttaggaaagacccaaaccaagaatgcagctaccatgatgccaggatattaagtagtatttccatgagctggctattccagcaactgcttcccctcccctttcagaatagtaagaaaaatgcaactagtcctggagatggattagtaccttccttctgctgctaagctgaatttaaggtggtctaacattaccagtaagtgagttaacagcattgaaaaggcaactcttgtctagaaggggtaacagatactaatcaaataatagcagagaactaagtacaggttatcataagtgctataaaggggtacacagagtttaaagcacagagttttgacctagtttctgggctctgggcaaagtccttgaggagaagagacagctatgaggtgcatgaaagatggaggtggcaaggtttccgggtagaaaaaacagcacgtgcaagagcctagtgtaggaaagtgcatctctcattcattcaaataatgttttgagagtttcctatgtactagacactgtgttaaactacacgaataactggacacaactagtatgacctttgttctcaaggagcttacagtctagcaggagaaccaaatgatcgaaaaactccatggctaaatatatagtcacaaagttaaataagtactatgaaagaaggaaaaacagtgccatgaggaactcaaagagaaagttgacaggaagtacacttgctaggaaccaaaaagaggaaagcacagtttgagaacaagaaacaaggaggaaaaagatacgatgtggctagaggggtaggcaggggccaaataatccactaggagcttactgaccatattaaggattttgatcttttactctaaaggtagttaagcagcctaggaattttaggatgagtgttcgcatgtgtgtgtagcggggcgggggagagcggagagaaactaatcaaacctggattttgaaaagattatttcagaaaaacagattgtaaggggaagaggggggtatgatacttaggaggctattacaggaatccagagggaggattacttgggtgggggtgggggggtggtgggagggagaatgtaaatggttgaaagtacggataaaacaagtagaaagacctgaggtgctcagcaaatcaaagctgaatagaacttgctaatcaaccattcaccatactaggtagacatccaaattgagccaggtaccctggatttggaatagtctttcaactctattgcctaatccatcagactaaggactgtatctcttatctaatgccattgtaataattttttcaaaagtatctcaggaacccaaggaaccttcctctgaaaccataaaacatcttgctgggctgaaactactaacctacaggctgattgatctttgtccagaaataaataaatgaatcctccttctgaaaccacaaaacatcttgctgggctgaaaactactaacctacaggctgatctctgtccaaaatgaatgaatgaatgaatgaatgaatgaatgtcttaaataatctacaggccaacctttgtccataaataaacaagtaaataaataaaattcctatatgcctcctctctgatattaaaataggcttcacttaaaatgtttttagaagacacagctaacataatagcttagtatgtgctgagcccacaatcactctgagatgggtcttgtttgcatttttacatttgcattttgtgtacagatgagaaaacagccatttagtggcagactcaggattcagattccagaggctaaactcacatataagtaaaacttaagagttgctcggtgataatcttttcagtccttattttacttgacctctctgtgcaggatctggcctgctgacaggtgaatggtgtttacacgggtgttcactttataataatccattaatgtacatttgctttatgtacttttgtacacatggcaatatatttcacaataaaaagatataaaaaactaagtcaactagcaagacttaagtcagggtaacttacatgaaaatccggatttgcaacctcttgaaaaactgggagatctggcctgtcttcttccaagaaaacaatcagctggggctgagcaagagctgcttcctttagacaaactggcttgtgctctgatggagcagtgccctctcttctggctttcatgattcatgctgcttttctggtctaagacttacctaacaccatcccatactcttctccctggtgctctcttacaacacacgaacataaaaggatgtgaatgtatgacttatagaacatgtaagtagatgtatgattacctatggcaagtaaatttaacctcagatccttcacctgtaaaaacagagataatcgtagtatctaacagaattgtgaagattaaatgggataatgcacataaaacacttagctcagtatctgtcacagagtcagcatgcaatataaggggctactgtttgttttgacacatatttctcacacttataactaaaatgtaagcctacttgccatggctactgacttgatttttataggtgatacagcatcaaaatagtgtacttctgtattaacactccagtaagtattaatactccaataactgccactgttagaaaaaaaaaatcagtaaataaaccttccttagtacctttatatgacattaccaggaaaaacttccacaattatattttgaaaggcagactcatttttgccagattcatgtatttcccctgattgtggcttttggtggtctgatcagtcaggtaagtggatatcttactactaaaacatacttcaatacttactactaaaacatactttagtatgacaaacatcttagtcataaaatatcctccaaactaagaccaacttgatttttcaagataatcataggaacaccaaaagaagcttactaccttttgctcagctgttggtactccaatgactgcctcataatgcatatctaattcttgcccctcagacagacatatacaatatttttctccaaaaagccacagaagtctaactgaaactattttctcccgaaaccaataaagtcctcatacaatggaataccatgaagtacaagaactgaatgaaaactaatgagctacagttctccacaacataatcttacaaacataatgctgagcaaaagaagccatatacaacagaattcacactagaagattctgtatgcgcaaagttcagagagtcaaaactagtgctttcagaatgcataattaggtggtaactataaagaaaaactagaaaatgagaaacctagaagacaagatacatgcaatctttgaagaagggaggatatgacccagaaaaggcatgttagggattctagcacttatcattatggacagaattttatttgctgctctctacccgcaccattaaaatgccctatcagtacagagatgtgttcactgctgcatctccagcacctacaacagtgattggtacacacgaggtaaccaacaaatatctgctgaatgtaaaattccgctttaggaatccaaattgttacatatttcacagcttcttgaaccctaaatgtaacagtaacagctagtatagtgttcatttgccttgtcagtatattcaaggagctgttaagcatataagccaattactttataattcttaatgtctccctcctattgagatattgataccaaacatatgcagaaaacacttacatcaatgtatccagattcaattcaaacatttaaaaacattaacaaggaaaaatacagaaactctgctaaacagcaagcccaggtttagaaaatgactttgtcacctcctccaacgaagaaagcacacaagaatgctctgttattacaggatgaccataagtttgctcgtatttttaagagtaaacaatgcaaatcctttgtttcttcaacaatgagttacacaattcacaaagtgatcattacagcgtatagcagttgaaaactgtaaatttctaggatcgggatcccaaacaaaatgtactcatttaatatgtgttaagctaacaaaaagaattagtcattactggtatcctcctgaattttaaaattacatactaaattaagtgagctaatcttatattaagtttaactggtgatattcagttaccagaaactgttgtacaatctccaagataatgacaattccaaaagcgtgaaaattcctaagataaccaagaagaaaaatgaacttttcagtctttgggaatttacatttttttaaaaaggaaaaaatatttcggtaagtcaaaaaaaattaattaaaccaggtatacgctaatcttatgttcctaattagaatccacagaaagtaatatcagcttctgttttacctcctttccggacatgataaactagaattgagatcattcaccagttaactcacttcccagtattttcagtatatcaactgaaatatatccgcaacacaaactaataaaaccttatctcttgatctatcccaaagtgagggccacctgagattcagtattgagcactacatatatgacagggttttgttatcacatttcaaatggtgttttacagtacaaagtttggtaacattggtgttctcatgatctaaagctgtgttcttgtggtaaaggcaatcattcagagtccatttattttcatccatgcttaggatataagataaaactccctacccacgtattccccacatactgctcattattaagaatttatctgtttaagaggaatggaaataaagcacctggctagcccataaaggagcaacctgaagccactcttctctgcaataaataaataaagatgcactctaggtcagagagagcaaaagtcttatttttattgctggcttatgcaagaaatactgcaacacaccaattttataggattaactttaaaatctgtaaactatcctaatgtctatttctttctacaagactaaaagttgttaaagtaaaaaggtttttcaagatttgctttcaaaattcagaggtgcaaagcaagttccagtcaaatattccaggaggatcattctagacataaactatctttttatttaacatatcaaaactttgctaattagaaatgactggctcattccactagcttgtcttcagctactataatgctcagtcatacacaatgctgagcacgtgaatgctttcaggcaggcctgaaatgagcaatgactgagcagtcacagatgggtggcactacacatgaatttacagctggactcatggtctttcagtaaggtgaatttttatcatatcaggggtatgtcaagtaacaggattacgtcttcaaattttccaccaaaactattatttttaaagacattttccttagcagcatggtgatctatcatatttatacacagttttattcttagaactgtacagagtttacatttggtctctaaacagaaaagagattaaagagcaagtaaaagtcagagccagaccttgtttccaggattggaggggaaaaagggagtggaactactgtactttttttccttcaaatcaaacgggaagcagtactacatatactgcgttacagccctcgaagccacagattggtttccacctcattatttattggtgtctttccttttttttttttgagacagactctcactctgttgcccaggcaggagtgcagtggtgctatctcgactcactgcaaccttggctcaactgcaaactctgcttcctgggttcaaatgattctcctgcctcagcctcccaagtagctgggattttaggcatgtgctaccacacccggctaatttttgtatttttagtagagacggggtttcggccgtgttggttgtgctggtcttgaagtcccgccctcaggtgatatgcccgcctcagcctcccaaagtgcagggattacatgcttgagtctggcaaattggtgtctttcctaataatataatgtaatttgtgccaatatataacctgggggggaagaacaccacaatttgaaacataactatcttatgaagctgtcctgaaacaaatgtaagagttgtaaaatgtagttaggattatcagccaactatataaattaaagctttaaccatgatggtctaaaatgccaaacacacacaaaaattattgctacagtgaggatcattaaaagttggcagccaaacttcagtgacttctcacaaactacagtgagtttttcacttttaaaacagtatgaagcaagtatgcattgatcagtaactatcataattaaaacactgcatcactcactcaagaaacaatccctatatgtaatgactgactcttgtcattaatttttgttcattagcttggccattttctgcagctcttaaggtttcaaaaacgttaagatatcaagaaaagcccactgtatacacaaattaactcaagatggattaaagacttcaatgtaaaacccaaaaccataaaaaccctaaaagaaaacctaggcaataccattcaggacataggcatgggcaaagacttcatgatgaaaacaccaaaagcaattgcaacaaaagctaaaattgacaaatgggatctaattaaactaaagagcttctgcacagcaaaagaaactatcagagtgaacaggcaacctacagaatgggagaaaaacttttgccatctactgatctgacaaaggtctaatatccagaatccacatggaagtgaaactaatttacaagaaaacaaatatccgtatcaaaaactgggcaaagaatatgaacagacacttctcaaaagaagacatttatgctgccaaaaaaaaggaggtatttatgcggccaacaaacatatgaaaaaatgctcatcatcaccgatcattagagaaatgcaaatcaaaaccacaatgagataccatcttacacccgtcagaatggtgattattagaaagtcaggaaacaacagatgctgccgaggctgtggagaaataggaacgcttttacactgttggtgggaatgtaaattagttcaaccattgtggaagatagtatggcaattcctcaaggacctagaaccagaaataccatttgacccagtaatcccattactgggtatatactcaaaggaatataaatcattctcctataaagacacatgcacacatatgtttactgcagcactatttacaatagcaaagacatggaaccaacccaaatgcccaccaatgacagattggataaagaaaatgtggtacatatatacaccatggtatactatgcagccataaaaaagaatgagttcatgtcctttgcagggacacggacgaagctggaagctatcatcctcagcaaactaacaccagaacagaaaaccaaacaccacatgttctcactcataagtgggagttgaacaatgagaacacatggacacagggaggggaacatcacacaccaggacctggggcctgttacccgggttggtggtggggggaaagggagggaaagcatttaggaaaaatacctaatgcatgtggggcttaaaacttagatgatgggttcataggtgcagcaaaccaccatggcacacgtatacctatgtaacaaatgtgcacattctgcacatggatcccagaacttaattaaaaaaaaaaaagcccactgtgctccacttgatacaataaatcaattcctgggtatcatgtaaatcagtgtaacagtaaaaaatgacataaatcattttcatacttacattataatttcagatagccacagcgggcaatactactattcccgagacttaacaaaaacatttaagtattcagcaaaatctaataagcatatacaatagcacaatcttaaattaaattttattgcttcctccaaaggaaaacagcttgaaaacacagaagccactgaaacttccttcagccacttttctgtgattcaaccaatgaaatcgtttcttaacaatgattcataccactttcttacacatttaaacaattctttggtgacgcagagaaccaccctaattcttgtttttcaactttctaataatcttaaatcaaatacaccagtaaacaaaattctgactgcgaacgcagacgtttatcacacatataaaaaacgtttttttcctttatttatttatttgagacagcgtctcgctctgtcgcccaggatggagtgcagtggtgcgatcttggctcaatgcaacctctgactcccgggttcaagcgtttctcctgcctcagccttcccattaggggggattacaggtgctcgccaccaggcccggctatttttttttttttttttttgtatttttagtagagacggggtttcaccatgttggtcaggctggtcttgaactcctgacgtcgtgatccgcccctcctggcctcacaaagtgctgggattacaccgcgcccggccacgttttttccttcattactttttgtttttgagacggaagctcactttgtcgcccaggctgtagtgcagtggccccgatctcagctcaatgcaacctccgccttccaggttcaagcaattctccttccttagcttcccaagtagctgggattataggcacgcgccaccatgcccggctaatttttgtatttttagtagagacggggtttcaccatgttggccaggctggcctcgaactcctgacctcaagtgacccacccgcctttattacttctttagtatcatgcacggaggattcttttcaatctaggtacatacatatttttaagtagtattctacattttcttctattttagaatttttattgctctttgtcatttagatttcctttgattttttttagcctatgaggcagaaaacatttttaaaaaatggataaccaatagtcctagcaccatacattgaacaagccactttctccaatagtctacaatattattttttaccacatattcgtagttttccaccttgctggctaaatgaacttaaaagttatcgtatctctgtgtttcaatttcttcaccaaaaagtagagataatagttcacttcatagggttactgtgagaattaaataaattgagcacttagaacaatacctgacatgcaataatactgatgatcataattactaaaagcccataaatgcacagatgtttctggacctccctggttcctgaactgacgggctgctttaaatgactgtgaatttctaacaagtttcctgatacggccttctttttccaaaattttgtcgctatcattttatcatgtaggttttcttatcaatatgtcaagttttctacaatacaacactagaagacactgacttggggaaaattagtaaattctacaacagtgactgtctccatccagaaaatacattgtttcatctcgtttattcagatctcactttatgtccttcattaagattccagtagctcaccaatatttgttatatttatttctaggtagtctttttagagaaacatttagtagtatatatcagaatttaaactgcacatagcctttgcctcggtaattccatttttaagaatctgatatacagtaatatatgtgtacagatataaaaaggctactattccaagaacaaaatcctggaaacaaatgtctatcaagaaagcaaagataatctaaacagcagcatattcataggatgacaaactattcaaccattataaagaaaaccgaatcaaaagcactggcttattagacaagagtttcccaaactatcatgctaaaacagtaacagcgagcttccaaattaatgttgcctttttttttttttttttccaaactgaaaggagggtggggaaaacaaacgcatcatatgtaaagcactgagtccagcctggctcttagtaagcattttaatcaccttcaaaaattaaatgtgacttacggaaacaggtcactgaatattatttcatttcacttattcatttatggcctgttttgctctatataaaattctgaagtggctccataatacagcatcttaaaaaaaagctttcaacttgccctttactcgcaaatgtttacaatgcaaaaaagtccctacaacgtaatatttaacgagtgatgcttttcaatatgccatacaaatctcaatactataattcaggagaagtactcctcctaccttactgtggcaatccattgaaaacgtatttctctccatacttgaaataacctcttaaaaagtgtgttgtcttgcatattaagtaccagagatcacacttcaggaacaaagtgacattctgtgtaatacggaaacaaagcctttcctcctaggaaagaaagccccagaaaagacaaataatgggagcttattttaaaaccaaagcaaaatgttgccttttatcctaaatctctggatcaagttttacctttagattgttcttcctcaatgtaaggtcaaaaggtgcaagttaaatttttcttaaacgaagaatactatatcccttaaaacaatctattcattaataagtgtaaccgctagcttctcccagccagcaaacaagcttctgtgagagttcaaaagtttcagaggcatagtattcctgctcccagatgttacgggtaagcatttcaaacaaaaatacacacagaaaaccactacctgcccaagtatctcgatactatttgaagtaatgaattgatattctttaaaggggagattttttactcctcacatttctgtattcctttgtttgaaataacaagtactattttatgatgaaaaaattaatatacaaaatgggaggagcatcctagctgtttttcaggaactttggctttttaatgtaatacacaagttagtttcaaagcaatgggaaaatgcaataatatttcagagcacataggaaaagtaacaggaaaaacgttacttttttcggctgaactcaccggcctttactaatttttaagtgctcatcttattgtccattcgtaggaatactttgtattacttgtgaaagtttaattcaagttaaattattaaatgttaaagaggttattttcaaagttaccttaaataagtaatacagcatgaaagaaaacccgacctactacgcctcacaggctgagtggagtgttttgcagtctcaaagccttatcgctggcgtgcgcataccgcagggagtgacatcagatcgaaactacagggtttcgccggggaccaaccactcctccaaagacagcagctcccggccagcaggaggtggcaccccaagccccgacccgctgagagccggcttccagcccccgaaccctcactggagccgagtttctccgcgagggacctgttgcgtgtccccgccctcagcgagccgcagccaggcacaggcgccggcagctatgcacctgcccagtacggcggccgggcgcccgcagccccctccccggccgcccccagtgcggcccgcgccgcccccgcccgaggggctccccgcggcccgcggcccgcggcccgcggccccgcgccagccctgcccaccccgccgccccggggcccagacagccgccagcgagggagggcgggacgcgggccagatgccggtgggcgggcggcgacggtcggcccggtctggccctggcggccgcggaggcgctcaccttggcggccgcagctctggcggacatcttgtctctctccagcgccgcgcgaggctcctcggacccgaaactccgcggcgctggcccgcccgctcctcacgccacagcccaaataaacatctcccgagagcgagcggggcacgggcgggggcggccggaagggcccggcccagggggagggaattcaactcggacaaaagtccgggaagcgcccgccccgcccgggtcttctccacggggcgcgcccgaccggcacctccctccgagcgcggccacccactcggcctcccgcagctttcgcagcccggccacgtcggcctcgcccggtcgcccgcccgtcagcagcacccgtggcctcccggcgtctcctcggaagccggcttcgccacgtaacttcccgggaaccggcggccgccaaggaacgcggcgtccgctggctcagccggcgccggcaactcagcggccacgcaaacctgccggcccggcccactgagcatgcccggcccggcgggggcggggctggacgaggcgaggcgaggcgaggcggggagggggcggggccgcggcgggggagggggcgggacgagcggccggggtcccgaccccaagcgcggaaggaaaagccgggtaacccaagtaacttggaagacagtttccgctgccgtgcgagtcttcctgtttgtttttatccaaggtctggcagaattcgcccccaaggagaaagcgcctgtgcaccaaagctttccttaagagacttgtccacttgctcctcgacaagccacgcacatcatggggtgagccccatgcatgagtgcggctggaaaggccggcagagccgatacccgacagttgtttccttcactgggcaaacagcatggtcacggctgtcaccgcgtgcctcggcgttgttcccacggaaggcggaatgcattttctgcaaggcgcgtcatggctttcatctccgaggagctccggcagggtcagaagcgttgctctcgttcaccggcgccgactgccaaggctgaaactggtgatgaggtcatgggcacccggaggcagcagcctgagaaacaccctagagacctgtgacatctcggcccacaccccacattagacctcaagatatatccaaagtctctttcccgcccatctagacaggaatcttgaaaagtttatttttggccatcaagattgctgaaattcttgttgaccgaacgggtcaagctgccctgcattccaatgctgtccctccaactcaaagttgggcagaaaagggtgtaaacacgtgcagtccatggtccagtttaatcagccactacacaaacttcccacaatgttgacggctttgctaaacaccaaggaacatggtaagaaaccaatcctagactcactaatctacacttgtaaatgtaaaggtcttcaaaaaatgccagaaatccttagtaacatcaatgataacatctttaaagtatctggtatagtgccacaaccggcacagaagaaatggaagaaatcataaacatcaggctttagacaatggttttctctttagaattcaactgtatgaaaagaacaaatttaacaaagaagtatgtgtaggtgatacataagtatcaattaaggcttcgaagtgccacacatcttgcaacccaaagctgtctgaaccagaaaagagccttctgcaaaccaaacccttattcctttttgttcttcataaaaatggttgaagtcatttttgttttaaagtcatgttgtaattgttttgcttttggacaaagtattatttattcttttaagaattgtgggccaggcgtggtggctcacgcctgtaatcccagcactttgggaggccgaggcgagcggatcacgaggtcaggagtttgagaccagcctggccaatatggtgaaactccgtctttattaaaaatacaaaaattagcctggtgtggcgcgtgcctgtagtcccagctactcgggaggctgaggcagaagaatcacttgaacccaggaggcggaggttgcagtgagtccagatcgtgccactgtactccagcctgggcaaccagcaagactctgtctcaaaaaaaaaaaaaaaaaaaaaaaaaaaaaaaaaaaatggtggccaggcgtagttgctcacgtttataatcccagcacttggggccgtgcgcagtggctcaagcctgtaatcccagcacttgagaggccaaggcaggcagatcacttgaggtcaggagttcgaaaccagcctggccgacatggtgaaaccccatctctactaaaaataggaaagtagccgggcatggtgacagacgccagtaatgccagctattcaggaggctgaggcaggagaatcgcttgaacccgagaggcggaggttgcaatgagctgagatcatgccattgcactccagcctgggcaacaagagcgaaactccgtctcaaatcatcatcatcatcatcatcatcatcatcatcatcccagcactttgggaggccaagaccagaggattctttgaggccaggagtttgagaccagcctgggaaacagtgagaccccattaaaaaaaaaaaattgtgattaaatttcttcatatgcaaacaccatttaaaaaggtttgggaagtattttttaattttaaaaggtggtgatgaaagacctttcacattatctttaccatttaagaagatgtgcaattgcataagctgcctagaactaggtgtggtgtctttaatagcacctaaatctagagacactatctacaaatgcactgacatttttcacttttccttatttgtcacttttacaagttgcccaatgtgtaatttaaatgctagattgcaactatttgtcactaattaaaaatagttatatatttaacagttttatctttgccatggtttaaaaaatgaaatcaaacaaaaatatttcatcttgaaaatattattctttaaaaattatatttagtatttcagtgactaatagtatcactttaaaatttttcagtggtatttttaatatctaaattaaacttcataaagtctgttctttaaataaacaagagaaggcttttatcatctgtaaaataaaggtaaaactgttgccaacaattaaaaacaaagctttattcctgcagtttattttttaggtaggtgctttgacaacaagtggaaagtataaagaataatctgaaagaatcacccatttaacaattaaagagtttatccatggaacaccaaaaaagtattttctgacttttatgcttacacacgcatgtcatcatagctcctctagatcaatatgggaagaaatacaagttaattaaggattctcatttagagttactataatgtttaaccacaaatctctttcgattgtacagatttatcttatttctgatcatctctgcaactgaacaggaaactaaaaaaccacaacacttaaaagacaacttcctgtgggatttttggtgtctgcggctcagaatgaaaaaagcattatgtgtgcaaaatctttacacattttagatagaactacttaataaaacagccttgaccaaatgaacaactatatccacacctaatttgtatatatgtatatgtatggttttaattgcaaaaaagatccttaggaaagcatatttatgttatttttatatgaactgtgagtttacgcttgacaaagaggaagtatttatttacggtagtgaagcattagacaatctcgataatgtcagagaagagaatatatacaaaatattagaaggagaagcactttatcaagatgttataacaaccaaaagtaatcctgattccactcctatgccataccattaaagattctacaaattgttacagaattttcctctgccaataaagtcatgtaacaatgttaaatgggggaaagattcttttaaggctcataatgtttctaaatttcatagaccagtaaaaattttaaaacgatcttagaggtgcaatataggagtaccaactttttaatcttataaagtaaaaacattttaaaacaaacattataaactgtatatgtaaagataattaaaatggcaaattttatattatgtacatattaccacagtttagaaatacaaaaagaaagctattaccaacaccatttcatttttttttttttaaaaagaagacataaacactaaaaaacaagtctttttaaattcaattcagtatacagaaagttattcctcgaaagaattcctcctatggggctacccttacctctgactggggctaaggtggagttttcttttttcagggtcccaaatattgcacaaccaggcaggtcggaagctccataaatccatgactggaatccaggcaggctggcatacaggcctctggctcatcccttagcggtttgtcctccattcttcacagcttctccactctgatctacactttcctatgattcctttaagactccctccccagcccaggcaaaacatctcatctcataatccatagagaaaacagacattaaggaatagaaactcccttcccttcctgccaaaacactgacaagtctaccctgggcatccgcttttcctctccatcttccccccaagggttatgaattccatcttggggggctgaccctctcagctgtgtcctctttctgtatcatcttcatcctgtccttagctaatgaattctacctctgagaattcaagcgtcttctagtgtttcccatcttaaacacagtcagggctccccaggctacctaccaaggtgtgcactactgcaggtatacaagaccctagggcagaagggcttgcagttggggtttaatgtggttgctgtcttgaattgtaaggactttcgttttggatgtgtgttttgtaagtgaaggtcaatgggaaaatgaggcacacactggggactggggcctctgctctcacagggtcctgtcgcctcctaggagggtatctgggctgcccgctcccacagctcttgatacccctgctggtcctctcccactctgctccactgccactgctgaaagggatccaagcaaggtgtggggtttaagtatgcatacccacagcatcttgagtgcacaaaagccccaaacgggcagtgtcactttctgtctggtggctgcctggctggaggcaatctcttggtgagggtgagcctttggcccagcccggattccagatccagtcatggaggtttaaggatccttggtggttaccatctgctgtgggttggagcaataggcccgtggctcaaagtccccaaaccctgtccccagcagggcattcaggtcaggaggtttgcatgaatgtcatcacagcaagctatcaggcccagcacacattagtgggaccccagggccctctgaccgtctgtacttgctctgattacccacccctaatcctctagggccccagggccagagtgttctctgggctgtttccctgcctggggatgggatcctctccctccttccagccttcccgagtctggctgtgttcagtctcttctagccggcttgaggcatcctccagggacaagccacagaatataaactgtgtaatttcagtgactccacatgagttaaatattctgaaatttgcatttaaaactggtgttgcacaatataaacagtaaaattcatgctgataattcacatttttaattgttctttactctgaacatgaaatagtgcataaaaaacatgacaagtcaggatggaaaccctggaagaaaagaaaaagctttaggtgtacctttaatgacacttttttcctccctttgaaacaaagggcccctagattatagaggcagctctgagtccacctcttcctgcagatactgttctgtcagtttgtgacaagcttctcaagagtcgtctgccacaactaggtctttctgttgtgaatgcatgcccaggtcttttggcattcttccccctccccactttaatttcacaagtaatactggcatacagtccttctgtaaaagattcatgcaattgatatattttttaaagtccaacagaacaacatccactgcattcccattcctataattacccaggaataccatgatctaagcctaactagagagtgtatttctagatcactttctgtatatttatttacgtgatatgtatgtgtggagacagaggagagagagaatatatgaatataagaatgtatggttttgtgtgttttaaactaatgatagataatatttatattccataactttttaatgtaatatttcaccttggagattatatcaaataatgaaaatctgcttcatcattttaaaatggctgtttagtattccataatatgggtgcattatagtttatcaaactaagattatttctattataatgtcacaacaacaacaaaaaaatatatatatatctttttgtatacatgtataagtatttctctaggagagacatccaaaaaggaattattttctggattaaagaatatgcttacttaaaaaaaaatttcactgatactgccaaattgccgtctaagaaaaccagatcagcttattttgtttcctcctctccccccatatgaacacttgataatattaatcttttatagtttcacctatctggtagacaacaatggtatatcatttgcctattacatcacttacccattttgctctctcaggttatttcttttaatttgttaatgtgttctttggaactgaatgaattgagtcttttttttttttttttgaggtggagtcttgctctgttgcccaggctggagtccagtggcttgatctctgctcactgcaacctccacttcacgggttcaagagattctcctgcctcagcctcctcagtagctgggattacagaagcctaccacaatgcctggctaggttttttgtttgtttgtttgtttggtatttttagtagagacggggtttcaccatgttggccaggctggtctcgaactcctgaccttaagtgatccaccgccttggcctccctaagtgctgagattacaggcatgagccaccatgccgggccccaattctaagtcttggctcttggccggctctatgtgtgtgtgttaagtacaatttgtttcagaataagtttagctttacagaaaagttgcaaagatagtacagagagttcctgctgacttcccctaatattaatatcttgcataactatgggacatttgttgaaaactaaacgattaacgtgggtacagtataattaaattgcatcaagttctgcctgttttaactctttaatttctcttatatgcttccaattttgccaattcctcctactttccaaatgtgaaaactattttggacatgttactttcgagcctctggactttcataagcttaggtgtgcgagggtgcctggaggaggcagagagcataaatacaaagtcacatagagggtccacgtggagtttcacatttctgattcagttcaggaaacttttttcctcatgctcacctttatgaaagaactgctgtgagacatttctgagcctcaaacactaaggggagagtagaagaaatttacagctctttagattagtctgtcctcccaagatggcagggagtgccaaattcattgccttaaaaaaaagaaaaaaaaaaaaaaagatttcttaaaagcagcagaagactcccccagagtataatgtttgcatttttttacaatgtgtgtgttataaaacctttataataagtctttcaaaacaaataaatgtaaaatacagaaaaattagtagaacttgctaaaacactgcattttaaaaagaggtaagcatactttttattttaaaaatgttttaaaggacgataaatacacatctgtaaaaagaaacactggaaggaaaactaagaacaagtaataatggttacttttagaggagacagagggcagcaatgatatgagacttttctagatatgccctataaaccactttggctctggaaacaaaaattcttacattaaaaaaaaaatacaatgaaatttaaaaaaaaagccatctctaaaagctgaaaacaaattgaagaaagaaaattaatttacattaaatcagtgacctaactaaatagataaaagaattatttccaatgacactagcatattctaatgaaagtggcactgtaaaaaaatcttaaatttaattcagtagtcttttagtaataacactattactctgaaactgctctatatgtgtgtatgtgtacatcaactaaaactgttacatattcattagcatgtcatctaatatgtaattacacatgtcagaataatattatttatatgataaatgtataataattatatataatgtattgtctaatatatgatgtaatatatattagtacattttacgtctattagcaattaacacacatcaatttatatgaacattaccatactatgtatataatagttttgaagctacatataaatatataagaatttcaaagtaatattaacattattatatattagtgtataataatgctaatattacatattattacactaatatatattaatgtgtgttaatgttgttagaaaccaagattttctgtttaagagaaaagagaaacaagtataaaataaaaaaagttaagattttgcaattctagtttaagttgaaaaactcagcattaatttttttttaatataatgcctagctctggccattgaaaaggactgggagtaatggaaattcaatagcaaggagtactcctaatgtccgtattgtaatctccaactaggaacagctgattacaggtctggagcaagaaatatacaagataatattgggacattttgggccagaaagcaaggaagttctcaaagaataatgagtcaaaaggatacagaagccaacaacaagtagctcttattggccaaagatgatacaatttgatcctcaaaagaaaagaaacaaacaaaggaagaaaagaaaaagaatgcacctgactgaaaaaccctgaatatctaaaacccattaattcacaataacaaaaaagagcaggaaagcaagagagcccccaaaacaaacaataacctattgaacacccctggataaaacttgggaaccaagtccgtactctgtaagctgtcaattaaaagaggagaaagaggagaatatattttgtatgaactttatttcagatagccaaataactctaattgctgagggaaagtttttcttaataaatctggaaggaattatagaaaatcatcatcctgtactacttaatgaaataatagattcaggcagtgatcatcaaaggatcaaatgatcaatcttagcatcactgaaggcaagacaagcaaacatttatgcctcccatgtgaggcaattggaagcacacagtagtatctatgaaggattcctgccaaaaagtgaaacctgaatgaaatccagtctacagggctaatgtgcataaacagaaatacaagggaaggaggtacaagttaaatgactccaaaggcaagctttacagacggatgtgggagggcctatataggaaaagagaccccattttaaaaacaagttaataaaaaagaaaaggaaaatgggactgctgtggattttatgtggatttcttttcaaatctactcactgtaaaacgacattttaaagacaactagagaaatttgattatggactgagtgttagatgggacctagatgtgacaatggcatcatgactacataaggaagggacccctttttaggagatacatgttgaaatatttacagttgaaatgacatgtttgggatttgcttttaaatacttcagcaaagagaaaaataaaaaatagaggcagcaaatgcggcaaaatattcaaaattggtgaatcaggcgatgagcacatggagggtttattgtattattcatctttctttggagtatgtttaaatgttggtgtacatttgacagttctttatcacgcaaatcaacaataacataaaaactgaaatatttctgtcagctaaaataggtagactgtaaataattgccatacattattcctgtccctgtttggatgtgccactgtggctcttctcatcaacagatggagtcttttcttccatcccttgaatctggtcagcagtgagaactgctttagttaaagggtaaacatgacacaagcagaggcttgaaaagcactagggcattggggcggctgagagccctgggcctaccacaggagaagttcagactagcttgctggagaggtcatgtggaaaagaaatgagaccctggctgagggtctgccaacctgtagacatatgagtgagggaattgtagaccacacagccccagccaagccacaaactgactgcatctgcagagtcagcccaggcaagtctagctgtctgagccagatttgccgacgcacagaatcatgattgttttttaatatgctaaatactgaggtggtttgttacatggcaatgactgactgatacataaggataaacctatagaagtactatacacatatgcagaaaactgtcttagcttcttagcactgtgagggacatgccatgtactcaataaggatgtctgaatgggaattccatgtcactagaaaatggtatatatggaaactgtctaaaggcaatggaaggcttaggtagactacttccttttgtgtatatgaagtactatcaaaccaagtagttactccactgatagaggcagatgtgggaagataaactatgtagaactttttttccttggaagactaaaaaggtctggctttgccgctggtcaactatgaccagacactacggaaacagtcattgagattgctggcagatggcctggcctttctcccctgacacaattctgcaacccaagtggccagtgtgtggagagaacacacatccctgtgagaggccgcctagcttttcctcccctaagggccacactgggccaccccagcacacatcaacttggctggcacactttcctgcaaagcagattccactctgtgtactctgagaacaaatcatgtttcctccttgccaaaggtttttgcttgcaaatgttggatccaggtataaggattaatgagggaatatttagagtgccacaaaaaaaaagttctatatagaagccacagaagtacatgtggatcttctagtagaggtattttttactaaaagaaaataccaaaacattttcatcttaaaaagctcaagtaaatctgatcaatttagcagaatcacataatttgtaataatatacgtataaggattgtgtagttaatcttagtatcattagcaaaatactatacttgtaaaagaaaaattcaagatagttaaatatttctccataatagtagctatttaattggaaaattttttgttttctttgagacagtctcgctctgtcacccaggctggagtgcagtggcatagtctcagctcactgcaacctctgcctcccgggttcaagcaattctcatgtctcagcctcccgagtagctgaaattacaggtgcacaccaccacatcctgctaatgtttgtatttttagtagagatgggatttggccatgttgggaggctaatcttgaactcctgacctcaagtgacctgcctgctctaacctcccaaaattgctaggattacaggtgtgaaccaccacacccggcctacttggaaagtatttttaaattaattgatactttaatctttgatgaatatagctattctcagtatattaaaatgactactcacacaacgccacccacatttacatgctaatttatccaacctcctcatttatatttttaaagatgcaatataatttttgtaagtatatatatatatatatatatatattttttttttttttttttttgagacggagtcttgctctgtccccaggctggagtgcagtggcgcaatctcggctcactgcaagctccacctcccgggttcacgccattctcctgcctcagcctcctgagtagctgggatacaggcgcccgccaccacgcccggctaattttttgtatttttagtagagacagggtttcaccatgttagccacgatggtctcaatctcctgacctcgtgatcggcccacctcggcttcccaatgtgctgggattacaggcatgagccactgggcccggccgtaagtatattttttaaagcttaagaatcttgtgagtaaatagggattttttttttttttgagacaaagtctcactcttttgccaggctggagtgcagtggcgagatctcggctcactgcatcctccacctcccaggttcaagcaattctctgcctcagcctccagagtagctgggattacaggcgggcaccacccgcccagctaatttttgtgtttttggtagagacagagtttcaccatcgtggccaggctgttcttgaactcctgacctcacaatccacctgccttggcctcccagagtgctgggattacaggcatgagccaccgcacagccggcctgagatgttttatactattttgcagtagcaaacttctatccagtaaatgtttcaagtatctttttgaaccatgactttggagttaacattattcaatgaggttaatgacacaaaaagataattaaatatggtgaacggaaagaatggacagtaaaagctaagaaaaattggtggcagcttcattatttgtgaaactaaacttgaaggggacaaattaaaacttgcagctgagcttcaagtgcagcaaaaaccggcagaaaccagggtccccacagggattctgcgctttggggagaacttctgttcttctgctcctgttttgtcctgttttgtctttctgaaaaggcaacacaaagagctgaggaaaagccaatagattcattatcattctacctaataataaaataatgttctcttaacaaagtgtggacacacatggcgaaggcatcagaaagaacctgatggaaataatctggaaaaggtcttttgggaatgaagtttcctcatctgcagaatggaggaggggtaatgagaggggcttgttgggggccaggagaagtgggctggatgaattccaagatcctttatagctataactttcagtgatctaggttaaaagctgaagatctttttcatccctgactatgaggccaatgtgagatgtggttatctgtaggtcttacagtgcttattataaaactatatattaatactttgtttccatgaaaagctctaattttaaatgtgggtaattttaaatgtgattaatatttccataacggagtgcatattatatgaaaatcaaaagttttataaaagctgggcacatttaaaaacatacaaaatcccagctcagcttaagtatatggttgcaagagtgtgtgttttcaaagggtggggcttcctgtctctggattgtttggaaacattctgacaaagccaaattcatttcactgatatcctgaatgcagcaaggaactggtgcctaaaatagcacaaaattgcctgtagtcccagctactggcgaggctgaggtgggaggatcacctgaccccaggaggttgaggctgcagtgagctatgatcgcgccactgcactccagcctaggccacagggcgagaccctagctgcaaaaaaaaaacaaaaagcacaaaacatgatactctaacatgtagaatcagtttaagtcaactaagaaatgtgataaacacccaaaagatttcaaatctgtattctctaaatccttttgagagagtctccacaattagctggactggaaaacttagcaacatttagcatacttttcggtcacatattcattcattctttttttaactattcaacaaataggtaaatagatggacggggaaagagagagagagagagacagagagagacagagagagagagaggagatagatacctcttactacatgccagaaacaatttcttttaaaatttttccagtttttttcttctttaacttcatactccctttgtctcctgtctttgttgggtatgattattcaagaatacatttaacttgtggcactaaatccagagcactctctaatagggagaaaacacaaccactgtggtgtcaggaggaggaagtaaatgtgtgagcagcttggtacactcttcactatcctcacctcaaaggaaatacagaggtggatcaggaagccagtttcaactggacttactgctgcttcttgctgacactattgttacgttatctgtgggatgatcaactttttttttttttttgagagacagagtcttgctctgtcgccaggctggagtgcagttgcacaatctcagctcactgcaagctccgcctcccgggttcacgccattcacctgcctcagcctcccgagtagctgggactacaggcacccgccaccacgcctggctaattttttgtattttagtagagacggggtttcaccgtgttggccaggatggtctccatctcctgacctcgtgaaccacctgcctcagcctcccaagtactgagattacaggcctgagccactgcgcccagccgggatgatcaacttttaaagagtcaacctgggacacagtgataatgacaaaaaccataacaacataacattgctatggtctgaatatccccccaaattcatgagttgaaacttaatcaccaatgtcatagtattatgaagtggggccttcagaggcaactaagtcatggagacagagccctcatgaatgagattactgacctgataaaagggctggagggagagagatcacccctttttacccatccatcatttttctgcctctgtcatgtaagaaaacagtcttcctcccctctagaggatacagccacaaagtgccaacttggaagcagagagcagccctcaaagacaccaaacccactggcgcagcccccttggaccttgcagcttccaaaacagtgagaaataaatttatactgtccataaattacccaatctatgatattttgctatagcaacacaaatggactaagacaaacataaaagaagtaattacacatgtgttactgctttaacacagaaaagatgtggaggtgaaatatattattctgtattatttacttttctgtaacataaatgttattatttaaacagaacaacaatagaactagttaatgatagtaattaatagtagaacaaattaagcaatgtgtgagaaaaatataacaatacttttaaatgtttctttctgttctctgatacaggagtttattttaactatttttttaaaaagtcttcctagcactttggtaggctgatgcgggtggatcacctgaggtcgggacttcaagaccagcctgaccaacatggagaaaccccatctctactaaaaatacaaaattagctgggagtggcagtgggtgcctgtaatcctagctactcaggaggctgaggcaggagaatcacttgaacccgggaggcggaggttgtggtgagccaagatggcgcccttgcactccagcctaggcaacaaaagagaaactccgtctcaaaaaaaattaaaaacaaaaagtctctatttgttatttaaattttgtaggctttatatgttgtgtattcttaacacatataaatgtacgacttttacaaagaaaacataaatacaacatggctaatttaaaagatagtacctatatttagtaacaacagcaaaagatcatgtcctgtttctttctgccccatgacacagtgggatatctttactctttctgtttccttttccaataacacttctttgaactgcctgcagtggtaagacatatctcttttgacttgcacctctgctcttctcaagcgcacaatacactgattcctggtatcaatccaatgtgatgacatcaagctaaatatcctctcaaaagcatctgagtgtggaatacctataattttatttcctagcaagaataggattttagacttaggaggattcatttccagctctccaaaaatgtccatccctttgttaattaggttgttagcatctataaattcatcacataggctacacatatataaaatatccactgttctataaaaccttttattttgaaacaatcgtagattaacaagaagttggccaggcatggtagctcacgcctgtaatcccagcattttgggaggctgaggcaggtggatcactggaggccatgagttcaagactagtctggccaatatggcaaaaccctgtctctactaaaaatacaaaaattagccaggtgtggtggtgcacatctataattccagctacttgggaggctgaggcataagaattgcttgaacccaggaggcagaggttgcagtgagctgagattgcaccaccgcactccagcctgggtgatggagtaagactgtgtctcaaaaaagaaaataaaacaagaagttgcaaagaaatgtacagggtagtacaagctacccacacccagcccctccaatgtgaagaataccttacataactctagaacaatattcaaaccaagaaattgacattggtacattccaaacatgttattcagatttcacctgttatacatgtactctgtgtgtctgtgtgtgtgtgtgtgtgtgtgtagtgtgcacagctctctgcaactttatcacaatgtagtctttcttgtataaccataaccaccaccaccactgagggatttaactatgccttcaccacaagactctctcatgttactccttacagcctacacccatcctctctccccagtccctaacccctggcaactactaacctgttctccctctctataattatgttacttcatgaacattacataaatggaaccatacagtacgtaacctgctggaattatgtttgttcatcaccgtaacttccttgaggtttatacaagttgttgcatgtatcaatggttccttcctttttatcagaatagtaatccacagtaaaaattcaccttttttttttttttttttttttttgagacggagtctggctctgtcacccaggctggagtgcagtggtgccatctcggctcactgcaagctccgcctcccgggttcacgccattctcctgcctcagcctcccgagtagctgggactacaggagcccaccaccatgcccggctaatcttttgtatttttactagagacgaggtttccctgtgttagccaggatggtcttgatttcctgacctcgtgatctgcccgcctcagccttccaaagtgctgggattacaggtgtgagccaccgcacccggcctaaattcacctattgaaggacatttgagtggtttccaaatttcttgctattataaaaatagtggctgggtacagtagctcatgcctgtaatcccaacactttaagatgccaaggtaagaggatcacttgagcccaggaattcaagactagcctgggcaacatagtgagacctcatctctacatttaacagtttaaaaattagcagggtgtggtggtgtgcacctgtagtcccagctactcaggaggctgaggtgggaggattgagcctaggaggtagaggctacagtgagctatgactgtgacactttactccatctttggtgacagagagagaacttgtctctaaaaatataaataataaaataacaagaaaaatattatacgaaaaccgtgaaactgttatgaacattcctgtacaaatccccatgtgaaaataactcttcatttctctggaataaatgcctaagaattgaaatgataagttgtatggtaaattcatttttagttttgaaaggaactaccaaattgttttccagtgtggctgtctcattttatattcctaccaccaatgtaggagtgatccagtttctttgcatccttgccaacatatgatgttttcactattttttcactctagccattctgatttgtgtgtaatgataccttgtggttttattaagaatttgcatttcttcaaaagctaatgacattgaacagcttttcatgggcttacttgccacctgcatgtccccttgatgaggtgtgtgtgtcttttgtccagtttctaatcagatttttttaaactattgagttttgagaggtctttatatatttatgtgcaaggactttgttgaatatgcgatttgcgaatgcagtattttctctcatctagtttgttttttcatcctttcagcagactctttcccagagcaaaggttgattctgatgtgttctaattgatcagtttttcctcttatggattgtttttggcatcaagtctaacaggtcttcacccagtcctaagtcctctctcttatgaattttctagaagttttatagtttcacatgtaagtttgtccatcatttttaaacactctgaagagatgttattaagttaaacgtctctttctcaggttgggcaagagggaagaaatgtaggtgaggatagacgaaggggcgataagaaagggtgacggaagacaggctcggcagactttcccgtgagagaaatgctccagacagcaccctgttcctccaggagctgaatcttgggcatggattctccctaccccatccccgcccatcctgcccacaacactgccccaggacacgcctcctgaggccaggcagcctccatctttatgtggccaaagggggtctaggtagttgtcagcttcagcttctggaaagagaccagctgctgtatccagtgggtcccagtggtttgcttagataggatgccactcactatgccaggtgtttgggatagaagaaagaataactggaaggtctcagtattcaaagaacctacagtccagagaaggacacaaaataagaaagaagagagcaagggctaagggtacaggtaggagagagaagcagaaaaggggagcataactgagacttcgggaaggctttcctaggagatagcactgtagatgtgtggctatctgaaattgcaaactgtgaaccagagaataagagttcctgcatttcaaagtccttgaagtagatttcaaagggtaccagtttgagggctgctcttctaaaaataggacactggcatttcccatgagcaacaagaactcacaagaaggtggaatgtgactggataaggctgacaacaaggggaagcaagcctgacattctccccaccagcctggaagtctgggccttagcaaatgtgaaaggctagggttcaagctgaaaccccgtgtccttatgtaacctagacgaggctgcagtttagttgggctaggctacggccaaaagcttaccaagcagaaattcagggggaaaatatttcagcaaaaatatttaacccactgaaaataatttatacttgttcatatgtttacaaacaacctgctgattaaaatggctcttaactactcattaaaaggaggcccacccttcaggacctatactttgcaacacttagttactatttaattggagatacagtataagcaaaaatatgaaaaggctgcatttctttatatgctataattttactttgtgatgattctaactttctctgccctcaattagtctgatttagtgatgtcttgtcatgtataggctataaaatcctgatgctgtttctcaacttgccagtcagaatagcaggattaataaattctcaagatttttaaaagatcaaaattggagcccctgtttttttccttccttcctcctcctccctccctcccctcctttttccttcctttcttccctgatttttagtaacatttatcataaaaaatacaacctatatatttcttgaccataacttacatgtgattgagaagcatcgaattagagtttgtggtctctgtcttccaatatcttgtatgtactatacataataaagttggttcatcatcataactggggctttttaaagccagaaccccatcaagaattcccataagtaggaacatttccagaagtggtagggtacagtaagattttttgatctgctggtaaacgctgacggggatacccacttaggctattttattttgaaagagcgatgaaaatttgagcaaatgatagcttccagatacagtaagtcctcacttaacatcattgatagagtcttagaaactgccactttaagtgaaacgacgtataacaaaagcagttgtatcataggttcattgatataaacaagagttaagttcctggagcgtatttctggccatgaaaacatcaccaaacttctaaataaaagccccaaacgcttctaactattaagcattgaaataaatgtgagctatacatacatttaagaaagattaataagaacaagtaagatagctatttactcaattcttccattatcaggaataattaattgagtctgccagatcgtgtcccaacagctcagggtgcaaggagggaaccaaccctggacagtatgccatcccccaccgcaggtgcacccacacacacccacactcacactgggaccaagcagacaccatggttcacctcacatgcacggctttgcaatgtgggaggaaaccagagtacctgcagaaacctacagagacatggggagaccatgcaaactccacacagacagtggccccgcgccaggaattgctttctagtcaatgttgtaagaaaatgacattgaatgaaatgatgttattcaagaacctgctgtaaaggaaggccaatatatgatcagaagtgcacatctctaatgaagaaatcaggaagagccattttgctttcccttaaccctgctgcccccaggtaacaatagtaagtttccttcagttacccctttcttttccacatagaagaaggaaatttcacttttgaaatgttgaattatcctgttttcacgcaagcaaagttgcataatggtcttggctttgccagctacatggtgtctacaggtggacaaaatgcctatttctgtgtccttaccaataaaaatgggataatcactgatttttttaaaaagtcattgctataaagattaaaacgaactcctgtatgagaaagtaaataaaaccactaaaaaatatgagtaaaaatgctcattttgtaaccaaatgattctttatgtcccttttattttgtcctgctatttgctattgattgctgttcctatctttgacttttctttctgttttttttcttttttcttttctttttttttttctttttttgagacggagtttcgctcttgttgcccaggctggagtgcaatggcgcaatctcggctcactgcaacatccgcctcccgggttcaagcgattttcctgactcagcctcctgagttagctgggattacaggtgcccaccaccacacctggctaattttgtatttgtagtagagacggggtttctctatgttggtcaggctggtctcgaactcccaacctcaggtgatccgccagcctcagcctcccaaaatgctgggattacaggcgtgagccaccgtgcccagcctacctttgatttttctatcaatgcaaagttggaggagttaagcaaccattcctaagatgaagaaagttatcttctagaccaaattcaattttcagcagtaaggaacagacaaaaaatcctcttcccctgccccacagcttccattgtactagaaaaacacagacaacaaataaaacaaataagaaaaatatgtgaaatgttcaatggtagtaagtgctagagaggaaaaactaagtgaagaaagtgaaggaggaggatagggcatctgtggggaaggcaggggacggctcaatctatggattcaggaagggtgtggtctgcgtgctcccagtgtgagtgtgggtgtgtgggctggaagaggccagggagtgagtcacatgtacatccaggaaaatgcttccaggcagaagggacagtaaccacaaggtgggagaggccttgatgtatctgaggacagctggagatcagtgggctgaagcagagtgagaattgaaggggaggagagcaaagaagcagcagagctgggctagggtgggcagagcaccagagtgactgtttttttgtgtgttgttttgaaacagagtcttgctctgtcgcccaggctggagccttgagacggagtctccctctgtctcccaggctgcagtgcgcggctcactgcaacctcctcatctcgggttgaagcgcttctcctgcctcagcctcccgagtagctgggactacaggcatgcatcaccacgccggcggatttttgtattttagtagagacagggtttcatcatgttggccaggctgatctcgaacacctgacctcaagtgatctaccctcctcagcctcccaaagttctgggattacaggcatgagccactgcacccggcccacagtggctgttctaacagaaacgctgctgctgtgcagagaaggaaggcaagagcaagggtggacacaggccagtgaggtggcaccagcagtgacccagggatgaggtcatagcagcctggaccagacagcatcagtggatgtgctgctggactccagacacatggtgaaggcagagctgacaagatgcgagggtagactggatgcatggtatggagaaagcggggagtcaagattttttatctgagcaactagaaggacagcacagccatctagtaagatggtaaagacttctggaaaagcaggttttggaggctgatgtcaggagcaagtttggggcacgttatatgtgagtcatgtattacatatccacctagaaatgttgagtaggcaattggtgagatcaatctggacttaaggagaaatattcaggttggaggtacaaataatcatcaatttaagatgctatttgaagccatgaggaggggctagctcacaaagcagggtgcagataccaagaagagatccaagaccaggctttgggcatgccaatggtaagaggtttgggagaagtggcaatggtgactaagtttgagtggacagtaagacagagtatggcatcttggaagccaactgcagaacatgtttgaaaaaggaactgattgaccgtgacctgtgtcaaatgctattgttaggctaagaagatgataacagaaaaatgaccaaaatggatactcccaagccctcaaacaaagtatgctaaagcagtttttaatgttttaataaggtcttaagtttaagatgagaatttgcacaaatatttatatcctctcctaaatctcactaaaatgaccctaaaaataagaaaggataaagacaatattggtcaggctatgtctcttcctctctcttccctaaactctaaacagatgctgggattaattcaaagatggattttccagcttaaactgactattcatcccaggaaatccagaggaatggaagccccagagatacaaaaggaaatacgaaacctcccaggactccagcaggtttgtgaggagataacaatataggtggagtgacaagaagacacacataaaaagtcaagcaaaataaagaagacaaatgtcaatttacaaaataaattgtactggctgggcgcagaggatcacacctgtaatcccagcactttgggaggcagaggcgggcagatcacgagggcaagagatcgagaccatctggccaacatggtgaaaccccatctctactgaaaaaaaacaaaaattagccgggcgtggtggcaggcgcctgtagccccagctgtcgggaggctgaggcaggagaatggcgtgaaaccgggaggcggagcttatagtgagctgatatagcgccactgcactccagcctggtgacagggcgagactccatctcaataaataaataaaattaaattaaaaagttgtactaataatctaacatagttttcactattctattacaaggcagcagagagtgctggctcaccagtggccagggggaggtcaacattcacatggattaccatgagcttctcaattcccagtcttatctccattccctctcagctacacatatgcatgggcacacaagggacttctccatcatcccaaactgcctcctcccccaactcactgcactcacacctcctaaccacacacacttaactcctatctttgcgtctttcttctcttgcctcctgacccctccaatgcattctctacactgcactcaactgatctttaagagacccatcaccataacctctcctgcttataatcctgcaaaactgaagcccacatccttaatatggcctacagctcctgcagatcagaccttcctcccaggcttgtccaatgtctttccattcactgcgatagccccagtgagggtccccccagttctaggatggcaccatgctccttcccagctcaggccctgcacctatgctgcgcctttcattgccttctccaccagtgcctgacatggcacattagaaagctttcggttaataactacttctctattcacttgctgatttgatatcagggagttacacacaagagaagggagacctggataaaagggggaaatgacaagcagagagagcaaaatgatcagtttattcactcattctagacatattgaagaggttagggaggtccaggtaaattggagcagtggaaatcttaaagagccaggggtcaacatatcagccctacaaaagaaaacaaggggcctgatgcggtggctcacgtctgtaatcccagcactttgggaggccgaggcgggcggatcacgaggtcaggagatcgagaccatcctggctgacatggtgcaaccccatctctactaaaaatacaaaaaagttagccgggcctggtggcgggtgcctgtagtcccagctactcaggaggctgcggcaggagaatggtgtgaacctgggaggtggagcttgcagtgagccgagatggtgccactgcactccagcctgggcaacaaagcgggactccgtctcaaagaaaaaaaagaaagaaagaaagaaaacaagggctgagatcaaggaaaatggtctgaatacatatcaatgcctgattcaagtaatgtttggaagaaatcagtaaatatttattgaacacttactatatgcaaagcaacatagtacaaaacgatacatagtttacttttgtttacttgtttatttaatttttttgagacggggtcttgctctgtcacccaggctggagtacagtggcatgatcacggctcactgcagcctcaaactcctgggctcaagcaatcttttcctctcagcttccagagtagctgggaccacaggtgcgcaccaccacacccagctaatttttgtatttttttgtagagacgagttttgcatgatgcccagccaagaaccagccttttgattttttgcttttttcttttgttttcctatttttaattctattaatttctgctctttattattcccttcttttgcttgctttggctgattttgctctcctttttctaggttcttgaggtagtaaattaggttactgatttgatgccactctacacttttaaagtaagcacttgggctgggcccagtggctcacgcctgtaatcccagcactttgcgaggctgaggtgggcggatcacgaggtcaggagattgaaaccatcctagctaacaaggtgaaatctcatctctactaaaaatacaaaaaattagccgggcgaggtggtgcgtgcctgtagtcccagctgctcgggaggctgaggtaggagaatggtgtgaacccgggaggcggaggttgcagtgagcagagatcgcgctactgcactccagcctgggtgacagagctagactctgtctcaaaaaaataaaaataaaaataacataaataaaaaatagagtaagcggttagtgctattcatttccctctgattcactgctatggctgcatcccacatattttgaatatgttttcaacatatgtttttatttccaattatgtgtatttttacattttctttgagaaaactttctctttgacccattgattatttagaagtgttgttttatttccacgtttaaagctttttcctgttgtgtttctgttactgtttcctagtttgatttcattgtggcagagaacatactcacatgattacagttattttaaatttcctgaggcatgttttatgacccaagatatgatcaaatatggtctttcttggtgaatgttccatgagtgcttgaaaaaaaaaaagtttctgctgagggttgggttactgttctgcagatgttaatcagatcctcttagattgtgttgttcagatcttctttccccttgctgatttactatttagtatttctcagttgctgagagggtgctgtgatcctcaactataattgtgggcttgtctaggtctctttacagctttatcaatttttgttttgtgcatttttgaggctatggtgtttggtgcatatgaacatttatattttaagtatcagttatattaagcatatcttaaaatgctgaaaactctatttctagatattatctatgtagacagcctgatacattttatagtagtaacagaggaagttgactagagacaaatttaaaaataaaactttcagtatagataatgcagaaactattggctgggcatggtggctcacgcctgtaattccagcactttgggaagccaaggcgagcggatcacaaggtcaagagattgagaccatctggccaacatggtgaaaccccatctctactaaaaatacaaaaattagctgggcatggtggcatgtgcctgtagtcccagctacttgggaggctgaggcaggagaatcatttgaaccagggaggcggaggttgcagtgagccgagatcacaccactgaacaccagcctggcgacagagtgagactccatctcaaaataaaaaaaaaaagaaactattatcccaacatattattttctgtggttttttttaaatatatggagaactgatggtgctacgtttttataaaatactctttttcacataagataaatagaatatataataacttgctgacatatcatcagtaaagacttctaaatgataatgtaacatctctgaaacatatcttataaacaagagaaaaaaagagtagaaccaaaatgaaactttaaatttaattacattaaaattaatgttttgagtaggttttgttgaataactagtaggcttgacccttggctaaaaaataattttcttcacgaaatctacatacagcacttctacctttcttatatttgccacatttcattttgtgttatagttacatgtatgtttgttttaatagtattactacattgtttgtacacagccacatgtatggtatgctggttttaaaacatatatttacaaagtcttagatactcagcaagtggagtttattccactcaccccgcaccccccactgttttaatgtgggcttagtgactcacttctttttaaaaacaaattttatttaaaaaaaaaaaaaaaagaccaggcatggtgactcatacctgtaatcccaacattttgggaggctgaggtgggatgatcacctgaggtcagcaatttgataccagccttaccaatatgacaaaatgctctctactaaaaatacaaaaaaattagctgggcatagtggcatgtgcctgtaatcctagctactcaggaggctgaggcaggagaattgcttgaacccgggagtcggaggttcggaggttgcaatgagctgagatcgtgccactgtactccagcctgggcaacagagaggactccgtctcaaaaaaaaaaaaaaaagagacaaggtctcatattgtccaggctggtcttgaattcctgggcttaagtgatccacctacctcggtcttccaaagtgctgggattgtagacgcgaaccaccacgcctggccattagtgactcacttctaacaaacagaataaggcagaagtgatggcgtgtcctgcagatttggtcatgcatggccctgtgggttccttgttctctcttggatcactcgctctggggaaagccagatgctctgtcatgagggcattcaagcagcaccctggagtggtctatgtggggaagaactgaggcctcctgccagcagccatgtgctggagttaacctgagagcagatcctctagccttggatggaccctggatctaaacctcacaccttatacaaaaattaactcaaaaacgtatgacacttaagtataggtgcctgtagttctggctgacgtcttgactgcaacttcacaagaagtgctgaaccagaaccccctcaactaagctgcttctagagtcctatttattgtgaggaatattattttagagactttgtgaaataataaatgtttatttttgtttgtttttgtttgatacggagtctcactctgtagcccaggctggagtgtagtggcgcaatctcggctcactgcaagctccgcctcccaggtcctggtttaagcaattctcctgcctcagccacccaagtagctgggattacaggcacacgccaccatgcccagctaatttttgtatttttagtagagacagggtttcatcatgttggccaggctggtcttgaactcctgacctcgtgatccgcccaccttggcctcccaaagtgctgggattacaggcatgagccaccgcgcccagccaaatgtttattgttttaagccaccaacttttgttatatagcaataaataaataaataatgaaataggctgggcacagtggctcacacctgcaatcccagcactttgggaggctgaggtgggcagattgtttgagcccaggaggtagagaccagcccggggggtaacagagcaaaaccctgtctctatgagaaaaaacaaataagtaataaaataaaatataggctgggcacagtggctcacgcctgtaatcctagcactttgggaggccgaggtaggtgaatcacttgaggccagtagtttgagatcagcctggccaatatggtgaaacgctgtctctactaaaaatacaaaaattagctgggcatcctggcatgtgcccgtaattccagatacttgggaggctgaggcaggaaaatcacttgaatccaggcggcagaggttgcagtgagccaagactgtgccactgcattccagcctgggcaacagagtgagactctgcctcaaaaaatacatataaaataaaaattttaaaaataaaataaattatagaaaagaccagctctttagggaaaaaacaataaaattgataaacctctagcaagactgacagaaacaaaaagcaaggaaacataaaaaatattaagactaaaataagggatatcactacagaccctacagtcgttattagtataataaccaaatactataggcaattttatactctgaaatttgataactcagaagaaatgggcaaatacctcaaaaaccacaaatagccaacacggatgaaacaggcaatctgaatagccctattaccaatttaaaaaaccaatatctaatttaaaaactcccaaaagataagtttccagggccagatggtttcactagagaattctaccaaacatttaaagaagaacaacgccaataaaaatccttgcaagatatttgtagatatagacaagactattctaaagcttatatggaaaggaaaagaaattagattagctaaaacaattttgaaaaaaataaaatggaagaaatcagtcttctggatttcaggacttattatatagctatgattaagactatgtagtattggcaaagggatacatataaagatcagtggaacccagaaataatcctatgcaaatatgcctgggagccaggcatggtggcatctgccttctacctatatcatatatgtccaactcttttttcataaaggtgcaacagcaattcagtagaaggatagccttttggataaatggtgctacagcacctggacaatcacaggcaaaaaaaaatgaccctggatctaaacctcatgccttatatgaaagttaactcaaaatgtatgacacttaagtattataaaattataaaacttttaaggtaaaaaatgagaaaatctttgagctctcaagctaggcaaaaatttcttagacctgacactaaaaggacagttcccaaaaggaaatattgataaactggacatcatcaaaattaaaaattttttgttctgctaaagagctgtgatgaggatgaaaagacaagctacagaatgaaagaaaatatttgtaaaccacatatctgacaaaggactagaatatacaatgaagtcttaaaattcaactgtaaaaaaacaaacagcccaagtaaaaaatgaacaaaagacagacatttcattgaacaggatattccgatggctaatggaccacaaaaagacattcaacatcattattcctcagagaaacgccaattaaaaccacaatgagacatcactgcatacctgtcagtgtcatacctatttggtgacagcaccaagtgtggagaggatgtgaaaaaattggatcacttgtacattgctgggaatgtgatatagtacagccactctggaaaacagtttagcagtttcttaaaatccaaaacacgcaattaccatacccagcaattgcactcttaggcatttatcccagcaaaataaaaacttagggccgggcatggtggctcacgcctgtaatcccacactttgggaggccgaggtgggcggatcacctgaggttaggagtttgagaccagcctcaaaatggagaaaccccgtctctactaaaaatacaaaattagccaggcatgtggtgcatgcctgtagtcccagctactcgggaggctgaggcaggagaattgcttgaacctgggaggcggaggttgcagtgagccgagatcatgccattgcattccagcctgggcaaccacagcgaaacttcatctcaaaaaaaaaaaacaaaaaaacttaggttcacacaaaaacctgtacacaaatattcatagcagcttaattataatatccccaaactggaatcagcccagatgttcttcaataagtgaatggttaaactgtggtattcaccccatggaatattactcaataataaaaagaacaaactattgatacatgcaacaacttggatgtatctctaggaaattatgttgagtaaaataagccaatcccaaaagtttcattctgttttgggttttaaattccatttatagaacattttaaagtgataacattttaaaaatggaggatagatcagttcttccagcatctggggaccagtagaggggctggaggaacatgtgtgtgattataacaaggcaacatgagagagtctcctggtgttggaaacgttccatatctcaatccgatagtagatacgtgaaccaatgcaggtgatactgtacagaacttaatatgcacaaattcaaataaaactggggacatctgaataagatcagtggattaacatcaatgctaatatcctggttatccttctataaaatattaccatttggggacattggacaaagtatacaaggcacttctctgtaacaattctcataactgcatgtgaaactataaataaaaaatattaaagatgatgtgaacagagatacacacttttaggtggctgtatttttccccccacaggagtcatacttaacacaatggccaagctataaaaattgaatgagaggaactgatgtcctagggttacttatcaacatatctaaagtaaaataaatacaagcatagtttttaaaatttcaaagctctataaaatgcaattttacaaggttactaaatgtgcttgttttcaggatcctgaaggcaatttcctggtatcaaaacccacatatcctttattgagaatgacttgcacaacactattctgcattacatgggaataaaatgatgggtggttttttccgagagaacatatccaggagcaacgacgcacctgcagttggagcagatagtcgctatactttcaccgcatcaccactagatttccatgaattctgcatgagaaaactgtgactgatatgtcagttttttcacttagtttatagtacacgcaaaaataacatggccagtctcttgccatgttatttccaaagaaaattacttggaaaatatacctttcaccaaactctaaatccatgtgcaaaatgtaatattttatacaccatataaaaataccaaaaaacatctagcagtaccaaatcaagatgagacacaagagagggatcctatgcactggtagctgcaggatggcttctgtagtaagttgtatggtgtggtctccaataagatatgtcctaatcccagaacctaggaaggtgaccttattggaaaaaagggtctctatagatgtaagttaaggatttggggctgaagagatcattccagattatccagatgggccctatgtccaatgataaatgtccttataagagggaggcagaggaagattggtccgagacaaaagaggggaacgtgatgtgaagagggagggaaagattagagagatatgaccacacgtccaggaatgccagggcatcaccagaagctgggagagacaaggaacacattctcccctggctctccctcagggcgtgtgaccctgccagattttggagttccagccttcaaaactgtgagtaaaactatttctattgctaaagtcaccaagtgtgtggtgatttaggatggcagccacaggaacagtttgactcccttcacccggagtacaatccacgcacctgccaatcaaagcaacaaagtatgaaaatcactactttaaaaactcaagacaaaagaaacctcaaaaatactagcttatgtaaccatgagaccttcaaactggccttgaattcagaataaacaagaaacagccaaatagaaagctatcattgaggaggggaaaaaaaaaggttagaaacaactaacttttaattctgttcaaagagaagcagtactaccaagatatcaaataaataattcctttaattaataagcaatctgcaaagaatgagcataaaattgtgaatatgagttaatttgatacttccactgtataccagaaacactactttaaaatataatggaaaaaacactcctttcacaaaagtaatgaaaaatatgaaacatagtttcaagaagtaactttaaccaaccttgcatggacctatatgaaaaaaaaataaacagcttttattaatcattgtttatatcttcaagaacacttgaacaagtgggacctgcttggttgttgggtagaagattgagtaactgtaaggtacaagttagtctcaagatgctgacaagtttgacacatgcaaaaaaagtcccaaatatattttttgagtgaagttaatcaaataactccaaagcacaactggtatgaaaatctagtgagatcacaacacaaacaatagataaatgtttgaagttatagatatcccaattaccctgatatgatcatgacacattgtatacatgtatcaaaatagcacgtgtagctccaaaatatgtcaactattccatatcataattaaaaaaataaagtgagaaagaaaagatttattaacacttatagccaggtgtggtggctcacacctgtaatcccagcactttgggaggccaaggcaggtggatcacttgaggtcaggagttcaagaccagcctggccaacatggtgaaaccccgtctctactaaaaatacaaaaactagctgggcctggtggcacgcgcctgtaatcccagttactcaggaggctgaggcacgagaatcgcttgaactcaggagatggaggcttcagtgagccgagataacaacactgcactccagcctgggtgacaaagcaaaactccatctcaaagaaaaaaaaaaaagacttataaagtaaactaatgggcatagtgatgacacggtctgctaaatattaaaacaggacataaaggtacacttattaaaacgtaaggaacaacatacagctgcacgaagcatatgtccatataggaacttgtatgcaaacattcacagcagcattatttcataagagccaaaaagcaaaaacagcacaactgtgcttcagctgatgaacagataaataagatgtggcatatccatacaatagaatattattcagtcataaaaatgaatgtagccaggagaggtggcatgcacctgtagtcttagctactcaagaggctgaggagggaggatcacttgagcaccgggcaacatagtgagaccctgtcactttaaaaaaaaatgaggctttcctctttacttctacaggtattgatacataatacaatacaacatagatgaaccttgaaaacattctactaagtgaaagaagccagacacaagagaccatatattgcactattccattaaaatgttcagaacagataaatccgtgagacagaaagtagattagtggttgccagagactgggggaagggggaatggggagtgactgctaatgggtatgaaagccttttgggtgtgatgaaagtcttctggaattatagttatatttttaccttgtatcatgtcaagaaataaacttcagatggagtaaagatttaaaaatagaaaataaagtcatgaaagaacagttggacctccgtatctgtgagttctgcatccgtggattcaactaacaacagatcagaaatatttcttaaaaaaatatgtgggtgcggccaggtgtggtggctcatgcttataatcccagcactttgggaggctgaggcgggcagatcacgaggtcaggagatcgagaccatcctggctaacacggtgaaaccccgtctctatgactgtgccactgcactccagcctgggtgacagagcaagactccgtctcaaaaaaaaaaaaaaatgtgggtgcatctgtaccaaacatgtacaaactttttttcttgtcactatcccctaaataatacaatataacaattatatacagagcatttacattgtattacatattataagtactctagagatgatttaacatataccagagggtatgtgcaggtcatatgcaaatattattcaattttatataaggaacttgaacatccatggattttgatatctgaagggggtcctgggacaatcccccatatataccaagggacaactatactataagaaaataaagaataatatttctataatcttatattggggagtccagtctaaatatgacatggattagagaagttataaaagacatacagacttaagcatataaatatgacaagcttccagaagatgagagacttcttgaatggatactgttttttttttttaaggatgtttctatttacatatcttacccatttcctgtttagaaaaaaaaaatgcagctcgctgccagcacacatttctcagggcaaacaggaaatgggttaaaaggcctacgtatgtagtagacacctgctgggtggtctcctgattcaaccattctttctcttatattacgtggatcgggcctcaagccttggtcatctttcttcttgccacatggacaagaagcgcagggaaggcctttttacagacaaataagaataaaatatgtatgtgaagagggcagacataaatgatgcagaactgaatactgatgtcatgcaaattctctgttccagcctttttccaaggccaatatgcattcttgcctttggggactgggagacactccaatattcctctatgggtttcttctcttacttaaaagatgtttaaatgagtacattttattatatttaaaatgactccattttttgagatggagtttcactcttgttgcccaggctggagtgcaatggtgtggtctcagctcaccacaacctccacctcctgggttcaagcaattctcctgcctcagcctccggactagctgggattacaggcaccagtcaccatgcctggctaattttttgtatttttcgtagagacggggcttcaccatgttggccaggctggtctcgaactcctgacctcaggtgattcacccgcctcagtctcctaaaatgctgggattacaggcgtgagccaccgcacccagcctaaagatgaccccatttctttaactcagtaattctgccttcaggactatggaaacaggccagctgtggtgtcttactcccgtaatctcaacactttgggaggccaaggtggatggattccttgagctcatgagttcgagaccaacctgggcaacatgtcgaaacttcgtctctataaaaaatacaaaaattagccagatgtggtggtgcatgcctatggtcccagctactcaggaggctgaggtgggaggatagcttgagcccaggaggcagaggttgcaatgagccgaaattgcaccactgcactccagcctaggcaacagagccagaactcatctcaaaaataaaattaaaaaatatggaaacgctgcaggtataaatattaatccaatgattatatactgagtccctagtatgtgccaggcactgtttaaggccatgtggatacagtgcttctgaagacagatagccactgaagaattattgctttccttttttttgagacagggtctcactctgtcaatcaggctggagtacagtgccacaatcacagctcactgcagcctcaacctcccaggctcaatcaatcctcccacctcagcctccgagtagctgggactagctgggcacactccaccgtgcccagctagtttttgtattttttttgtagagacagggttttaccatgttgccctggcttgtctcaaactcctgggcctaagtgatcctcctacctcagcttcccaagtagctgggactacaggcctgtgccaccatttttgtatttttggtaagctaatttttgtatattttttgtttttttgttttgccatgttgcccaggcttgtctcaaactcctgggctcaaggcatcctccagcctcagcctcccataacgctgggattactagtacgagccactgtgcccaacctgaagaattatttctagcaatagaaacctcttagacagatggatgtccaataactgaggattgattgtggactatttaagtgacattagttacattaatgttacttaagcattaacatgctatttgtaataacaaggaaaaagtatgttattttgttaagtgaaagaaacgattaacttatagtttaatcataactatataaaacattttaaacctatatatagaacaaaaggtcggaatgatcaaagtgttcgcatctattatctttgactgatgagacactatggtagtatcttctgctgtagaaaatatccaaattttctattataagcaaacctactttggagaataaaataaaacaaagtcaaatattaagaagagctttgggaaaacagaacccaaagtgcaaggcatcagagaggtctccatcatctgattatgaaatcttggactctgaccccgcagcaatctaccagaaactctaggcaacaaggatgggacttcccaccccatgcacagaggtggccccggtaagaaggcagagtttgacagtcattgtgggtgctcccacccacagctcctgtcaggaagtggctgtgaaaccgggttcctcagagccatcgtggttctctggaggtaatctgggttggggagtggctggaggaagtaaataggggtccagcttcctttgccttctcagcctggtcctctccatcacaggtagctttccacaaactctaagttgaaaatacaagcagcttcttccgagaattgttcttgctctctagagaattctcttcattaacgctgttagtatcccttgactggaaggcaccatagcatttatgtgtaattcctgaatcacctccatgattttcagatattttaggaaccgggatgttttcctcaaatgaaatctcctgtgtatactcaggataaaagtgaaagaggggagaaaaggaaaaaggaggccttgtgctgctgtgaaacccaacagctctgaggaaccgggttcaaagccacttcctcaaacaggagctgtgggtgggagcctccacattgactgtcagcctctctgcattcttactggggctacctctattcaaggggcaggaatgcccagaccttctgcctagagtttttggtggattgtctgggagtcagagcccacagagtctgctgccagacctgaccacatcccaaactctgactcaggagtaagcgctttctttctctccccctggaatcctgtttcactgtttaagtgttattgcacctccccttctgcactcctgttccctggttccagggagcagaaagtaattacaggacacctatgctgtccattccgtcttcaagtagtccagaggcacccttggatttgcacagttatacttaaaaacccagaagacacttcgcccttgccctaggatcaccccctcaactccctagtccctggcaatcattagtctactttctgtttctacaaatttgctcattctgaacatttcatataaatggaatgatacaatatgtggccttttgttactcacttccttcatttaccctgagttttcaaggttcccccatgtggtatcacatgtattaatacttcattactttttatgggtgaacaatagtatggatatactatggatataccacattttgtttgtctatttttcagctgatgaacaattaggctgtttccatcttttggttattaggaaatgcaggcatacctcattttgttgtgctttgatttaatgagctttgcagacactgagtttcttaaatggaaggtttatggcaaccctgtatctagcaagtcgacaggcaccatttttctaatggcctgtactcaccttgttagcgtttcttagcaaaattttaaaattaaggtatgtacattgttcttcttacatgtaatgctactgcacacttaatagactacactatagtgtaatcataacttttatatagactgagaaacgaaaagaattgtgtgattcacattattgcaaaacacaacatttgttttatcatgatgttctggaatggaacctgcaatatctcaggtatgcctgtaatgctgtgaatatgcatgtatgcattttgtgtggacatatgttttcaattctcttgggtatatacccttaggaatgaaattgctggttcatatgacaactcttatgtttaacatagacctgcaaactgctcaggaactgcaaattattttccacagcaatgacactattttacattcccaccagcacgcatgagggtcccaatttctctacattcttgccagcacttactattgctcttctttttgattacagccatcttagtggacgtaaagtggtatctcattgtgattttgatttgcacttcctgacgattaacccatttatgagggaggttgcaattttttgaattgcagacgtgtgaaaaatcagaccttggtgatgaccttgagcagtaggatataaataactcccacaggtttagcattccagtagtggaacgctaggcataaatgggattcaacgatactggcatcttttcatgtgcttattatctatttgtatgttgcctttggagatatgtctactcaagtcctttgccactttttaattggcttgtcttttttttgttgattcataagagttatttacatattctggatattagacccttttcagatataggatttgcaaacattgtctcccacactgtgggttgtcttttcaatttatttattttgtgatggggggagattagggaatacgaagaatgcctgttctctttactgacggtatcatttaaagcacaaaagttttaaatattgatgaagctcattgtacctattttttttcttttgtcacttatgtttttggtgtcatatctaagcaaccattccttaatccaaggtcatgaagacttactcctgtgttttcttctgaaagtcttacagttttagctcttatgtttaggtctatgatccattttgagttaatttttgtgtatagtatgaggaaggggtccaacttcattcctttacaggtagatatacacttgtcccagcatcatctattgaattctttagttaagaagcactgaatcctagtccaacatcttcattttacagataagaaaattttggcccagaaagatcatgttaaaattactttgtgttgagaataaaagaaaatacatctgaaagaagatataccaagtcaataataataacaacaaaaaaagaacatacagagaaagagaaaactttttgtttctgttcttcagaatttctaagtccagtgagagaggtaaacagtacaacatgggatgttcaggactaatcacagaaatatacaaagtgggggtgaaatcatagagaaaagcctgcttaactgcctggtgatttaagctaagattcaccagggaggatcattctaggcaaaacaaacaaaaaaaaacccctcgtatacaaaagcctctcagctggaatgttatgggaagtgtacatgtggcaagatcttaagttgaggcaaaaggaaagcggagtgatgggagccaaagctgaagcagacttggagccaaacaccaggctgcatttgcccttgggaggtaggcaataggtttttttcttttcttttttttttttttttttgagacagagtctcgctctgtcacccaggctggagtgcagtggtgcgatcttggctcactgcaagctttgcctcccgggttcacgccattctcctgcctcagcctcccgtgtagctgggactacaggtgcctgccaccacgcctggctaatttttttgtatttttagtagagacggggtttcaccgtgttagccaggatggtcgcgatctcctgacttcgtgatccgcccgcctcggcctcccaaagtactgggattacaggcgtgagccaccgtgcccagctggggatcggtttttataacaaggcaatgacaccaccagatctgtgctttagaaatctgattgcttgtctgggcacggtggctcatgcctataatccgagcactttgggaggccaaggtgggcggattccctgaggtcaggagttcgagaccagcctggccaacatggtgaaacccccatctgtactaaaaacacaaaaattagctgggtgtggtggcaggcacctgtaatcccagccacttgggaggctgaggcaggagaatcgcttgaacccaggaggcggatgttgcagtgagcccagaccgtgccgctgcactccagcctgggcgacaaagcgagcctttgtctcaaaaaataaataaataaataaatctgattgcttgcaatatggacgatggtttgcaggaggtagaggctggaggaagggtttaggtgattcttgcaaaaggtcatgacaagagcctaaaaacagagtcctcagctcacaacgagttctcagatgcggctggcagatatgtgttgtttggctagaacagtgtttttaaagcatcttgaattcctgattggggaggaggcagaggcaagctctctctggggtgtcacaaccacaacactccctctttaggctcgcccaggcagaggcacccatttatgttaccagcctggccctggtaagcatttcagttgcaacctacgcctaaactaaggcagtgatgatgtagacagagaagagcacatgtactctcagcacaatttagaaagtgggctggcagtgctgctctttggtggtagagaacacagggtgatgttcgtctctggacttcaatgtgcctaactcacaccccatcccccagaatgatgacaaagcttttgctgaacttgctactctgaacagtttgccctcctggttcatggcctctcatggaagtaacaaaaagtacatagtcttttaaaatgtcttgggagctgtgttttctttcctgctgaagctttgtaaagtagaccttccaattctctaggaagcaaaggttcttttaaaccataggcttcaacttcccaaagttgtttaaggattctggtgctagccaatgatacagtattacttttgtcttcaactggtatctttcaaaggatttatatttctcaaaattaaaaagttgtacccggccgggcgcggtggctcacacctgtaatctcagcacttcgggaggccgaggcgggtggatcacaaggtgaggagtttgagaccagtctggccaacatagtgaaaccccgtctctactaaaaatacaaaaaaaaaaaaaaaaaaaaaaaaaaagctgggtgtggtggtgtgtgcctgtaatcccagctacttgggaggctgaggaaggagaattgggtgaacccgggagtcagtaccctagttccaagacaatattttattttcttttgaacttcattcactcaagtctttattcagagtgtaagttcctagagggtggggactgtgcatctcatttagcttagtaactcaagagcttaacaaagttcctaacccatggcaggggcttattgagaattgtacaggtttcctaccgtcaacactgttatctattagctcttttcagcttcagttacctgcaagcatctgggccgggttcaactgcaaaaggatctcacccatataagaggaaaaagggcagtagaggaaggaacctggaagttgacctctgcacatttctggatcttttttgtggtgctggcatgttgtgggcctggcaggaacaggcttccagttcctgtctgtcttatcactatctccacctttcttatcagttagctacgtggggggctttctgtcctacagatcctttatacttggcacgcttttttcttggccttactcagtactgagggtgaacatttgtatgctactatttattttaagtgttttgctttataaagacctatattctgttggtaaaactgttttctaaaattaaaacatatttattgataataaaaggcaaaattgcagctaaattttcttcttctgtgggagtgacacactaagagtacccttccaattctgtgatttgaaggttcaagaaaccacgaacgttcctgtgagccaaaagctttataatttgcttgagttgaaaatctacaagtgaattttaacaggataagcaatccgtaacaggaccaggaaactattcaaggacaagaatagactgtttttcttggttttagctacacaaatcaacaccaatccttctgataagacgagaattactctttcaacagttaccgacagtagcaaatgccacgaagatattaacaaacagcaccaatttaaagcctaagagcatggggaatgcagctggtgattcttacaaatgttaatgtaaactctgcagtttattccactccacattgctaaaaattttaccctgccaggcccactgcaacctcaaaataatactcttcccaacataaagggctgcttcttttaacttctccagagtgatttttacaaggaaggaaagttgccatatctctaagaccctaggggagtttagaatatgatcaagttccgaagaagtgcatttttgatttgtaaaaattattttaacaaatattggtcaaatgagtgaactgcattcatgtgcataaatatgtagaacatctgcaaacctctcacatgcatccagaggaatactactctcctgaggaggcttggagcaaggaggcctagcaaagatggacatgcaccgagcaatgtgcgggatctgggctggacaccatgataaatatcaaatgaaccagagggtccattaaaagctggctggagaaaaaagtcacataaagcgaggtgaatgtggaaaagtgaggggtgagttaagacaagctgaaaagctaaagaaatagaagtagagtgtttaagagaaacatgtacccagttttattgagatcaattcaaatcgccaggcactgtgctaggagacagggaacacaagctatttaagagaagctttctgcccttgattgtaatgagacagaaataaatctgcaattaacaatcataaaggcatactttcatcttgggcacttggaagaaaggaaacatagagctgacataaactttgatgtaaatgcagctttaagcactttttctttttctttcagtgatatggcaccttctccttttcaaaaatagcagcatattaattctctgttaaatcttttctttgaaatttgcgtttatgtctggcatgattttaccccatgtcacctggtcctgctccccgcattcttgttccttctggcaacacccacccaaatttcaacacatttttccgtcacaaatttagcattagcttaagtcattaactatatttacagcttgtcttcatccttactgaaacataaaggatggttgcaataaacagtgtgttttgtttatgaagaaaaatgtccattttaaatcagtctgcttgaatacatcatttctgtatttgaacatggctttggcagatgcagggaaggatgaaaactccacactcactggaaaacaaataggcagcattcttcattttattatgtgaactccccacacagtatgtcatgtggaatttgtgtgggattttatttactatatcacaaaagctgtccttactgtatatttatgcagaaaaaaaacaggctgcttttatgtaagtcaaatgtcacatcagaaaataataccccggaatgtctggaaagtattctggtgtttttgatccattaaaaaatataatttgtctttcacaacaacaaattaactgaaggggtaaggtatgtttaataaaaaataacgaggccgtctggctggagaccgagctgtcaggaacctggagaaggagatctgcaggctctttccaggggccgccctaacctgagacaaccaggaagacagcgggatggcccccagcacacaaggacccacaagagccaccgtcaccctgagcactcagaaagatactcagactgagcctgagcgcgtcttcactcagttccagtttcattcacgtgggtactcaaagatgcctatgcttccagttgtttctgtgttctctgtgttctcctgcagaatccattgaactggacttaagacatttatttcagacaaataagataaattatgtagtatataaaatgtaaaaggtggaaagagcaatttctgactgacacaggaacattcctggacacgagaaaattcaacccatcgatgttgagcgagactcagaccagacatgctgtttgtggctaatattagaagtcatttaactgtcaaagcaaatggcactttatgagcaagaaatcaactgaaaaaaatgaattatttatggttttgataaggtcataaccatcacaaaaggcaacaagggcaaaacagtaaaactgtctgttcaagtaaaagcagccctccctggaagaaggtaacttgcttcctgtctcactttcacattgggccttgctggctccaacgtggcccatgtgtgctatgtcaggggaagtatttctttcccttgccactatgtgggagcttttaatacagttctcaactctctatgagctccttgggtgtgtatattcccttaaaaattatctcagtgtgtaaaaaatttgttttaaaaacattttaaagaagaattggctgggcatggtggctcatgcctgtaatcccagcactctgggaggctttgggaggacatggcaagagggtagcttgaggtcaggagtttaagaccagcctgggcaacacagtgagaccctgtccctgcaaaacattttaaaaattaaggctggacgcagtggttcatgcctgtaattccagcattttgagaggccaaggtaggcagattgcttcagcccaggagttccagaccagcctggacaacatagcaagaccttatctctacaaaaagtacaaaaattagccgggtgtggtggtgcatgccagtagtcccagctacttgggaggctgaggtgggaggatggcttgagctcaggaggcagagaggttgcagtgagctgagatcacaccactgcactccagcttgggtgatagattaagattctgtctcaaaaaaaaaaaaaaaaaatcagctgggcgtggtagtatgcacctataatcccagctactcagaggctgaggtggaatgatcgtttgagcctataagttcaaagttatagtcatgttttgtgccattgcactcagcatgggtgacagagtgagaccctctctcaaaaggaaaaaatcagcggcaatagctcctaattccctctttgtaattttccgggcattaaaaataactggtcagttaggaggtggctaactctgctcaatggttgtgcaaaagcttaggataaaatacagaaacaggagctgaggaggcttctttcccttttcagtgttgtggcttcatataaaatctacatgtgagctctaatactggtccacgcatgcctgtgtggctctcagcgttctagaggccaaggctaagctcactataatataaatgaataaatgaatcaggactgttgagttctcctttcaatccccaagtcaagcacagtgtctaccacataatgtcaaataaatatttatggaaaggaagaaagggaaggaaaaaataaaccaagagaatgaaacagttagatcatgaatggcgctggtatccactgggttcccgtatttcttaagaaaatgaaccctctaaacaaaatagcccaagttttaagtttgttgaaacttcccttaaagatcagttctggggacataagagaaagattttgctactgctaacaaagtttgcaaaactttgaaaagaaaggttttggcacaggcaaaatctgaaaagagtaataatgagcagaaactggccctagcagacagataataaatcttcacattctgaagcttccatattaaaagtgtggaactggagaagaaataatcgacacagctcaatggatcacaacaacaaattaaaaatatataagggaatttcattttctataaaggtatacaataaaggtatattatattattataaaggcagcatttcaagaaaagagattgcttaataaatgtgtttcatgcaactaggtaaccatctgagaaaaataaagccagattccgatctcactccttataccaaaattaatttcagatgaatcaagttttccaaatgtaaaaatgaagccataagagaaagcgagggtgaacagcgaatgtgtgagtaatctcaaaggggcatggtctctttctatgcaggacacaacagtcaaacaaacaacaaacaggaaaaatatttcaacacagctacaaagggctggcttccttaatttagagagatactgtttatttcatccatcacactggcaaaactctagggagggcctgggaaaacatttactgagatactattgaagggagtgtgtgttagacgtgacatctctgggagatttggcagtgtttatcaaaatttagaaaacatgtatctcagcaatccctgagccacaaataatttatcctaaactcccactacccaaggttctgcactaaggtccagattccagaagaagtaatgcaatcccaagttcatccttcctactgtggtcaaggttaaaccccacaccccacgatgtgactgctgaggcgacttatcagtcccttgaagccaaatcagacaggcaccttacagacaccgcatcacccgctgccctgttccacctgccaagggtctgtgcctcctcactagactccagcatcttgaaggcagaacgatatcctttcccctgtctttctttctttctttctttttttttttttttttttttttttttttgagacagagtctcactctgttgcccaggctggagtgcagtggcgcgatctcggctcactgcaacctccacctccctggttcaagtgattctcctgcctcagcctcccgagtaggtgggattataagtgcccaccaccacgtctggctaatttttttgtatttttagtacagatggggtttcaccatgttggccagactcaccatgttggccagactggtctcgaactcctgacctcaggcaatccaccaccccgccccccaccgcccagcctcccaaagtgctgggattacaggcgtgagccactgtgcctgtccctttcctctttctaatatcacatttatatagcccagagcagaggctcaaaataacattagatggatgaacaaataaattactgaatgtgtaaatcagataaactagctagctagaagtactagtgggcaggttaaagacaggatggaatcataggtaaatggttaagaaaaaaaagagaaagggatccaagagtttagaatagttttctaataaatttaaggttagtcctgtgtgtaaaaactatctttatattaagtatgcaaaattatcttataatacacagaggaaccggagcagacaataatgaatgtcaggcatttagcaagctgggttagatttgatgaaaccgaaaactcttaagcttggaaactagcttgttaaataacaatgttcctgtaaacaggcaggctagatttattgtgcccctgggaaattctctggaatgaacacagaaaatgcttctgttgattagcctttttagcttgcgggtgagtgttgacctaaaagggaaaggcttgccctccagattttacataatgtgcccttatcaattcctgtcaggagaactgtccctgcagggatgttaggaagactaacgattctgcctcagtaacacaacctgtgctcccaggagcctgctgcgaaacagcagcttatctcttacacctgcttatggactagaaagaccaattttaaacagagggccaatgcaaagagaagagaagataaaggacattaataaagctaacaagttgattgatatattcaaagagaggaaaccgaggccgagcatgtgtgatcactggcccaaggtcacgagggaactggcggccagccccaggacacagagggcttccctcctccagccacctcctcaacgctagctggagagcagggaggaggcatttcccagaggcaagctctgaatactccgctgtgttctcactggacaaaggaaaggaaagatactcctctaaagacggcactgaacactcacttagagacggtaacagaagcctctgtcagcaactcaaggctcatttaaccaacttttgggatattacccacacagtcctaaaaacgtatgcaaagcaggaagtgagataaaagagacctcaaaaattctgagagtaactataaaattagacatattaataaacgtgcaaacgttataaaatgggaaaatatatacagttggtttttccggctgtggtagctaatcaaaaatgacatctccttccagctcccctcactcccaccatgccctcgtgggcaaaacctgctatgatttgcccgtgtagccccctctctgtgaacgtaggagaagcgaagccattggctttctgagacttgctcatcagaagccttgctgctgccacctgcgcctctgggaaagcttgccgtgggagaggcgcaaccgcctggagaggccttcctatgaggaagtgcgttagtcacgtaggagacggccccagctggcccggccacccagctgaggcgccaagctgcacgtgaaaaagccgtcttgggcatacagccccactgggcattcccgtgagtccagccctaacgtcatcggactgcagccccaagagagacccgagggagaactgcccactcacagaaccaagagggagaatgatcaacaatccacaaagtttcttgcaaagcaacagataactgaaccattggctagccaagctgtacaaaagcattaaaatagatttattgccataagacatgagaagtataaacaaaaaaaagttactaaacaattacagagcgcctatgcctcttctttgaatggaaggccttagaaatacttccatattttctgaggtattttgaaggagtacaggtctgaacacacagcacacagctgtcagaaggaaggccaggcatttacacagggtgggctgtggaagaagaaacctcgtaggcagcgggggacacaatggtgactgcaggaaggcctatgaggctgtcagctggaagactccttgataccatttcattaccagtccaaaacacagtcagctctgcttgttttttctcttacaaactctagtatgctgtagggttagagaggtacttatattgtaagcatacatgtgcaaataactgtgctagattatgtggcaacctgattttccctagatttgtcatcttatatttcaatcagacatgatgatgaagagccttgaactcaaattcaaatttaaaacaaagatgaaagcacagactagaacagaaaatcaaaaacacaattcaaggatagtataacaaaaacatatttcagatactgaagaaagctggtcctttgcaatagaccatgttccacggaggtctgccctctgacaagccgagggccttaaggcacataacctctttgagacttgagatcttcagaattgttttgaaactatttcttcattgggaagaaaaaatggttctgtgatcctcaatggtggtgaagttctaggtaagagctttaagcgaaacgatggaaaaaagcaagaactaggagctggtacgttagaagcatctactgcattcaaaccctgcattaggccccttcatacaaacctcctttagtcctcgtcatggccctgcaccaagggcttggtgtcccctctttggagaagccaccacacagaaaggtccagtcaccagcaagaggtcgtgcggcacgtccactctgagtgagtctcacaggggatctcaaatgccctctttcactctgcaaggtattacctgcactgtgggctcagcattccagagatacgcatgggaatagggccaggtccctgcctccaagagctgacagaaggctggaacaaacacacatgtgcacgcaccattcatttccacagaaagtcatttttggattcaaagctgcgtttgaaatgggtcttgcaggatgaatgggatttcacagatgaaaactggtagaagaaaactgcataggctcatggattcattcagcaagcacacacacaaaggcctgctgtgggtgaagggcaaattctgtccctgaagggcagagtgagtgctgggagcttcaagcatttcttttgaggtccgtttagcaaaagaatttcttattaaatagacaactcactttatattttgtcacatacactaaacacttgtgggaaattctctctgccattcagattttaaaaaattgattctggatattagctgttcccaaattcaaaggcgacatccctcacagcaaaaacctaacacaggtcctggaaaccgacaaggccctgctgcaggagctcacactcctgcggtccctactcccagggatcaagcctggctgctacaactctgtgtgcaagagcaaactgtttcttgtgatgagtcagtttcttttttgaatcaaaacagaaatgttaagaaaatatggagagctattcttttatgatcaagacaatttttgctatgctttatattcttttacagtttcctattttaatattctcatctggtagatttcaagcactgacctctccctttctttcaacaagggtataagaagacagactccacttgctcagactaggcatggggctttatggcctttgggatttcttaggggagacttgagacttgagagctggagaactgtcaagctaatgatgtaccccttttccttgccatttcaacacgaacaggtatttctctccaaatctagaaatccttctgtaaatggaacggcagatcattattttgcattttgctgagaacaagaagtacgtgagatattgcacaaagtacagcatgaggcatagcttttacccaacaggctcaaaactctaaattaaaagaaaacaaagggacagaaagaaaagcagttttcttctcttccacctcctcctcctctcgcctgaaatgtaccacccacggggagttgcacagcttagggcttaggcagagatgatattccatgtactttttcaggtttcccatttaaggctgtcaccaccattaagccaaatgacagtaacggaggtgcggtcacattaataacatgagggctgttctagggcaagatagggcctgcgtcatggcttcctctatccctgagaaggagggtgacagaagagaacgcctgcagggtgacagtaaaggagtgtatcagggatggggttgcagagcactgtgcagtccccactgtgggctgtcggagtcaatcaggcactcggctcattggaacttctgtcccctcagcagtaagggcggagggcaaaccttgcaaacgacacatcttagttggaggacatgattggggctggcatcatcaaccatatgagatgagcctacaacagacagcagtcagagacaataccccgggttaaaaaaggaatctaccccattatgaaatagaagaaacctcagcaagttgttgtctatgttctctgagctgataaaatggtattaccatgaactaagggtagctagtccctcaaaatccatgctaatgaaattctctaagtccagaaaaatgagcaaaaccatcattttaaaaaaatttagaaatttttatttttatttgcttataaacttcattgtgagcttttggaacaaaaaagtctgatttcctatttaatgaagaatggcttttaaacaccacaacttaatgcatagctgtatcaatattacgtaaattgacaaatgtcacacaaaatgtggtgcctaattgattttgacatgcacgtacataaagtaggaccattcaggtaaatacagagctaataattacaagaagcaaataataccaatgaaaaccattttttaagggtattagattttcattctcttcctcatcaaaaagaagcatgtattgaacatctgcctgtggctagggttgtagtaagcagaaaagtgacttgcctaaaggatgagaaatcctattacataaagattttttattttaaatgtaggcccactctccacacacccacacccatcagttacctagcagttccttataaggagtgtgaaatccaagtctggcaactcactggggacttcaagcaaaaccttctactctgtcctgttaggtgtgcagccctatgataaggcactgtggccatccgcagaataggcagaagataagcctctaatctgtacttttcaaccaatacctgggaggctttttaagagtgatactgaccttgttttcattggttttatttcattttacttaagtacttgttgccattgaaaattacagccggccttattgtcttcaattcatttgcatccccttttccaactactattcctaaagcaaatcatgcatttgcttttgtgcaagtgtctgaggactaatttctccctaaagatgcggtgttcaaatccataaattctcccccaaatacatgttgtgggttttggttcttcatatttttttatttttatttttttctgagatggtgtcctgctctgtcacccaggttggagtgcagtagcatgatctcgactcactgcaacctccacctcccgggttcaagcaattctcctgcctcagcctcccaggtagctgggattacaggcgtgcgccaccatgcccagctaatttttgtattttattagagacagggtttcaccatgttggccaggctggtctcgaacccctgaccttgtgatctgcccgcctcggcctcccaaagtgctgggattacagacgtgagccactgtgcctggccagttctcctcaatattaggaggaacattgtcaccaggctccctgtgaggtggcatttccaatgaccaaatatagttgttacttaagtcaaaactctatacctgccttgtccaatatggtaactgctagccacacgtgactaattaaaattagataaaattttaaaatctgctcttcagacacacaaaagccacatttcaaataacccatagtctcatgtggctagtagcaatgatactgaacagtgcagaaagttctgttgagaagcattgctctacattaagcttgtctaacctgccccacatgtggcccaggatggctttgaatgcagcccaacacaaattcgtaaacttgcttaaaacattatgagattttggccgggtgtggtggctcatgcctgtaatcccagcactttgggaggctgaggcgtgtggatcacctgaggttaggagttcgaaaccagcttgaccaacatggtgaaactccgtctctactaaaaatacaaaaaattagccaggcgtggtggtgcatgtctgtaatcccagctactcaggaggctgagacaggagaattgcttgaacccaggagttggaggttgcagtgagccaagctcgtgccactgcactccagcctgggcaacagagtgagactctgtctcaaaaaaaaaaaaaatatgagattttttttgtgactttttagctcatcagctatcattagtgttagtgtattttatgtgtggctgaagacaattcttccaatgtggcctagggaagtcaaaagattggacatccctgctctacatgatgcaagacgggtctgcttgtgatcttggttcatatagaatagtttctactagtatacattcaactgagaatattcaaatgagtaaaaaccacgtggactgctgcagccctccattcctctgcagaatccgggtgcaatgtaacatcaggcagtgctgtgagctgaagcctaaggacctagcacactcttgaccatatcctgaaactgttcccaaccttttcctgtgacacatttatacctcctaagtgcatacaacacacatttatgagaacacagtgaagcaaaaatgctcaagaaatggaagtgacttcagttaatttcaactcagggttgactcagtttctcctcacttttgtcaaaattttctgtgtaacatgccagtctgcattgcttctctgatagggcaggattctacagctaatgttaactaaatgaggatgttacattaattaaaactcattgttcttataatttcatgtaaaccaattaacaaatgcaaaagattttagaaaactggttttaacatttgactccaagatataaatagaagtatttcttttatttttattgtttgagacatgctctgccttccaggcttggagtgcagtggcgtgatcacggcttactgcagcctcgacctcccgagcttgagagatcctcctgcttcggggtcctgagtagctgcgactgcagatgtgcaccaccacacctgagtaatttttgtatttttcatagacacagggtctcactttgttgcccaggctggtctcagactcctgggctcaagcaatcttccccaccgccttggcctcccaaagtgctgggattataagcatgagccaccacacctggcctagattatttcttttcttctcttctcttttctttctttctttttctctttctttctttctttccttccttcctttctccttccttccttccctcctcctcctccttcttctttcttcttctctttctttctttgtctctctctctttcttttttttttgagagagtctcactctgttgcccaggctggagtgcagtggcacaatcttggctcactgcaacctccgcctcccagggtcaagccattctcttgcctcagtctcccgagtagctgggattactgggattacaggcgcgtgccatcacgcctggctaattttttgtatttttagtagagatggggtttcaccatgttggccaggctggtcttgaactcctgaactcgtgatccgcttgccttggcctcctaaagtgctgggattacaggtgtgagccaccccgcccggccgattatttcattgtttaaaacaaatactttgactttttaaaaactgaaatttgcctgtttttcccaaaagtatagtttttgtttgtttgtttgtttgttttttgagacggagtcttgctcttgcccaggctggagtgcagtggtgcgatctcagctcactgcaagctccgcctcccaggatcacgccagtctcctgcctcagcctcccaagtagctgggactacaggcgcccgctaccatgcttggctattttttttgtatttttagtagagacggggtttcaccctgttagccaggatggtctcgatctcctgactccgtgatccgcccgcctcggcctcccaaagggctgggattacaggcatgagccaccgcgcctggccaagaatagttttcaagaagcgggttaactgtgactaatcaagtacaacctaaactgacttgatctccttgagtagcctctggactttccccagagctgttatgaattcttgggaagcagctgatatattctcaaataaatacctcatttttatgtcagatcattctgatataatcttattttagaaacacagcccatagttcagtatatgacaacaatctgttcttagaatagaaatctgcaaaattaaaaaaaaaaggagcctccggaagcccagaagcatctttgaaaggtgtctctacaattttagtttcatagctctgtataacatccaaccatgcatgtaaacagctgaaaggaaaagcaacttcccttttatatgtatctgttagccattcttcctggactgtcagggaagccgatgtgggaggaggggctggcctgggatgagtatgggagaaaaagtgacttgcatattaattaacgcccatgctggccgggcgcggtggctcatgcctgtaatcccagcacttagggaggctgaggcgggtggatcacgaggtcaagagatcgagactgtgctggccaacatggtgaaaccccgtctctactaaaaatacaaagattagccgggcgttgtggcacgcgcctgtagtccccagctactcgggaggctgaggcaggagaatcgcttgaacctgggaggcagagcttgcagtgagccaagattgtgccaccgcactccagcctgggagacagagtgagactccgtctcaaaaaaataataataaaaaaataaaaaaaattaactcccatgcctcctctggcttcctttcctccatcccctgacattcatgtgcaagtggctaaaataggctaaagagaggatcaagtacagtttccgtggggaagaacatctaggtaggaaaggtaacgccatgcggtcttgaggctgggaacagacggacggcaaggctcaggctcctgtgcttgctcccctgagctggttttcaccaccagtggacagacgcctccctatccctccagctgcctccggcgcttgctgcccagaagcctccctggagccaagacctgagagcccaattctccagtggcctttttaattttaaattttgaatatttcttaggtttatatttctaaggctgcattaatgattattagtcgggtgaacttttacagtggttttaaagctaagtctgggtattctaggaaccatctaccctagcgacagcaatcctgtggtcaccaccatcagtcacactcctctggccacctggtaccatagtgatggaattgtgacatcaggtgtgtgcactttcgcatatagcttagactctcttttttttcttttttctttttgagacagggtctcactctgtcacccaagctggagggcagtggtgtgatctcacctcactgtaacctccacctcccaggctcaggtgatcctctcaccttagcttcccaagtagctgggatacaggtgtgtgccaccaagcccagctaattttttgtatttttggtggagatgaggtttcaccacgtcagccagactggggaccaatttataacattagataaatgtattggaagggcaatggagaatatttcaactgtgttagctattctaaaatatgttgagtatcacctcaaaaaaattatcattagaatacaattaattttaaaattatgagagcttttactatataatatttactgctttcctctccactacatcttcaataatttctctcttggtgcaatttttttcaacaatttattcaatcatttctctgtgtatgtacattcgagggttttcatttttggtgtctaaaactgaagctgtaataacaataaacatccttgtccttgttctggtgtgtcctttgtttagtttattaaaatttaaacagattaactgaggtaaaattgatatacaaagaactgcacgtatttagtgtgtgtaatttgatgaatttggacatacgcaaacatctatgatactatccccacaatcaaggatagatatatctagcacctcacaaagtttcctcatgtcctttttgttttgctttgttttttgtggtaaaatctaccctcttaacggattttcaagtacacaataccatagtgttaactacagacactacattgttcagcagttctctagaacttactcatcttgcatatctgaaactttcatacccactgaacagcaattccccatgttccctaccctgcagcccctggcaaccactattgtattctctgttctacgagattgactatatttatagatatctcaaataaatggagttatgcaatatttgtcctgtgactggcttatttcacttagaataatgtcctccaggttcatctgtgttgtcacaaatggcaggatttccttctctttttaagccgaacaatattccattgtacgtatatatcacattttctttatccattcctctgttgatggacaggtgggttgtttctatatcttggctattatgaataatgccgcaacaaacatgggagtgcaaatatctcttcaagatcctgttttcgcttcttttggatatatacctataaatgagattgctagatcgtgtaattctatttttcattttttgaacagctccagctgttttccataactgtggcattttacactcccaccaacagtgcacaatgcaagggctcccttttctcctccacatgatctccaacacttgtcttttgtggtttttttcataacagctatcctaacagatgtgagctgatatttcattgtagtttagatttgcatttccctgatgattagtaatattaaacaccttttcacatacctcttggccatttttgtatgtctcctttggagaaatgtctgttcaagtcctttgcccgtttttaaattgggttatttgtatttttcctattgagttgtaggaattcgttatatattttggaaattaaccgcttatcagatacacggttcacaaatatattctccccactctgtaggctgccttttcacactgctcattgtttcctttgttgatgtgtcccttttggagacaggcagtccattgtggtagtaaggaggtgaagtttagagccctattacctgagtttaaattctgccagtgtcactgttttaccttgatagatactttattctttcgcctggtttcctcatttgctaatctaggataatattaactgaatgtgacaggttcacagccactaaaattttatccaattaatgttcatcatctgttacttatcagcagattccaatttgaaccacacattggatatatatttttcacctctattctggaagctttgtggatacttaccagtaattccatatactcaccgacaaggagctttaaaaagtgcttctggacaataaaactacgacaatgtttttgagagtggtctattccctaacactacctatatacaccagtcctaaaatattttctgtgctacagaaagtaaagtgttcaaggatgtttatttgcaaagagtctgacagatatagctaagcttataaagatatatatatagatatatatagatatatatatttttagttattgagttcatcattgttagggtggtttcaaaatttgaagtttttcttatttctgtggtattttataacattaaacctagggatggcatcaaacacaatttcaaatgaatgtgttgctgtgctggatactgagaagtcagactacaaacctctgtcctcacatcaaccccagccaaccttaaattccccaagtgcaccaactaaaaagaccaagtgagcccttcatcagcacacttaccccactagcaaggacctgacagagttttcaccatatgttttgtgtttgtgcgtttgtgttttggttttggtgaaggggagaggacatgtcagtaggctcaaagctataactacagagccgactttaaatatgaaatggctttcataccttcatctcattgccagtatcaacaaccaaggacttcctggcaacacttggagattttagagacatcagtaacctttctaaaaatgattttgtgactttcattctaaatggctaggcaaacaaatcattcaatagactgcagaaaatgggccacaaaatgaccaggaggcacatgatatcatacacaataagagagtatggggacaaaattcagtttgttatgagatttaagtgcaaaattcctaactgacttaggtgcctggattaaatgtgttgggcaaatgaagagcaactgcatctccatgtgtcggaccgaaaggtccttgtataatgaccctccccaaacgaagagccactggtccaattcagtttgaggttccctacaggttatcaataaaggttttttaaaaacctgctggatcaatctggtggagggtgatttacagagtaactagaaaaagatttggcccaagatttggccacctggctgcttcccactttggccacagcgatggcttccctgctctggaatgccttccagacatttcccttcgtcttcttgctgccccttttgattctgccactcttaggacttctacatgaaaggaatacaaaaactcctacaatacttaaattcttttaaaaaggttgtttgaaagagctaacctaattaacagggaaaaaaatgcctttacttgcacttcaggacaattgtttctgctacagaagaacctttaataatcttcccaggctaaactgtggagacctttgattttatacaacccaaagcccactggaaatctgtctgcttcctccaactattgtcaaagaaggttaatttggaatttaacaaagtaaaagatttcttccaaactctcagcttgccttgggacttaagtgacgctgggtccgtttcctgcagccctgggacacttgcaagtgaggctctcagggagccttgttgactgcgttgggtgaaatgcacagggaatgcagggaatgtggcatggtgttctgtgttccttctcactctgcattgtttatgcttgctcaaataacttatatttgctcctcagttggaggttaaatttcttctgtatcatgactgaggcataaaattataaaataagtaagtataatctcctacattcctcacagcaaccatttccctacctccttccacacacaaacaacttttcagcagtgaagtggtacgtgtccttttttttttccttttaatctcaggatgatttagtctattaaggccatttaatggaatgaccagatgacaaagaagaaaaaggattgttttgagtaagagtttcctttttcatttctggctttaattgtgaggttatggctttcagaaaagaaaagaaaagaaaatgcctgtagtgataaaagagctgtatttcaacaaatgattatatttttataaatcttgtagaatttgtggatgtattttattaataaaatatttacacctcaagtttataaaggaatagacaaaatttacacagggtttgacagtcttatgtatttggtggtgaaattatcacaatttatatccactcgtacaatgctattaataaacaaaatgcttgtgacaagtatgggaattcttagaaggtaaaaattcccaggaaaacgattttaggctgaaagctaaactagggtatccctactaaaacaaggataccctaatgattattctctcctttaacaaaatttgaaagcacaccttttcctcctatattatgcagcatgtggtcataatttgtacttgttgctgtgttgaactcacaatagaaaaaataaatgaaacatcttttgagtaaactaaacagatgtctcatgttatccttttaaaatacagctggagaaaccttagagatcatcttgttcaacggttctcaacagatgctccctggaccatctgtatcaggaccatcttgggggtatattgaatgtgcaggctgtcagccccacaccaggcccagtgaatcttagagggtagagcccagacatctacagtgttaccaagcaccttatttcattcttccatacactaaattttgagaatctctgttgtcctatcttttccattttcaacaaagaaactcttacccaggttgtccaagatagagtagcagaggtaggcagaacttcatccaatagtaaaaataccacactgctcttctgtaatataacatttactaaaaactaaactatagaaaagcagaattaatatttctattaaagttctgcaacgtacagcaatattttaggcctttcttatccattcttttattccacaaaccttcattgaatgcctgcactacctaaggcatcgatgctgtagcagtttaagtttacaactgagcggagatgagacattacacaaagaggtacagttcaaggaaggctgccacaaacaccacaggagcaggttaactaaagggatcaaaaagttctaagcagctagccctcacctctggttcagatgacccagatgacttcacagaggaggggctgttctggccatggctgagctagcaacagatatggatggacaagggataaactcaccttactattctcgttccctagcaagtgtaaacattaaaggcttctgtcatcctggggctgcagccttcaaaggaagttctttatacaaactaaaaattagaggtgaaagaaaacaggatcctcattttaggtatggaatctctaaccctgcttttccctgactcccagcctcaaatactcctccttttcgggttctgttgtagatctcgatcctgtcctcctcccgcaacttatgatagggaatcctaacactcaccattgataatacattatccttttaggaggatatcctttgaggggactggcaatctccctggggtcagaaaatgagtacgtgtcagctaccagggtcatgcagccaccctgagcccaagccagtgttcctaccactgcagagttccctggcaagggaacacatggagatagtatctgggagaggaaagggaatccagagcagacttctgaaggctgtggggagggactgcaggctgcgaggctttgctcctcgctccttttcctcttcctactcctttagcagtaagagctccccaaccatgcttgggctatggccatgccatgtggcagtacagttagcagacaactgccctgctaagctttaaaaaacaaagacactaaaacctgataaacaaccagcttttctttgcttccttggatcagtaaattttaaaaagaagcaggggaaagaaaacagagaactgacctagaattgccaaccttttatttgggcatctaagaacatctgaaaaataagcaaaatagaaaagcctctatttcagtaaagagcaatcctttaagtagagtaaattcagactataaaaacaaacatatgatgttttatctgttttgtaaaaatcatttttccttggactagtaaaaactgcatcatgtcgccccatctgtagtacttagaaacagctgcaggctgtttaagtttctgtaagtttctataagcatagctcagagactcaaaagagaagggggaagaaggcttgggacaggaaaggaaagagcaaaagcattagggtttttcaagacgtaccaacaagcataaagttccactcgacaatttcagattttaaaacccctcatcatctataatccaggctatgcctgttctttgagccaacagaaccaaactggatgagatgccaatttaaaaatactgtgtgctctaaataaacttaaacatcagcagtgtagaaaaaccacattatatcaaaacatattgtttaaggtactaagaaatgtctctgcaaaacttaatatgagctttaaaagcatatcatgccaccatcaccatcagtcattaaatttttattttttcatttaagcttttattatttaaaaaattttcagattcaggccaatgttaaaagatatgaggcagaaaacaaaacctaaatattaaaaaggaagataataaaatatgtatttttggatggtgtgtttataggaatcaaatggtaaacaattacatttaatttacagctgagggtccctgtagtcacagttacttgggaggctgaggcaggaggattctttcagcccaggattttgaggctgcagtgagctatgactgtgcctgtgactggctgctgcactccagcctgagccatagagagaggccatgtcttaaaaaaaaaagtaggtcaatactagatatacaaaaccaaattaccagatactaccagtttgaaagtatagtaaaaaaagatcaaaacacaaactataaaataagtaataacataacaataaccataatgagaaatatgtaggacctatttagagaaaattggaaaattttgtgagaaatataaaaagtaagatttggataaatgcttagtacatgtcatgggctcggtggtaaagactaaaacctgttagataaacagtttttccccaaataatctgtaagttcaacataaattttccaaagttcatctgaaaaaacaaacaggaaagaacaacaaagaaaattttgcagaagagtcctgcagggggactggccctatcagatgccacaacatgtaagccgtgtggcacagacagaaggacaggcaagcagaacaatggaacagagaagataacccagaagaaacacccatccatattcagaagatgccacaaatccatcaaataaaattgagaaaagatggcacccactaggtaacaattcagaccaaaaacaagagcccctcacctgattctatatggtgaaatatattccacatgaatttagagtttagcaacaaaaattttgttaaggtagaaaaatatattgtatatatataatataaatatatacatatataatataaatatatacatatatatgtatatatattttttgagacggagttttgcttttgttgcccaagctggagtgcaatgcgcaatctcggctcactgcaacctcctctcccaggttcaagtgattctcctgcctcagcctcccgaatagctgggattacaggcacgtgccaccaagcttgactaattttttgtattttaaatagaaatgaggtttcaccacgttagccaggctggtcttgaactcctgacctcagatgatccgcccacctcggcctcccaaagtgctgggattacaggcatgagccaccgcacctggcctatatcagatattttaaatcacttctaggaaaaaaaatgactttctaagctaaaaaataatagaagaatctaaaaagaacagagtaacatattttatcatctacaaatcttaaacttctatttttattttttaaatacacttaaatgcaaacaccaaattggaaaaagtatttgtagcaaaggtcatcatcaaaagactaatcgctttccaataaacagtgctataacatttgtataagatttttggtagcccagtaagctaagacaagctttggggaaggcaatttggcaatacatgtaactggagccttaaatatatttgtatctgtgacccagtaattccacttctgggaatctagcctaaggaaacaatccacatataataaatattctctgtgtacaaagatgctcttcacagggaaaaaaactgaaacgatctaaaagtatattaaagaacagttaagtaaatgatttaaaaattttaaatggtacttagagtgtataatagtatttcaaagtgtttataataaaatgttaaagaaaaaatcaagatactaaattgcatattcaataaaaatacaattttattttttaaatatagatttatatatgaaagtattaaaatatttatttaaacactattatatccattttatatgtgtatgtacatatatatgtgcatatgtcatatgtttacacatatgtagaaatatattaggtataacagaaatatatgcaataggaatatacacacacacatatatacacgcacacacaaatcacctgcttaatgcctttaatctattcaaaaaagaaggcattgaggctaagacatcaatgtattattaccatttgtttcaaagtgtaatataattaattctcagatcatcctaaagttccaattttttccaaccaaaataaagtcataaaagaaacacttggttaatgaattaaacgtatattaaagagtccttctcatatttaaagctatgaggcatttaaatacaaataaaatcatttagtttcctaaaatggtgagcaacacaaaaacattctggataaaagttctttattgtttctacttccagcagcgtacatcctgaacctacattctctccctagataaggagtggctctggctcagtgtccccagagttccagcagctctcatgcattttcacccctgctattagaatgaccccagtgtgtagccgcacacactgactgcagcacagaggaatgcgggatggcatcagcagtgctaaagagtggggctaaaagcccagcgagaatcacaggagaatgcagaactgtgttctgaggcagcagggatggactggatctaatctagtgctataagtgcaaaatgcccaggaaatgtgctctgtggatagccaaggactcctgctccccaagacagagacgcaaatctgctcccttagttgggtaaacaactctgggaagataaataagtgagcaggcctccaagtaaatcaacccacagcatgtgtgcataacgttttagtgttaaatacaaaataatctttgactgattgtcatttcaagtgtttataatattccaggggtcctgtcataatgttcttatcatctgtaagctgaaagacatatcagaaatttattaagtttgtaaataaaactgctatgtttgagatcacttgattagtgcaaagtttaatctattttgtatgaaatactttttttctctgttaagatggtaagtttgcttctcagacattttaaatacttaaaatatatgaaacctacaaatgtagttttaaatgtctgagggaaatctaattagctaaaattaatcaacaatcagtcttattttatgcaaaaataattagattcattaatagaataacaagtcttataaattgaaaaggaaaagaaaaactagctttaaaaaagtctaacttcagtaaactgaatgctacttttgaacaccagtaactacaacagttcttttggacattacaaactagcattaactcaccccaacctctccagcagccaggctgcagagatgtaagctaggctccacggagcaggcacacccatgggaaactttgatatgaatgtcatggcagtccctagcctctcctcagtcctctcccacttttagctggcactgagtaatccattccttcctccagaagagacccagtgctgtgagacattattcagtcaaagtggttttacaaaagtcatttagtaaatggcttactaaactacttagtaaacgactaagtctttggtaaacgacttcactaaactgctaaccacaggaaaatggttagtagaattaatatctttcccacataccacatagcaaaacaattttaatttcttccattatttgtgtcctttcctctgctcaaaagttgcctttcccgccagcttcactgtctctcttttctcctcttccacccctctcttcagattcagatctggctgtcaatggcatgccccgatcagcaaaacaaaagttccaccatgggccagagagtggccatccaccccgaccttgagtccacctcgccaaatgtgaaagcccaacgaaactgggaggggacggggtgggatcccgctgccaaggaaatgagatttttctcctgtcatttaaaatgaactgattgttatacataatttgaagcgaaataagagataacaggaaacaggccacctgaaggaaacagaagcagagccacttcactattttgcttaactcttcatgccaccagtaaggatctttaaactggaaaaggctggagcccaggaagagcatttcaacaacttcaaggcgcagtgaattactcccactgcaatgaaaagcaattacatatgtttctgtgcagccattgttggtgtagtttcctaagggaaaaaatggacagctgtcaggaaatggaagccagaggaatgtttctcggttttctgaaaagagcaaagagtaatgttctggtaaatatggcctggaatcctaatgaaatcctaggacagactgttagatgaatgttcggttgtgaaaggaatagagtccgctcaataaaaaatatgttgaaaaatgattaggctatcctctagtccttcacagaggacttggtgagacagtacatctctatcaaactgctaatgggggaaaggtaatcttatttcactacatctacatctactgttaaaaaaaaaaaaatagaatcatcagaaaatcaatgccagagagtgaaagctataaataagagactctgccagcgagatgtctacttgttccagtgcagcccggtgaagcctgcatagagagcttgcatcagtgcatgctctctaaaaaggtatgagggaggcaagggcactggcaccaggccaagctctacctccctgccaggtaccttggtgcagggcccacattctcctagagcagcatcttttccaaagatactttttgtggccctatgaacaactgaatgaagtcaggagctggaagctcaaatcccccttcttccatgcaatactctgaaaccctccctgggctgcagtcccttatgaatggatgtgaggtggccttccagattgacggtgaggactaaatgtcaacaggtagtaggagcatcaaatgcagtgcctggtgccatcataggaaaatccccaaggggaacagagctctgaagtcctcctactctccaattctgagattctgtgaccagagtttgaaatcggaaacttgactcagatcctttttggtcatcttttctttgcagtaaaaatgtaaaatgtgaactgaaaaaaggggattccctgaatggtagtttgtctttctattcttcccatcttgtagagttcaggcaaccctcatcttattgtgcttcaccttattgcactttgcagatattgacttttttataaattgaaggtttgtggcaactctgttcagcatgtctactggcaccattcttccaacagcatgtgctccctttgtgattccatgtcaccttttggtcattctcacaatatttcaaactttttcatcgttcttatatctgttgtggtgatctgtgatcagcaacatttgatgttaccactgtaattgttttggggcaccacaaaccctgcccatataagatggcagccttaatctacaaatgttgggtgtgttctgactgttccactgaccggccattcccccatctcttcccctctctgcaggcctccttattccctgagatacaacattattgaaattaggccaattgataaccctgtaagggtttaagtaaaaggttcaaatgttcaagtaaaaggtctaagggttcaagtaaaaggtccgtcatattaaatcaaaaactagaaatgattaaacttagaggaagccatgtcaaaagatgaaatacgctgaaagctaggcatcttatgccaaacagttaagctatgaatgcaaaggaaaagttctgaaaggaaatcagaagtgctactccagtgaacacatgaatgataagaatgcaaaacagccttattgctgatatggagaaagttttagtggtctggatagaagatcaaaccagccacaacattcccttaaatcaaagcctgacccaaaacaaggccctaactctcttcaattctgtgaaggctaagagatttgaggaagctgcagatgaaaagtttgaagctaggagaggttggttcatgaggtttaaggaaagaagccatctccgtaacataaaagtgcaaggtgaggaagcaagtgctgatgcagaagctgcagcaagttatccagaagatctggtatgataattgataaaggtggctacaccaaacaacagactttcgatgtagatgaaacagccttctattggaggatgatgccatctaggactttcatagctagaatggaaaagtcaagtcctggcttcaaagcttcaaaggacaggctgtcttgttaggtgctaatgcagctggtgactttaagttgaagccaatgcttatttgtcattctgaaaatcctagggcccttaagaatgatgctaaatctactctgcctataccctataaaaggaacaacaaagtcgggatagcagcactctgtttacagcatggttggttgaatattttaagcccactgttgaggcctactgctcagaaaaagattcctttcaaaatattactgctcattggcaatgcacctggtaatccaagagctctgatggaaatgtacaaggagattaatgttgttttcatgactgctaacataatatccatgtgcagcccagcccatagattaaggagtaatttcaatttttgagtcttaatatctaaaaaatacattttatgaggctatagctgccatacatagtgatttctctgatggatctgagcaaagtaaattaaaaatcttctggaaaggatttgccattttagatgccattaagaatattactgattcatgggaggggttcaaaatatctacattgttgattgattccaaccctcatagatgactttgaggggttcaatagttcagtggaggaagtaactgcagatgtggggggaaatatcaagagaactagaattagaagtggagcctgaagatgtgactgaattgctgcaatctcatgataaaacttgaacagtcaagaagctgcttcacgtagatgagcaaagacaatggtttctcgagatagaatctactcctggtaagacaccatgaacactgttgaaatgacaaaaaaggatttagaatactcataaacttagctgataaagcagtgacagggtttgagaggactggctccagttttgaaagaagtcctaccgtagatcaaatgttatcaaacagcatcccatgcttcagaaaaatctttcatgaaagagagtccatccacgtggccaatttcactgttgtcttcttttaacaaattgtcacagcacctcaaccttcagcaagcaccaccctgatcagccagcagccaacaacctcgagtcaagaccttccacaagcaacaggattatgacttgctaaaggttcagataatcactagcatttttaacaatgaaacattttaaaattaaggtatatatattgtttttcagacacaattaataaactatagtatagtgcaaacatattttatatgcactgggaaaccaaaatattagtatgactgactgcattgtgatatttgctttattgtggtggtctggaatctaacccacaacacccccaagatatccctataaacgataaaaaaacaaaacttctgaagtaataggtttatacttgttcccctgtgaaataaggtgctgaagagtcacaaaatcatgctctttgctgccctgtgttttttcctttgtgttttgatcagatactaggaagcaacatttatctaacaggtagatttttacacaaaaggttgggaaattccatctgaccaggtctagtttttactggtgatttcattaagtgtgtggggggccagatggatagaaatgaagtcacttaagggatacatattgaaggatgtgcactacctacatatctgagattttaaaatatgcaaaattggccaggcgtggtggctcacgcctgtaatcccagcaccttggaaagctgaggtgggcagatcacttgaggtcaggaatttgagaccagcctggccaacacagggaagccctgtctctactaaaaatacaaaaattggctggatgtggtggcacattcctgtagtctcagctacctgggagacggaggcaggagaatcacttgaatcctagaggcggaagttgcagtgagccaacatcacgccactgcactccagcctgggtgacagagcaagattctgtctcaaaaaatatatatgcaaaattgaaaaaagcatacacataaaggaatatgaacataggtgtcttggcctgttgtgcggctataacaaaatcccataggctgggtaggctctgggcagccaaaccccatggctttgctgagcacagcccagagcacacctattgcgagctgtagtcaggtgcctgcagctctcccaggctggaatcgcacaccagtggctctactggtctggagtcatgtggtggtccaccctcacagcagcctctgcttggctcacttgaccaaggcttctagctgctacattcttcagaatctaggtgggtgtatcaacacccctacagcttgtgcactctgcatacctgcaaagatggcactgcctgggggctgacaaggtttactgactctgtctcctggaggggcagccactgccacacctgggcctactaaagccaaacctggggtagctgaggatccctgccctagaatgtggagagcagagctttgagatggtgcccagttgtgcagcaagcacaggggtcccacagttcatccttggcccatcctttcaaattgttctgccaccaaggcccttgcattctggccttgtgatgacagtggtagccccaataatctcgaaaacgtcttcaaagtcattcttccatgtcttcatgactagcacctggtggattcacaccaatctcatcaaagagttgcttggccacacccttgctgttctctcccaaacacacttccacagtatggacaggtttagaattgtccaaatatttaagttcttcttccctcttgattgaaaattctgcttttaaatcattattctcttctcacattttactataagcactcaacagacgccaacccacatctttgacactttgcttagaaatttcttgtgccaaatatcctatttcattgctcataagttctaccttccacaaaatgtgaggacccaaacacaacttagttaagttctttgccactttataacaatgatcatgtttcctatggtttctaataacatgttcctcatttccgagacctcatcagaattgcctttacagtccatatttctgacaatattctgatcacaaccacttaagcattccgtaagaagatggaggctttctctacagctctccttccctccttctaagctctcaccagaattgccctttagggtccattcacagcaatctaagctttttctagcatgcacctcaaaactcttcttgtctctatccattatccagttccaaagccacctccacatttctaggcatttgttataacaacaaccacactcccagtaccagtttctgtctttgttcattcaggctgccataacaaaataccatagacaaagtagcttataaacaacagttatttatttctctggaggctgagaagtccaaattcaaggtgtcagtagacccagtgtctggggagagcccactctctcttatatagtgccgccttcttctgtcctcacgtgatgtaaggaggcagggcagctctctggggcctcttctacaagttcactaatctcatttgttacggctccactcatgacctaatcacctccaaaaaggccccatctcctaacaccatcagtttaggggttaatatttcagcatatgaattttgagggagcacaaatgatatggtttggctgtgttctcacccgattctcatcttgaattgtaactcccacagttcccatgtgtcataggaggaaccccagtgggaggtgattgaatgatgggggcggatctttcctgtgctgttctcctgatagtgagtgagtctcatgagatctgatggttttaaaaaggggagtttcccttcacaagctctctcctcttgtcttgctaccatgtgacatgtgcctttcaccttcctccatgattgtgaggcctccccagccacatggaactgtcagtccaataaacctctttcttctctaaattgcccagtcttggatatgtctttttcagcaacatgaaaatggacgaatacagtaaatttgtatcaggagtggagtgctgctgaaaagatacccgaaaatgtggaagcaactttggaactgggttaacaggcagaagctggaacagtttggagggctcagaagaagacaagaaaatgggagaaagtttggaacttcctagagacttgttgaatggttttgacaaaaaatgctgatagtgatctgaacaataaggtccaggctgaagtggtctcagatggagatgaggaacttgttgggaactggagcaaaggtgactcttaccatgttttagcaaagagactggcagccttttgctcctgccctagagatttgtggaactctgaacttgagagagctgatttagggtatctggcagaagaaattcctaagcagcaaagcattcaagaagtgacttgggtgctgttaaaggcattcagttttataagggaagcagagcataaaatttcagaaaatttgcagcctgacaatgcaatagaaaaaaaaatcccattttctaagaagaaattcaagccagctgcagaaatttgcttaggaatgaggagccaaatgttaattcccaagacaatggggaaaatgtctccagggcatgtcagaggtcttcacagcagtgccccctccctgcccatcacaggctcagaggcctaggaggaaaacatggttttgtgggccaggcccagggtccccatactgtgtgcattctagggacttagtgccctgcatcccagtcgtgactaaaagggcctaaggtacggttcaggccgtggcttcagagggtgtaagccccatgccttggcagcttcgatgtggtgttgagcctgcaggcgcacagaagtcaagaactgaggtttgggaacctctgcctagatttcagaggatatatggaaatgcctggatgtccaggcagaagtttgctgtagaggtggggctttctttcattgagaacctgtgctagggcagtgtggaagggaaatgtgaggtcagagtccccacacagattccctactggggcactgcctagtggagctgtgagaagaggaccactgtcctccagaccccagaatggtagatccaccaacagcgtgcaccatgtgcctggaaaagccgcaaacacctgaataccagtccgtaaaagcagctgggagggaggtggtaccctgaaaagccacagggacagagctgcccaagaccatgggaatccacctcttgcatcagtgtgacctggatgtgagacatggagtcaaaggagaacattttggagctttaagatttgactgccctgctggattttggactcacatggggcctgtagcccctttgttttggccaatttctaccatttgtaacagctgtatttacccgatgctgctacccacattgtatttaggaagtaactaacttgcttttgattttacaggctgataggcagaagagtcttgctttgtctcagatgagacattggactatggacttttgagttaatgctgaaatgagttaagactttgggggactgtcaaaaggcatgattggttttgaaatgtaaggacatgagatttgagaggggccaggagcggaatgatatggtttggctgtgttcccacccaaatcttatctcgaattctaactcccacagttcctacgtgttgtgggaggaacccagtgggaggtgattgaatgatgggggtgggtctttcctgtgctgttcttgtgatagtgaatgagtctcacaagaactgatggttttaaaaatgggggttttccttcacaagctctcttctcttgtctgccgccatgtgagacattcctttcactttccatcatgattgtgaggcctccccagccacgtggaactgtaagtccaataaacctctttctttcctaaattgcccagtcttggatatgtctttatctgcagcgtgaaaatgaacgaatacaacaaacattcaaatcatggcaatagaaaacatttatataggatccctcagattttttttgaaagcaacaacttatttaattttcatcaatagttatatttagtgatcatatttcagaatgtttcatataaaatctattagacaaatgaacacaacatggttattacataatgctaatacaggtggagcacccccagtctgaaatctgaaatgcttcaaaatttgaaactttctgagtgccaacatgatgttcaaaggatgttcatcagagcattttggatttcagattttcagattacggatgctctacctgttaggtatctgcaaatattcaaaaatctgaaaaatatctaaaattcaacatactttttcacaagcaatttggacaaggcataatattgaagaattactcccaccttgaattctctttggagtgaggaaacaataaaatgcttattaaatatatggaaatacataggttatagataacagagaaactaaaatgtattgatttttggttcattttgattccgtttcagctaatatggatggttgaaatgaagtataaacagatgaaataagaacaaagataaggagtgttagggtgggtccctaggaagggaatgtggaacattactgggatgataataattatccaattaggttaatctctattattttgtacattcaatcagtagccctgaaaagataaagccaatgtttcatgaggcagaaagtgacttctaaggaaagaagcccccacaaagccatgatcctcccaactgttaggtaaaagtggacccccactagcatgaagaaataatcgtctcttctgtttttaattatatatggacagacaagttccaaatccttattttatgttttctacttcaattattcctttcctattgcaatttgagttcattttctattctgctctcaattaagtgaagtcaccattttccctttaatcatatgttatcctccaatttactttcctacttcatttacttccttactattgtctttgggaagttttatcagctcttcagatgggcagaagatgtggtggcagggaaaggggcaggggctggctggagaccacctgacagggagtcaaggcctgtctcaccaggtgtgtgagcacaggcaactgtggagccctctgaaccccaacctcatcttcagtaaaatggaacagccacatctacatcactacaggtttgcttgaagtttaaagctattctacattaggagttcaataatcataataaagttgtcagttttctttttacctcctaatcaatgtgttagtccctgaagaaaatcattaagtaaaaaggaccccaccgacccactcacccacacactaacacaaaatagttgtccaatggcaggaagttggattaactgattaatttattcaggaaatatttatttacattttgatctactccatgccagatactgttataggtactgaggatacagcagtgagcaggcaaaagctcctgctctcgtggagcttctattccagtagggaaaacacaactaataaaatgaatgagcaaaatgtatagtatattaaacggtggttaagtgccattagagaaagagaaggaggaaactcagggtggggggatggcaaatgtgatcttacagggggttcaggcaaaggtgacatggaaatgagactggaagtagtgagtgaggagctgcatggctgtccagaagcaaggagccacctgaaaaggctctggggcaggagtgtgctgggcacgtgaacacagccagggtggctggaaagagctacaggggaaagagaaggaggagatggtgagaagggagaggtacaggccttcctttggctttgactgagtgagatgaaagggcaagccaagttctgagcagagaaataacatagtgcagcttacctttaacaggatccttctggttctctgaggggtgcagtgggaacaggctgcaacagggcaagtgtcacagcagaagctactaggaggctacttcaacagtacaggtgagagatgataagagtttaggtgagggtggtaagcagtcacatactggatctattccaaaagtgcagcctctgcagagtttgctgagggactggatacatgcagagctgagagaaaaaagtcaaggatgaccccaaggtttctggcctcaacaagttactagctgtataaactgcatacaaacttgtttctgaccccgaggactagatgagtaatcaatatacatgaaggcacagcccagtgtacggcacatgggcttgtgtggtatgcttaggttcaagtttacaaactctattgaatttctactttgtgctttgccctgactttgctaggtccagaaatacaaacatgagtaagtgtgaaatccaccctcaggagtttatgatctagtgagacaaagaatcatcctttatagtacaagcttccccagcagccacagaaatgagtagaagattcagatgtcagcagggaagggaatgattgactcagagggaggatatctaggagggctgcctggagtaggtgacaacagagtagtggtgtcttctcaagaggaaaatcgatgaggactggcacagctgggaaaaaggtgataaagaggacagtagtggctagacttctcaagaagaaaatcgatgagaatggcacagctgggaaaaaggtgatagagaagggcattgacggaacgcttacccgctactgaatgatgatcacttattgttgaagatagagactgtgtctcttctaacaccacaatcctgagatgtaggcacgacatcctgaagatcgcaatgtgtacacagtttcttgtaaatattctgcaactacatagttatttgtttgactgttcctgctttcacaattataatttggtccagtcaactctagtcagcaatataacattaccttgtacacctccaaagcaaaattgtgcaaaagtatagctgcctgaggaggcaagtcctgatccccactccttggggccttctctatccatagatccaaaaaaccacagatgcttctggtgtgttctgccaatgatccttggcagtaaacaagtgtcacgtctgactaggcaccatggctcacacctgtaatcccaacactttgtgaggccaaggcgggtggatcacctgaggtcaggagttcaagaccagcctggccaacatggtgaaaccccatctctactaaaaatacaaaaattagccagcttggtggcgggcgcctgtaatcccagctactcaggaggctgaggcaggagaatcgcttgaacctgggaggtgaaggatgcagtgagccaagattgcaccactgcattccagcctgggcaacagagcgagactctatctcaaaaaaaaaaaaaaaaagtgtcacttttaataacattactcaattgatgacatgtctgcatcatcatcaattatgattcaggtattttcatactgttctcatatactttgtaccagcccgtaattctgcatttgcttttattttcttagtaagatgaaataaaaggactacaaacatttagaataatatgaaaaaagaagccacaaatattaaccctctagttcatgtcatcaaccctgaatgcaactctatttccacaaattggaagaggggaaaaaatccagatagtaaatgaaatttttactatcatattttattctttaatttgaatcatgaagaactttgaaagtttattttgtgagaaaactggaaaattaaaaactaacagaaatagttcataaagaaatgcactttttaaaactttccactgcattctcttcctcttggtggtgaaagtatagattcaactgcttggaaaaaatatagactacgcgcccagtatcattagtttgaagtttgttctaactgtggtatagatagaggaagaaatcattagcaaactaaaggtaaaatacactcaactatatgaaaatcaatcaacagtcaggcttcattttttaaaaaaactttccattaaatcacaacacgcactcaagtttacaagggtcaagtcctagtaaaaacacctttaaaaatgaacaagaaaatcagagctattcttcattgatgttccttttttgtcatgaacctgttctgtatgaacaaaattcctttatttaataaattgcactaaggcatcatttgctcagccataatggaattactttgatccaacggaaataaataaggactagagaagtggaaatcaacaagtcagcaagttaacatctcagttgttgtatgctattcacctctaaagaaaaaaacactaaaggcccgacacggtggctcatgcctgtagtcccagcactttgggagaccacggcgggtggatcacgaggtcaacagatcgagaccatcctggccaacacggtgaaaccctgtctctactaaaaatagaaaaattagccaggcgtggcggcgggcgcctgtaatcccagctactcgggaagctgaggcaggagaatcgcttgaacctggaaggcggaaattgtcaatcccatttaagaaaactatcttttctatctaatatgccaggttttgacctaagtgattacaggcaagcccagcctctataaacaaaatgaggctgttcccacaaaacacactagaagggggcccttgccaggctccctgtctcacccacttccctccccatacatacacttggcggcttctggcttggagaagggtgagccaggaggaagcaaaactttccaactgatctatgtgtcatcgtttttaagctccatatgaagctcaagatgaatattttataaaggcacaaaccctgcatgccacaaaattttagttttcttacatgatcaactgtacttataatatcatgtaatatttatctagaaggatcttcttgtcacttggtaaaacagtgggtaaaaattaaagcccaatgcactgagaaactattaaatgaacaaattacatgttcaatcttaccgagtttcagaatctttttttttttgagatggagtctcgctctgtcgcccaggctggagtgcagtggagtgatctcggctcactgcaacctctgcctcccgggttcacgccattctcctgcctcagcctcccaagtagctgggactacaggcacccgccaccacgcccggctaattttttgtatttttagtagagacggggtttcgctgtgttagccaggatggtctcaatctcccgaccttgtgatccgcccgcctcggcctcccaaagtgctgggattacaggcgtgagctaccacgcccggcccaagttgcagaatcttaacaaattaggaaattagatatttgtcctctttttctgaaatcaggggaacttcggggaaaaagcagcaatctaagtagaccacagcaacaagaaattcctttatggaaaatttgcttgtaaaaatccaaataaagacgtatttgtagagggcaacctgaaggcaaaatatcatgctcatacaaaatgaactgcagaattgagaagcacaagtgcctggaggcagccccattatcaattctttgacctcttggagctgggtgtgagggctaaaaataaacttacttcaccagctgaactccttcaggccttaacatctaaaatcctggatccatagatgtgtttggataaaggacggagaccaggggtgggcaaagtggtagcaaaagggtggcgggtgctgcaggccacaatgagggttcaggatttccttctaaatgtgattagcaggagagtgacaggatgatttacatctgaaaaggactgctccaactgctctgcggagatgagaccaggtggatacagagaaaccaggtactggctactgcataatccttgtgagagacaaaggtggctcggatcaccaagcagtagagcaggcagtgagaagttatcaaatttggcatgcagctagaggagaaagccaacaggacttgatggtcagtcagatctggattgcagaggaagagaaagtcaaatctcttccacttttcacaaaaataaactacagattgttccagtagtcaagatacatcattcaaaggaaaactatggcaatggctataaacaaataatttaccaaaaaaaaaaaagatgtatgtgcaaatcaccacatcaaaagatttcaacaccactagtaattacagaaatgcaaactaaagcaaaaactagaatgctttcccctgtcttattagaaaaaaaaataaagataatcgaagtgggctgaacagtattcctcaaaattcatgtctatctggaacctcagaatgtgagagtctttgcagatgtaattagttaagatggggtcagatgggattacagtagaccctaagcacaatgactggtgtccctataagaagaggagaggacagacagagatacacaggcagggaagaaagccaggtgaagatggaggtagagactgcagcgatgcagctacaagccaagaaacaccaataggaactgcagccgccagaaactaggaagaggcaaggacagatcctcccctggaacctttagaggaagcatggccctgctacaccttgagtcagatttttggcctccagaactgtgaaaggatacatttttgttgttttaagccaccaagtttgtggttctttgtcacagcagtcctagcaaactgacaacgtaattgacagtattactgagagtgtgaaaagtacagtcatcctcaggcctgttggcaaaagcatagattagcacaacagcctttgggaaaaataatttggcaatgcttgccacaattgcaaatgaccagatcttttgactcagcaattccaatgtgaggagtttattctaaggagataattagaaacatgtgcaaagattttaaaagaatgttcctcacagggttaaaactggaaaaaaatctaaatgttcaaaaatttaaaataagtcaaaaaaactatggcgcaaacttacaacaaagtaccatgatgggaagatagtttggcagtttcttacaaaaccaaacaatcttaccaacccatccagccatcacactctttagtatttatccaaatgagtcgaaaacatatgttcacacaaaaatctgcatatgaatgtttatagcagctttaatcataattgccaaaacctgggagtaaccaagatgtcctcaaacaggtgaatgaataaacaaactgtggtacatttatttaccgcagtttagaatattatttagcaatacaaagaaatgagctattacctacaaaaaacatggaggaaaattaaatacgtatttggtttcttttacttagtaatctgaaaaggctggatattgtatgattccaactatctgacattctggaaaagcaaaaactgtgactgtgaagattagtggttgccatgggtttccaggggtggtatgtggaacaggtggagcacagagggtttctagggcagtgaaactactttatatgatactataatggtggatataagtcattatacatttgtccaaatccatagattgcagaatgccaagagtgaacccaaatgtaaaccatgaactttgcatgataatgatgtgtcaatgtaggttaatcagtggtaactaaagtaccgctctggtgtggatattaatagtgagggaggctatgcctacgtgggtgcaaggggtatacagaaactctctgtactttccactcaagtttgctgtgaacctaaaactgctcttaaaaataaagttaggccgggcgcggtggctcacgcctataatcccagcactttgggaggccgaggtgggtggatcacttgaggtcaggagtttgagaccagcttggccaatatggtgaaacctcatctctaccaaaaatttaaaaattagccgggtgtcatgatgcacgcctgtaatcccagctactcaggaggctgaggcaggagaattgcttgaacccaggaagcggaggttgagccgagatcgcaccattgcactccagcctgggcgatagagcgagactccgtctcaaaataaataaataaataaataaataaataaataaataaataaagtttaataatctaaaataaaaattaaaaaatgttcttgaaaaatactgggtttttttgttgttgttttgtttttgtttttgtttttgagacagagtctcactctgtcacccaggctggagtgcagtggtgcaatctcagctcactccaacctccgcctcctgggttcaagcgattttcgtgcctcagcctcccaagtagctgggaccacaggtgtgtatcaccacacccaactaatttttgtatttttagtagcgatggggtttcaccatgttagccaggctagtctcgaactcctgacctcaagtgatctgcccttctcagtctcccaaagtgctgggattacaggcatgagccactgtgcctggccttgaaaaagtatttgatgataaggttattcaagacatgtgatgtactattaactggaaaaagcagaatataaaaatataaactacagtatgattctaattttgtttttaaaaagtatatggtagcaaaatattatctaacaattggtgaatctggatgaaaaggtacataggagttcattatattattcttgctacttgtgtgtaggtttgaaactttttcaaaataaaaagtaaaagaattgaaaaaggccaggtacggtggctcatgcctgtaatcccagcactttgggaggtcggggcaggcagatcatgaggtcaggagatcgagaccatcctggctaacacagtgaaaccccatctccactaaaaatacaaaaacttagccaggggtggtggcgggcgcctgtagccccagctactcgggaagctgaggcaggagaatggagtgaacctgggaggtggagcttgtagtgagccgagatcgcaccactgcactccagcctgggtgacagagcgagactccatctcaaaaaaacaaaaaagaattgaaaagaagtggtacatacatgtattcatatgccattagacaaggcatagaaaacactacactattaatactggttatctctgagcgatgagattatgcacaatttcggaggtttgtgtgatttcttatattcgccaacatttctacaataaacatgtttgtaatcaggaacatagagttaatgtcatttaaaagcaataacaaatgcaagggtctaagaaacctaagaacattaatttgaaaaataacaaacctcttcaactaagctatcaatgccacctgctttgttgttttaacttacccatcacattcatgttcatggcctttgtaacctcttccattcctcccagcttcccccaggttcccgcgacctctttttcttttgcctggcaacctgtctccctatgcagagatgttgaacaccgcctaattcctttgcttgcataacaaagttcctcagaattttcaaccacaagttcttccattcctcttatcattttctgctctttagaaaaacaaagtgagaacaacagtgctcttggaaactaaaaatatggacagagaggggaaaaacaccgatagaaatttggaagataaagttgagaaattaccttataaagcaaaaaaaaaaaaaaaaaaaaaaaaaaaaaaaaaaaaagaagaagaagaaggaaagataaagagggaggagacaggagataaaaggtccaacatgagaagaagaaaatgtttcccaaatttcgaaggacattttctattttgaaagggcctactcagcaagtacccatcacaacgaatttaaaaagacctattccatggacatcagaacaccagggataaagagaagagcctaaaagcttccaaagagacagaagacttgagaaagtgtaaaggactgggatatcagaatagcactggatttagtgataacactgggaactagaaacaattaatgatgcctacaaaattagaagaacaaatttccaacctagaatgctatactcaaccaagctatcaagtgggcaggtgatataaagacattctcagtcattgtacctcccttgacactacagtagccaccactgatgtccacccctgcagccaccctcattcttccttgctaacaaattcaaattttattctgatattaagtggccatctgttttgaaggtggggcaccagtcccaagagggtgaatttattagcagacgccagttatggcaattccaatccctttgatacgacctgagatgtgaagttggctaggaggttttgagaaaataatctcctggcttttaaaaagaggctcggccgggcacagcagctcatgcctgtaatcccagcactctgggaggccaaggtgggcagaacacctgaggtcaggaattcaagaccagcctggccaacatggtgaaaccccatccctactaaatatagaaaaattaggccgggcgcggtggctcacgcctgtagtcccagcactttgggaggccaaggcgggcggatcacgagatcaggagatcgagaacatcccggctaacacggtgaaaccccgtctctaccaaaaatacaaaaaaaaattatccgggtgtggtggtgggcgcctgtagtcccagctactcaggaggctgaggcaggagaatggcatgaacccaggaggcggagcttgcagtgagccaagattgcgccactgcactccagcctggggaacagagggagactccatctcaaaaaaaaaaaaaaagaaaagaaaaagaaaaattagctgggcgtggtggtgcacacttgtagtcccagctacttgggaggctaaggcaggagaatcgcttgaacccaggaggcagaggttgcagtgagtggagatcaggacactgcactccagcctgggcgacagagcatgacttcatctccaaaaaaaaaaaaaaaaaaagaggctcaccagagaaaatggttcatttttaaacttccagctattgtggtctgcatatgacaccagagacatggcagctaccttgcagctatcccatgaagacaaaccctcaccttaaagaattgaaagttggctcaaagaaggagttgaaagttggaaagaacctaagtccttggaaatattaccaagcctaccctgtagccagccctaacaccagacttatgagtcaaaacgaagttcactttcttgatgcccaagtcctgagtcctcagcacctacaggagaaagactggtttcccactgtgcaaagacctgctgcagcccttagggtactgctccctggaaaccccaattctcataccatgctcacacaggattttgaggtgagcggggcatcctacccaccaagcagaatgtctttatgcactcgggccaagctggagtctgcagattagaacctgggtctctgaagaatagggtagctaaacccttccaggacttcacatggaacccatccatcagttaagttgttggaggcagaggtgggaaaccaacttagcttttaattttaattattctttaagtcttcatcacttatctcagtctaagcagagtttctaggctgatccagatttatgctccacagaggactgcgtatctgcattgaaatcagaaaacactctaaaaggcaacgtgatatttgtttatttgtactattaaaaaccacaggagaaaataccttatctggaaaaatagtttgaacttttactcacctcctcaaatctaaattgatatctaacacccattttccttgcaaaacaatagccggcagtagaaacagaacgtttatactaagaaatgttacagaaacctgagaagaaataaatacagtacttattttctatgtacactcactttctcctttaacatcaaagtgtgtttatatttttaaacactaaagtggaaagagtgattttattaggttcactccacccaagttcattgctacaatacctgactctctgccaaggtgcttagcctatcgctaggaagtcctaaacacaggcctgtttttaaacactttcaccactcccttagcctttccactttgaaaatattgtctggtatcatgtttacttctacattttaaacactgtttatatgtagaagtgtattttaattattgtcagcgattaatactattcttactatctgaatgtagattattctatatttcattaaagttgaaagtaattatatttgtggtttagctctaacaactgcactaataatactagtgataaaaatgcactcataaatcagtttgtataattattgatatgcataatgactaacaaaattgcttccccaataactctaatgatatgagagtaatcacctcctctcctaaaaataacacgctacaagcacagagaagtcccaacttatacacggattctgcattgtcaattatatgtgatggggtaaactaaaagagagtgacagattatctgaggtggaattaaatgatcaatgagccctgaaagacagggagaggagaacatacacctgcatggtaagagtacatcaacgggtgcccctctaacactcactagctgatacttttagctccagataactctgttgctttcagaccactggaggcagtaagctgtactatgatgatcttagggagagcagatgcaaataaataatatgctaaagattcagtcaccttattcctctacaatacatttacctgcattggtatctctcatgaaacctactcaaatgcagtcatgtcagcagttgcccactgcagctgaggtggtcccaatgcttcaggctcagagctggcatacagcacaccagatctgctcagtctcagaacttaactccaaaacccagaggctgacagagctgagttgctgtttctagaatgactatctcaagaaccgggcaaggcataatggaacccattagtaaattcagcagaagaaggaagaggcaggaaaataagaagggggaatgtactagtctgtcttcatgtttctataaaaaactacctgagactgggtaatttataaagaaaacaggtttaattggctcatggttccatgggctgtacaggaagcatggctgaggaggtctcaggaaatttacaatcatggtggaaggcaaaggggaagcatgcacatcttcacatggccagcaggagagagcaaagggggaggtgctacacacttttaaacaaccagatcttgtgagaactcactgtcacgagaacagcaagggggaaatccacccctatgatccaattacctcccaccaggtccctcctccaacactgtggattataatttgacttgagatttggatggggaaacagagccaaaccatatcacggaagttcagtctcataatgaaagcaaatctcataattatttttgttaagcatgcattcctctgttgactcaactaagactcaggctctgggaacttaaaatgcaccaggctttatctatgttaggagttatggggatatagaaaaataaggcatgatttggattcttggggagttcgcaatccaatgaggagaaagatgagtgtcttagtcacctgggctgctataacaagataccacagactgggtggctttaacaaatatttatttctcacagctctggaggctgggaagtccaacattacagctctggcagatctaatgcctggagaggcccgcttcctgctttgtagatggctttttgctgtgcctcacatggtggagagagaaaagaaaggcactggtccccttcttcatatgagggcactaagcccattcatgaaggctctactctcacggcctaatcacctcccaaaggtcctaccgcctaataccatggcaccggggagttaggatttcaacatatgaatttttaacacaaataggcagtccataaccacaagaaaacaactatttagttttgaatcaaatattaggtagaaccacacaaaattatgttaattgtagtgaaaaacagaaatatttgtagtcaaagaggtagcttggggccgggcgtggtggctcacgcctgtaatcccagcactttggaaagccaagacaggcggatcacaaggtcaggagtttgagaccagcctggccaacatagtgaaaccatgtctctactaaaatacaaaaagtagccgatgtggtagtgcatgcctgtaatcctagctactcaggaggctgaggcagaagttacgggaggaagaggttacagtgagctgagatcatgccactgcactccagcctgggagacagagcaagactctgtctcaaaaaaaaaaaaaaaaaaaaaaaaaaaagagggagcttggaaaaaatattctgggaggtgatggaactgttctgaattttgattgtggtggttacataacttattgcacttatcaaaactctcagaaactgtacaccaaatagagtgaatgctaccgtatgtaaatttaaaaataagttttaaaagcagctgaatatcagtaatttcatacggtttaacttagtagatgcgccagctcaggcagacagttctgcaggattgcaggaagcagagacgagcagagattaatagaggagtgatagtctcatgaacaacaaccatttcatcagagccttgaaaaaataaagccctcaacagtgaagaaaagaagggcaagaaggtaaatatcctagagacaaggacagcacaagcagtcaaaaagttctacaaactcacagcaggtgtggagaatagcaaatagagcagtagatagttcatgaaagcagggggatcacaaaaaaaaaagggggtagaatacggaggacttaaaagaccagattaaatacactagaatttattctacagtcaatggcaagttagtaaagtgtttagacaaaggactgacatgactaaatctattttggaaagataaccttgataaaaatatggaggatttgttggttgtgggaggtatcagaggcaggagaatgacctacaagggtttcttaattggggtctgtgaatttcttaaaatggttgcaatattgtgtatgtgcacacacatttgtacatacacacatctttttctagaagggggtctatggttttcattagctactgaaggagttcataacctccaaagggttaagaactttaagaactgtattgttcaagtgcatcaagatgcagcaggagttaagtttgcagtgagcagaataaattcagagacacttatgaagatcgcatttctggacttaaaaataactagtgagtgagagtgagagagggaggatctaaagatgacaacaaagtttctagcttgctgacctgggaagtgttgagggagaggaagggagagggaggaaaaggggtatcattacactaagaacaaaaaaatgatttcacttcaaagaactgaatatttaacctctgcacttgtgtcactcttagctggagattttcttctatttttatgggccaaagtatttctggctaaagagagagataagatgtactacagaggaccgtacttgcatatgaaaataaaaagcagatgagaaaacaatcttcaaagcctttctcagagtgagttcgctctccggaggcttgctttccacattctcatggcattaggaaacctcagggggatggtatctgcctctgtcacacaagggaatgaatgtaacatatagtattggaataagctgaagatagccatccaaacagtattaatatgttttaaacgtacaaaacatttcatatgacttgaggatttttgtaagttagaaattcgactcactagcatggattacaccttaaataaatatagtttcttccctggtgttttcatacatcatggagcaaatttatatttatttggtaaacatttgcttattaaataaacgtttgcctgaagttgaaaggggatgctatatagagctcccctaattgctctgttagctcatttgacctccagaggccctgggatccaaagagctgcacccccacctcaggaagcctggagaaagccaggcagcagcaggacagtgagattttgttcaacaaatctgtattcatagccagatactataatgggggttggaaaatacaaagatgtgaggggctctcagcttgtctgtaatgaagtgatcagggcagggcaagagtgtcagattcagtcatgtaggagcagccctgtgcagaaagaaccccacggccagggagggaggctccagggaacatatggctgtcaccatatgggagtcgagagggctgagaagacagacctccggggagagtatctgaggcttcctaaatgctcatacctcaatttatagcagagtgctgtcacctgaattccactcacactgctctgctgggtctcctcactaaagcaagcacacccactgagaactacggcacgcttgggccatctggcccctctcccacaccctgcaacacacacacatacacacacacacacgcacgcacacacatgcatgcacacacaggcacacactcaccaactgaggtctgtgaacaatacaacctcagtcagttgcactgtttcatttgtacatattaccgtaaccaacaaatgactgcaaaaaaactgttgttcaatgaatactctggaaatgcatgatggaggtagactgctaaaaaaaatgctgccaaatcaggtgtgaaagacattatctgtaaaaaggaggaaggaaaattgttaaaaagaaatctaccagatttccaggtgtccttaagtccttccaactgtaatacggctgtggttaacagaaaaacaaagatgtggaataaggcagatccatattaaaagaaatagcctgggacttctgtcaaataactggtgagtaaatgtgcatttctgtgtatgtaattaaaataaaatgtttaaggaatatatggatcattttttttgagattctgtttactggccaactactataagaattaaccaaaaacctaatgattccccaattcctcttctacataaatttaacaacctcccactgtcagccaacatcactcccattaccagttaaactcccttccaactggaaaatcattgctctgttactggtctttatcaaagatgatttccaaaccatacaatctcatttactgtgatgtagatttagctttacttgttaaaaaggattttatactaagatttaaaccttaaccattgccaaatcttccttcagtttgcccagtaagatttcatacaacctagaaaagaatttagagcctgaataaatatatgaagtgctctagcaaagcactttcttagtgtttgtcatcaattatattccagttgcaaaattttagatattgaagatcatttcaaaaaacttttaaaattaaaatttgaatgcaaagtatgtagctactttctttgttttggtatatggcaatgtaagatactagagagtaaaacattcaagttgtaactactgaaattaaatttgataagaaacttgtccttttattgaataattactttattcatgttttttgaaaaatgtattcagttggaggagctgtcctctttttaaaactgatgctttaaaatccacgttataaaaacattactaggccaaggcgggcggatcacctgaggtcaggattttcagaccagcctggccaacatggtgaaaccccgcctctacaaaaaatacaaaaattagccgggcgtggtggcaggcacctgtaatcccagttactcgggaggctgaggcagcaaaatcacctgaactcgggaggtggaggttgcagtgagattgcgccactgtactccagcctgtgcgacaagagcaagactctgtctcaaaaaaaaaaaaaaaaaaagatcatagctctttcttcagtgtcttaaaatatcaatatattagtatataatatatctctagcatttttgtaaggtctcagaagccctatgaaatgctctgggttggcacttgatctttacacacaggattcaacataacagagcaacttgagaagacagaactggatttcctgaatgggtaatgagctcctttacatttaattcactggaggctaacatcatccttaattaaaaaagaaaaaaaaaggtactattaaaattacatttacttcctacaatagaaagccaaaatggaaactaccagagcttcatgaattttaaagccctacgcaaacgttgttgcacaaacacaatttcctctagtcctagaagttttgctcaagttgtattagctccatacaacctgacctacttgttctaaaatatttggttgcaattcaaagatgggattctttcttatggatcccacatttatagagcaaatgtacctaaatgttaatatatgttcatcataaattagattaaaaactaactcaagttaattttagtatgtcattatacagtattaactaaacaattaggataaaccactacaaaacagtgagctgtgacatcatagagccatttcctttcaagccctacccttaatccactcttccacctgccaatacacacacatgcacgtgtgcacatacgcacacagaaccccccctccaccaccacctttcatggtgtatttttcaacccctttagagaattgacaaggatagaagacatttaagattaaggtccataaagtattcattattgttgttttctgctttctttaagaactgtctcgtcctatcaggacacacagctatgctagctcagctgtaaacaaaaggatacgaccttgaaggtgtctatagctcactggttttagatgccgactccacatcttcatcacagctcctaggtggtggctgcactgatgtgtacaataagataaactgaatcgctagctgaaataagcattttgaattttcatttgtatgtgagtggattcaaaagattaaagtgctatatccataattacatgctcactactattaaaaatacctaagctaacttctaattaaaagggtggatagtacatgtgtattacctcctctccctcctgaacccctgccaaaaacaatatataaggccacaaagaagaaaagatccaagtgaacaagagatgcaacacttttcagaagatggaaaatgaatacagaagtagttataggatgagaaatagcagaggctacagaggggaagaccacacagaaacaaatttgctctgcaacccaggctccaggcttaggggagcaggacccaaccacaaagggaatagtagggtgggtgtagggctgagaacaggggagtgaatgaatgccagcatatgcaacacttggatccccagatcctgcacagacactttctcccctgacctgcagagacagtttctcccaggaaaagagctggcttgctcaagagcttccaatttgcttcctagtgactcactgggttttctggtggtaaaatacacataacataaaatttaccatgttagccattttaaaataaacagttcagcgacattaagtatactcacattgttgtgcaaccgtcacccccatccatctctgggactttttcatcttcccaaactgaaactctgtacttatcaaacactaactcctcactccctctttcccccaaacccctgccattctactttcttctctatgactctgtctactgtaggtacctcatgtaagaagaatcatccagtatttgtccttttatgactgactcacttcacgcagcataatgtcctcaaggtccatccatgttgtagcatgtgttagagtttccttcctttttaaagctgaataccactctatagtatgaatataccacattttatttatccattcatccatcagtgggcacctgggttgcttccaccttttggctattgcgaatatcgccgctatgaaattgggtgtacaaatacatctttatatccctgctttctagtgattcactcttacatgtgaacagataactaaggatcagaggactttttaggaaaacttcccaacgttaaagacagaaaccaaaataaataaggaggaagggctcttgaaaattaaaatggtataggccaggagcagtgactcacgcctgtaatccgagtactgtgggggaccaaggcgggtgggttgtttgagctcaggagtcccagaccagcctgggcaatgtggcgaaaccccatcattacaaaaaattacaaaaaaattagccaggtgtggcggcacatgcctgtagttccagctactcgggaggctgagatgggaggatcacctaagcctggggaggtcgaggctgcagtaagctgagattgtgccactgcactcctgcctgggtgacagagtgagaacatatctcaaaaaaaaaaagtataaataaaaaaggttagatgggttggaaaataaagtcatagaactttcccagcaaatagcgtaaaaagagagatcaaacatagtagagaaaagataataatcaatgaagatggtccaacagcaaatttataggatttctagagagaagaaaggtgtttatcaaataaactacgggagatatttcctcccaaaacgatattggtatccacattcaaagggccttccaagaggcttgcaaagatgaaaatagaccatacaaggcacatcgtggtgaaatgtcaccatgccgggaataaagacgctaaaaccttccagagcaaaaagcaggtcatgcaaaggtttgggacacagaatagtatcaaaggtctcaatagcaacattcagatgctagagtagaacaatgtttttcaaattcagagaacaataccttttaagctagaattctgtacctaagcaaatcatgaatcaaaaaagaggcaaacaaggtctccatcagaggagaggagcagaaaagtcccaggaacaggggcagcaggcccagagggcattaggttggtgggcacaagggcacaggagatgaaagcttctggcctcacactatgggtctgtagctttgtttctgattgattcatgcagtcatacaacagtgttttttgtctattatgtatcaggcactcttcccttctaagtgctgggaacagaggtgaaaaaaacaaaagttcctgtcctggtgcagttttcattctaaggcgggagagggacgataaacaaatataccttgttaggtaatgtcctatgaggaaaataagcagggaaaagggatagggtgtaaccaggtggagtgctagactggaaagaccagaggtgaccttggagacctgagtgcagtgagggagagagccctgggcattttgggggtctggagagagagctcttaggcagagggacttcaggaccagctgccctcatcagcctggcctcctgacaggcattctccaatggacaagattttctcttgctcccagcctgttcatttcttctggaccctctgggaaacaactctgcctggaggcagatggcagggctaagcagccccaattaccacatggctggggccctattgggccagtcctctttccccttcccagtgggggagatgacacaagactctgcaagagagatgggaccccagaagacagaaaggatgcaagtggttgagtgctaaggtggtaagtccaggccctgaagccatctaggcagacacaacatctgacacttacactgctctttctgtgcattttcacaagcaagagaggcagaacaggtaccaccatcatgcacagatgccgaaactggggcactgccaggtaaggaacctgcccagggtcacagagcctgttagttacagtacgaactctcactggggcctgcttcagagaccagtgctaggtcaaaaccaaacgtaaacatgtttttcttgttacttttcatgttttccatacaggtaaaaataaagcccaagttgtaagtggttcatgagaacagaagatctttttatttagcatttcacaaaatataaggctactcctcttgagacttcaccttgagctgtaattttctagctacccatgggtcagagacaggcactagaacttggttagacttactccacctcagattaggagcaattaccgtttgggaaaagaaaagcaaactgaaggatggaacagtctacctagaagatgtttcaatgatcggataactagcattatgactagttccccgccagaatatgccgcctcagccttcccttccaaacgctgcaatctcctttccgttacctatcttcggggttgcagttttgttctaagagcagaggagcatttgcatctgcggggcgaaggtgctgagtgggaggagcggccactgcatgcccacagaggaagctgctgtgacagccctgctgctcctgctgagcaagggaactagagtggcccagtctccacctgggtctggctccgttcccgaagctgattcaggaattgagtcatcattcgcaacctgaagtcaaggaacatcttaattagatttaaaacactgtatttcaataatatctaacagtttaaaaatacccccacatttaaccctcagcattcctgcgtgagggaaacacagtggtgcctgcaatttacttgaaatgagtaaaacatgtgaaatggacagatggatggatcggcagatacgtgataaaacaaagtaaaagaataaaggtagaattcaggtattggatatatgagcgttccctgtaaaattctttcagctttgttgtagttttgaaatcttcataataaaatgtcagggagagtgggagggagggactctcccatcatcctggattatttcaatatccatgtgaatgattaattcaacaacccagcctcaagcttcctggccctctgaatgccggcactctcccgtcacctcctggaccttacctcacttaaaacagtcctgccttgatcttaaactatctcttcagaccagattcctttcattccagctcactgcctcataggtgcttccgcttcaggaaggtatctacacctaaaccctccatttccccgtgacttctggtgcttctgtatccaacagagatttatcagccccctcagcaccttccctgcaaacctgcagggccagccactgtcagggaagaggaacacaggggcaggaaacaacctcacagcccctgcctgcagcaagctcatctggagctgagagtagggacggaggagatgtgtgggcacagctctcacggggctttgctgccatggttcctgtgggcttgcctgtgcttctctcccctgctggatcccctcttttccaccgctgcatcttcccggatagctcagtttactctcattttgatggatcatatttttcaacagcttaaacagtttttattatgaagtattttaaacataatcaaaagaagagagaatggtataatgaacccacatatacccattctcaacagtaacaagagtctggcatatttgcttcattatcccattttttttctttttctttctttcttttttttttctccatgacggagttttgctctcgttgcccaggctggagtacaatggcgcgatctcggctcattgcaacctccgcctcctgggttcaggtgattctcctgcctgagcctcccgagtagctgggattacaggcatgcaccaccccgcccagctaatttttccatgtttttagtagagacggggtttcaccatgttgatcaggccggtctcaaactcctgaccttagatgatccatccgccctaggctcccaaagtgtcgggattacaggtgtgagccaccgcacccggactttttcttttcattctttgctcaagtattttaaaggaactcagacttcttcagtgtgcctctcttaaactccaggcctgtaatcccagcactttgggaggctgaggtgagagaactgcttgagtctaggagtttgagaccagcctggtcaacatagtgaggtcatgtctctacagaaaatttttaatctgttttcaaatgtatttgcagagttgtgcaaattaaaatataagaaattaatgcaaaggtcagctaaagttgctgtctattaatttgatatttagtagttttcatttgtaaattaactaactcttagactgcaaataaacatttttgtaaagggctatgtttttaagtttctaagaaaatcttcagttagcagtttagagtcttctaaaattaaagtagaaagaaataattggtgtgaaaatgcaagggttagctgtgttagaaaatgtctaattgagggttgtaagtttcttctatcttgagaagaataaatattttgaagagtaacattgaaggtggcatgtttaaaagaaattaaatggttattataaaccacaggaaaaatagtagaaaggaaatggtaacagaacaatcaaagaaaagcataatgggataataaacaggttaacagtgtaataatgataattaacagtaacaagatattgttaaaattttaattaaacttaaagcagcagcaggaaatactgaaaaataaaatacttggctacataaaaatgtacacttctacttacttctaaccttataaattctaaaagaaaaaacacaaatggtaaaacacatatgaaaaaactgtttaatctgaacagtgcaaaaaatgctaacaataacactaatgaacaatttttcacactgcaaatcaccacagattaagaagactgacatttttagtgtgatgaagacaagttccttccagcttttgggaaggcagagtggcactctgtgtcaaaatgtaaactgaccataccccttcacccaccaaatctatttctagaaattcacccacaaaagacaatcacataaatgttcaaagatctatctattgaagcagttttcaaaagagtgaagattaggaaagacttatccactaataatggatagggtaaataaacaggtacattcacaaaaatgactactgctacagtcactgaaaatgtaaggatgctggagaaagtcacataataaagaaaatcagtgccactataattcatgatcactgctcccaaatgggtcctcaattccctttctctaaccgcagactcacaggcccttctgctgatgtgatataagctctcctatcagcaataaacaggaatgaagtattgatacatgctacaacatggatgaaccttaaaaacagcatgcaaagtcaaagaccagacacaaaggaccatatattatatgattctatttacatggaatatcccaaataggaaaatctataaagacagtagattagtggttgcagacttgggatggaggtagtagggggtgacagctggtaatgaaaatactctaaacatgactgtggtgatggatgcatattcaactctatgcatgtagtagtatattcaactctgtgaatataatacaagccactgaattgtacactttaaatgagtgcattgtatggcatttaaattctctcaataaagctgttaaaaaccaaaagctctcccatatgtggaatgtttgcgtgacccctgccacctgagtaccctcatgcttacagctaaacatgcctatgtgttattctaatgtgtgtgagtttcaccactggcatgcaacaaatcagctctatattcatttgttactccacctttctaaaaagctatctgacatattgacagtacataatgacagctaaaatttcttatcctttaattcagaggtgatctttttgaaacctttaataaggaaatacaaaaactaaatctgtcacccaaactggagttcagtggcacaatcactgctcacttcagcctcaacctctctgggctcaaatgatcctcccacctcagtctcccaagtagctgagactacaggcacacgccaccacacctagctaatttttgtagagacagggttttgccatgttcctcaggctggtctcaaaactctgagatgggctcaagtgatctgcccatctcggcctcccaacatgctgggattacacggatgagccaccatgctcagccaataatttttataattggaaaaaactgcaaaaaatctaaatgtttaacagtagaagaatcaataaaccataatatgcccatacaagagatagcaaaaagacattaaaatgttttcaaagaatatgaactatagagtgttcatgatgtataagtgaataaagcagaacataaaagtgtatatataatgtgatcccttttatgtatattatacatttctacaacaacatggatgtgggagcacctactgccttctctgaataccatccctttccttgagagccactgtcttggtgtaatgtgaccacactgcctagtctcaggagcaggggctaatctggggatggggtgggctaatgacaggctctttcccagaaatctcagccatgagattcaacttggttgctctcctaaacggagatcttaaccctagggccggtttgcaagtcggctgcagttagctgttatctaaggaatgctgggaatgctggtaggggctaggcccacggggcagctctgactcctccccatagtcccagtgcttaaattccaaggtacttagcttttgctgaaatgctggggcaggaagtctcccagaatgcagtggctgtgaacagcaaggctaatcccatgggaatggtggctgtgtctacctgtgccagcagttccctgtagcatcttcttgttgaacccactccagtcacaggaaataatcagagagctgattatgctatgcaaacaaccaggggttgtggcagtctacaatttccaaccacttgtctaaagcgtgattcagaggggcagcaaccagtcctggtcaccacaagctgttacactttctgcaggctgggtatgcaaaatttacctttctttcagaatatactgtataattttacttggaattcttattctactctcacagcatgttccagatgtcacacagcatgaggaagcaagtgctctccagcccaggatctgatagcacccacatctttgaggactgaggacagagggcatcaggaagccctgacaactctggcacatctgccaccaggtgtgtggtgaggtcatgagggcagacactcaggcgctactcctcttcttctcctggttactcaagaaagctactcagtacttccatacctgagtttcctcatcttcaaaagggaggttacaccctctaagccgtggcattcaccaagaggctgggacattattcttagaaatacacaaatacacgcacccttttttctagtatgggctgttcttaaaggtatgtgtcacactgagtcagcaggctcctgggtccataggcaggtcagcagtctctgacacattctccttcagctcttctgacaggtagaccttccatttttacagctttatggaaggatatttcacagaccataaaattcaacactgaaagggtaaagttcaacgcttttcattattgacacaagcagatcttgactgtcacagagagaaagataaaaaacatattagctcctttctctagtggcctgcatcctctgttccctgccatctcttaatctttccctccaataatgtttgcctgggcatcccctctaacccacagccactttcagacccctcagcagcacctcctggtggccagcaagccttggagggagggagccgccagctagtgcagcagttagctcaccatgccaggacccacactccccccagtggaataagctctatgctcagacaacagacttaatgaaaaccaaagaaacaaggataaaaatgaggtgaaagaaatagaagtgtttttgtgaacttttaaagtacagtaaataagtctagagtttataagcaaaagctgatatttttttaaaagagctttactgcataatctttatccttattcccacaagcagtcaaaaatcccacaaccacatgaacctatcaaatagtaaagaagcatttgggaacaagagctaggcgcagaagctcacacttgcaatcttagcactttgggagaccgaggcaggtggatcacctgaggtcaggagttcaagaccagtctggccgacatggtgaaaccgtctctacaaaaaaatgcaacaaattaaccggacatagtggagcatgcctgtaatctcagctactcgggaggctgaggcaggagaattgcttgaacccgggaggtggaggatgcagtgagccaagactgcgccattgcactccagcctgggtaacaagagcaaaactccatttcagaaaaaaaaaaaaaaaagtatttggggacaagaaatgaattaatatgtgtgacggacaatgacttaataatacctaatctggttctactttcttcatcttgatttctacttttgattgcttcttattgtaaggaatattttcaagacatattttctgtttctcatttatttttcactggtcatattttctaatcctgtcttcactttggtgtcttctctggattttagtagtgaaaatgactgacacgttttgaaataaatgttaaaaagataaaaagaaaaactcttgcctgaaaaattaccctagtattcaagctacttgtgtaaattacagaaatttaaaaaaactctagataatataattatcagatagaagttctacaatgagtacatttgaaattattaaagacccaaagaaataaaaatcccagggaacaaaaggtaaatacaaagcatagaaaaacatgatagtgaggtgggtgcatcacctgaggtcaagagttcaagaccagcttggccaacatggtgaaaccccatctgtactaaaaatacaaaaattagctaggcgtggtggcgcatgcctgtaatcccagctattcaggaggctgaggcaggagaatcgtttgaacctgggaggcagaggttgcagtgagctgagatcacagcactgcactccagcctgggtgacaaagcaagactctgcctcaaaaaaaggaaggaaagaaaaatatgatagaaatatatccaagtacatcataaatcacaagtataaataaataaaatgtgtccacttaactggatgaaaatttagaccatgtaaaaagaaaagtaaaccccacaaaatccatagagacacatgcagatacacagaggttaagagaaaaagaggaaaaaataaatatactggaggaatttagattctgagactgaaggatgagataattcagattaactccccctctgaacacaactggaaaaaatataaaggatattttcttgaaggcattatagaatcaagaagatggtaaagaatggccaagccaagatactggaagaatggaggtctgagaaggtgagccacgcatatggggccatcttccccttggggcaccttctgattctggagagcatcgctgagcaacaaggactccatccagggctgaaggcacataaattggaatccaaggcccccgaaagccagggagcttggttaatttggactgggatcctgaaggggtactctttaaaagcaaagaccaaccagaagttggcaggccctcataggcactgcagcttagttctgaatcatttcagtccttgaaatcggactgatgttaacccagattgctactgctgccaagtgcccaccagaaacaaacacaaacccatctcggaggagaaatatctatcatcctagacctcaatttatttttacattttttcaatctttagataactcaatcaaaaataaccaggcatacaaacaggcaagattatatagaaaaaaaaaaccactagtagacaccacaagcaacagaaacatacccacaattgctctagatttagagcaaaagaactatgtttactatattcaacaagataaaagatgagattgttttggcagagaactgtaaaccaaaagacgaaccaataaacatgcagagaggctcaatatcattagtagttagggagatgcatattaaaactaaaataaactactagtacatcccaactatgatggttaaaaatttttttaagtgacaacgacaagtgttgctaaatatattgagtaattctcataagctgctggtacaactataaattgtttaagccattttagaactgttcggcaatatctaataaaactgaacatatgtgtaacctatgatgcagtgactctatggcaaggttatacatccaacagaaactcatgcacatctacatcaagagacatagacaagataactcctactcgcaaaatctgatcactagaaggaaaaatagataatcttactctcacaatagtagagttaaaacacacacttgtcggccgggcacggtggctcacgcctgtaatcccagcactttgggaggccaaggcgggcagatcacgaggtcaggagatcgagaccatcctggctaacacggtgaaaccccgtctctactaaaaatacaaaaattagctgggcgtggtggtgggcgcctgtagtcccagctactcgggaggctgagacaggagaatggcgtgaacccaggaggcggagcttgcagtgagccgagatctcgccattgcactccagcctgggcgacagaatgagactccatctcaaaaaaaaaccaaaacaaaacacacacacacttgtctcaataaactaattgatcaagtagagagaagctgaataacaaccaataaacccaatctaaaggaaatatgtagatccaactagagaacccattattttcaactccacagtcattaaagaaaaagaaaaaatgcaaatttcaacaatgatcaaagaatctttatcatacaatttacattatttaaacccaataaaatcagaaatcaaggacaaaaaaaaatcttggaaatttatggacacagttttaaaaaatcataggtcagagatgaaaccataaaggatattaggaaatacttacaactttaatgacaatgaaagcactaactattgaaatatatgggattcagctaaaccactacttagagagaaatgtagagttttacgtgtgtattagaaaagaagaaagcctgaaaaccaataatttaaatgtatgactcgggctgagtgctgtggctcaggcctgtagtcccagctctttgggaggccgggggaagtggatgacatgaggtcagaagtttgataccagcctggccaacacggcaaaaccccatgtctactaaaaatacaaaagttagctgggtgtggcggtgaatgtctgtaattctagctactcaggaggctgaggcagaagaatcacttgaaccagggaggtggcggttgcagtgagctaagatggcgccactgcactccagcctgggtgacagggcgaaactctgtctcaaaataaaattaaaaataaataaataaataaatgtatgactcaagaagtcagaaaaagaacaagagtataagataacaggggcagaaattaatgaaacttgaaacaaaaaaaaaatcctgatttttaaaacagcagcaaaactgaaagctgcctttttgaaaagactacaggaaaatagagaaggcataaataggaatgaaaaaatgattacaactacagatacagctgacatttttgaaaaagaatactatgaacaactttatgcaatacaactgaaaatttagggaaaagtggacaattccaaaaataagtaacattaaaattcagtcaagaagaaatgtaaaacttgaacaaacctactaaagaaattgatccagtagttaaaaacctattccctcaaaataaactaaaaataaacaaataaaaccctggacacctgccctagatggtattatcagcaaatcatatcaaacattcaaaatgcagataatctctatttacacagactattacagatgacagaaaaagaaattattcccaactcatataatgaagctaagaaaacccaaaaaccaagccaaacaagtacagcatgaacatctcacttactaacagattttaaaaacctaaataaaatgttagaaaatacaattttacaaaatcttaggcaacaccattgtcaagtacaagttatccaagtaacacaaaacaatatcatactagaaaatactttagtatgattatttaattcatcacattgacagactaaaggagaaaaactgcattatcatcttaacaggtacaggaaaatcactctttaaaattcaacactcattcctgatacaaacacctggcaaaccaagaccaacagaggatttctctaacctgataaagactacctacaaaaacatacagcaaatatcatacttactgatgagacattagaagcagtccctttaaaatctggactaagataagggtgcccactatcaatcacagcctccattcaatactgtgctgaagtgcctgacatggaagtaagacaaaaaggactggcgtaaggattggaaaggaagaggcaagtctgtcataatgtgcagagaataggaaagtctacacagaataactaagaaaatctataagttattagaattaaaatgaaaggttcctggttataacctgaaaatacaatagtcagttacatgtctagacatgagcataaaaataaaaatatacagctgacacttgaacaatgtgagcgttaggagtgctgaccttcatgcagtcaaaaacccacctataactcctgactccccccagaacttaactactaatagcctcctgttgaccagaagccttaccaataacgtaaatagtcgattaacacatattttgtatgttatatgtatataccgtattcttacaataaactagaggaaagaaaatgttgttaaaaaaatcatatagaagagaaaatatagttactgttcattaagtggaagtggatcatataaaggtcttcattcttgttgacttcacattgagtaggctgcagaggaggaggaagaggaggggttgatcctgctgtctcaggggtggcagaggcagaagaaaatctgcatataagtggagccgcactgttcaaacccatatggttcaagggtcaactgtaagtcatgtacaacagcaaaaaaactatataacaaatcaaactagtcacacaacataaagttttattgaaagtaattttagaagaatagagagatgtactctattcacatataacgagtccaaattataaagttattaattttccccattctaattctatatgttcaatgtaattccaaactcctgctagggttttctgtgtggaatctgacagattgataattataaaatgtataaagaagatcaaagagccaagtacaaccaaggcaactttcaagaaccgcctaaggtgggaaagtacttgccctactgttagaggaaaggagtcccgatccagaccccaagagagggttcttggatctcacacaagaaagaattcaggtgagtccgtaaagtgaaaacaagtttattaggaaagtaaaggaataaaagaacggctactctatagacagagcagccccaagggctgctggttgcccatttttatggttacttcttgaatatatgctaaacaaggggtggattattcatgcctaccctttttacaccatgtagggtaacttcctgatgttgctatggcatctgtaaattgtcatggtgctggtgggagtgtagtagtgaggaccaccagaagtcactcttgtgaccatcttggttttggtgggatttagcggcttctttactgcaacctgttttatcagcaaggtctttatgacctgtatcttgtgctgtctcctgtctcatcctgtgacttagaatgctttaaccgtctgggaatgcagcccagtaaatctcagcctcattttacccagcctctattcaagatggagttgctctggttcacacgtctctgacaataccagctttcaagatttgttatacaattatagtaactaagacaggtttctacacagggagaggtaaacagaccaagggaaaataagagagaaacaaatccacacatatatggaaacctggcatttgacagacatggtattatagatcagtatggaaaggatgaaacacccaatatatggtgctgagacaactggtaatccacattgaaaataacaaagcaatctctacttcttgccacatccaaaaactaaatttcagaataaaagactcaaatgtaaaaagcaaactttaaaactttaaaaaaaatatgggagaacatctttatgacctggaaaaaaaagggttttttaaaacaagacattaaaataaaagaaaccataaaagactgataaaatgactacattaaaattatgagcgagaagcagaaaataaaaggtaaaattactgacaagaagacatttccagtgtatattaccatcaaaggactaataacagaatacacaaagaactcctacaaatcaacaatcttctctccaaacaactattttcaaaagtatgaaaagcctccatttttgttttcattttgaaaaatgaattatttaggctcactgaaaatattcttttccttattgtaatttctaacacagaattctaacactgattttgaatagtattagaactattgaaaacaatttaatgattaatacatttgaactgtttttatgattataaaataatgtgtaactatgaattttgtaaagatatcaaaatacacatttgaaatatttaattaaaatgttaaaattaaaaagaaacaaatgtaaagagcataaaaatcattaaaaatccctcatgcatcacacacacacattttgtcaatattttggattttttctttactttgtttctattaataaatacatatacatagatgcacaacaagctgggtccaaagtgagggtggcttattcaagtgatgacatccatcagtcagtagatgatgcaagctaatgcttaggaaagaggtgaggtctggggatgttgacttgggaggtcatgcttagagcaataaaagttaagactcagtcttggatgaagagattgtaggaagaaaataagagtgaggacacaatattagaataaggagcagaataatatgttgggaaaaataacttgaaaaaagagaaagtacaattagataggtaggaggagaatcaggatattgtggaagaatgtcaagaagaagataacattcaactgccaatcctgaaaagaagttaaggagaatgaatcctaagaaaaggccaacatatttaacaattgagagagacggctgtggagtaaacgtctgattacaggaatgcaaagaaaacagattgaagggatagggatatgtgcatatttacaccacacagtcaacaaatctggccagaaagaaaggtggcaaatcaagctttttttcaagatattagagatctgttatctgtctaccttctctgggcgagaagcccagtatactgaaagactaaagatgctgggaagagagaagtaaacaaaaacacaaatgcctgaaagcagagggagaggatggactttaaaagagttctggatcatgacttgtcatctgacacaggagaaaagaaccggggtcacaacagacatagttcaagctgaagaggacaggagaaacctctggctaggtaaacttagtaattttagtaccaaggtacgtcacgggacaaaactcaacttaaatcaagaagcatccacactaaactatacctaagggcttataagagacgaaaaaaaatccctcattatgtctttgcttcaactcacccatgacatgagaaccaatactggtatttgggtgaagcttcaaaacaactgaaactatggggaatgtttcaaaccagttaagcactgacataaatgactgagaaactccggtttccttaaaataagcaaaatattcatttgttttgatattattttttgatgatacaagtgtccatctgtagtagctagtcaataaatattggttcatgctacctgtactgaatgtttctgtgctacatggtcaattgcataattgccagtttaaggtacagcattaagagcaaaacaattcacggtgaaataccccacccatgttttcctacacatctgtgattcaacaaggaatgtaatgattcacagtattggcattaagtttatattgaggttgcccttttgtaactgagaagtagggctgggttgtcactgtgatcttcccaatcccttccacatccaaaccctcacttcccttctcagccccactttgaatgacgccaagttaaaacactaatgtagacatcctctgtcataaagccaacaaaccagagaaacaagaatgcttattgacctccttccttaactacttcttaaaaagggatctaaaatttatgagtaataaaattctaaaaagaacatttaccttctatgtgtatgcataactaaagcctacaactgaaatatttggaacttctaaagtagttttcaacttcaaatacaaacttatattagagacaaaagccattagctttgctatgagtagtgtgaagggttgatgtgacttgaggaagcaaagtttgcaaagattttcatttgactgtagatttacaaaatgtttaacaatttcagttcctgaaatagtcaatataggttaaaataaattagtaagttaaatgtggaagtctttaaggtaataacaaagcaaggccatcagagggaaactgagaattatctctctcaaatatctggagagtgactgtcaaaatcaagtcacaaagaaattactacattcacattattccgtgttccacagatgtttcttctattgctcacatgaactcttttctctttgctttcacactcaccagtaacacttgtagatctcctaggtcatttgaacatttagcattcaactctttgatcagttcaaactgcctccacagaacatctttttctttcaagcgttccttattctcaaaatgttccttgaatttcaaccaaatttaaattccttacatttaccttctaaactttgtattcacctcctctgttccaataaacaggaacaactctctaagcccttgtgtcttgtagcaaccattgccaggcattttcttaaaattcttacacctcccttgaggtgctggtagctttagaaatgtcgccggagcagcatgaaattagccatgactaggacaggacagtcaggaattgctgaagactctcatgcctgcttcaccacctatggtcattacaaaggacttcaaaattcctggcttttccagtcctggaatgaccctgatccctgccccattcctatagcacaatcccaaaaccatacatggtctttctcaccacagttcccctgccaatctcttaaatgctcacatctaatgcttaggccaaggctcttgtgttgcacaagaggtcccctacacccccgttcctgctgacttcacctccttgcatcaacaatctggtctcctgggccatcatttcaatcaccctctcacctttaatcacaactatttccttcctttgtctttctccacataccacccttcaaaaccagcagtgccagctctccactgccacccccaggcagatgtgctttgctggagagagtgacaccagactggccctggtacagtcctcaacatgttcctagccagggttccctctccttttctggtcctcagcagcaatcctacatcatcacctctctgtagcatccccaccttctccctcttcctcaactggcaatctcaatgcccactcagggaatgaaactacctcccaaccccaaactggtctctatatgagttccctcctcgctgggggtttcctccctcctatgcgctagagtccatccatctgtcccatccctacagcaccagggccctccattctccctttccctctggtatcttcgaagactctccacagccatctaaagatactcaacactctcccacttaaaaaaaatggcacatgttaaaaattaaagacttctatagagaacattaacacgccactaaatactgaatagagtcgtccagtcagtcttcatcatctagctcctctatgttgccagcacctgtcagtgcctgccttccccggtccagcctgttgtagacattgtgctcattccttgtttcttgtttcttcagccccagaaccttcctaagccatcctgaccaagcctttgggcttcctgtgtctgcatctacagggccacccgccggctctccaaactgaggctttcttccccacatctgcagttctgattgctcaactcttggcttggtttcagattagtactccaggtgctgcagtctgactaaactcccacttactgcactcatgtccaatcagtgtcctgacaagacaccagctccttttccctgggggtacaaaccttatctcaatcccgcaaattattaggggtccccgtgctcccaaattcatgtcactaccactaactagtggaatgaagtactgttattgcttacagaccgctctactgggttcataagatccaccttgggtttatcaagttcccttagaaaatatatttagaacgctggcagcccagtggagtccagctacacagctcggcgcgtttaccctgggatcccttgtttcttgtttcctttcatttccttctccaaccaatttcccatcatacctatgggcaaacacccatgttataacaagcaattcattaactacttattttaagttatggtgaagtgttataaccataatatttataagtgttatgaaatttataagttctgaaatttacacaattctttcagtggttagcaaaccatactactattatagactctattatatttcataaccacatattatacacaacatgagaagatctctgtttaagagtcccacctatggtatttgtaaaaccattcaatcaggcaaaaacaaattaaaaaagtaatatcagatagtaatacactagaaaaccaaaccttgaacaaacatttggggatccccaggcttacaaatgtattggtttctattgggtaaagtcttggctttctcattttatatcatttaaacaaaggaactgaaaattatattttaaaataaaaaccataatctaaaactaatctaagaaaatactgagaaaaaatagcagtaaatttatatattttatcttctgtaatgaaaactaaggggaaaaaggcatgctaaaagcaactagttctaaagtaacttcatgaatgtaccacacagaatacttaacagctttaaaaagcagttatgaaatgcccatttgaacatcagatgccacggacagaacaagtatccaacctaaagcagacaacacggacccactcaaagatatgcagtgacatgcagagtcgtacttcacacaatcctcatttggagaatgagtcaagaagggcagcagcgcgaccctccaggcttttccaaaatgaccctcctgataactgaggagctccagctgggctgttcttttgccctggttcaaaatatacctagatgtggaaaagtacaaaggcaagcatttcccatccactagaaaagaagttcaattatcaaatgctaaatctaggttacactaaaaaaaattagatgaattaaaatgtggcctgcctcaaagcaagagcatgtcttaccaatcttactgtatctcacttaacatactcaagaggaaaagaaattgaagcatttaagtagtccatcttcaacattctgctgtgaatacaggacctgtaatatgcttgttctacttgacatataaaaagaatcacatttatgtggaagcctaaggttaaaacaggtttttaaaatgtaaacagcagtaacatgaatgtattgaattacgtaaatcccaaaacttttcatgccacaatggtatgggaaggtcggtgactgactcacctaaataaaatgcagtaagtcaaagtatatagttagagcaaaaggaaaaagataaaaacattttaaaaactaatttatggttttaattctctataataaatcttttaaaaattaatacacagtagaaaatggagaaacaaagttaataaatgcttacaaagatggcttatgttatattaaacatgaaaatgatatcaaagcataattatgaaatcgtcaaaaatcacgtttgtagtacaagtttacagctagttttaaacaaagaattttgaccaattacttgcagaaagtaaacaagaaaaaaagcttgacttctttctgacagcacggaagtccttataaaacagagcactatgtcattcgactaccaccccccagttatcacagttcttggtatataaatcaccttcgaataagcacagggtgtctgaaatttccactctgccctaagtaacaccattcaaaatatcaattgcttccagcaattcgaacaatgaaaataactttaaattggaaagattatcccactttcatctccacattaaagtccatccatcataaatttaagtagagttatggtgggcaagacgtagcaagaatgaaataaagtattttaaccacaagagacccaaacaggacttggcaacgcttcctaactgcacacgctagaaagccctgcccccatgtggctgaaagtcttgcacagctggccagcttgccctggggcataagggagaaggttcatccccgaaattgccatgttaaatgcccacttctggctgttggaagatttaggataccatctactaagcagaaaggatacctttttcccaggctcagtgtcttggacaatgtgaacacacaactaataactgctggattatggagacaacagcttgtgtctgcataatgccttatgtaaggttccctcccacggatgcagcaaacacggaacattcaagttctgagatgatgctgaggctcaatttaaatggcatctttcctgctctcaactctactttcctggtaatgcttcatgacatacgatcttttagtcattattcctaaataatagtgccctgtcagtactgggggcaaaggacgcatcttggcacttggagcttttgctattctctctccacctggtacacactctgcagtctgtgaccctccatttccacctccagctgcctggagtctctctgcgaatgcttcaattccctctggttcacagcccaaaccagagcctacacctgatttaccattagccatttcccaagcctgtactctgctccccaacccctagcacaggctcagtgactctgaaggtgaaagctggcagcaatgctggtgagtcataagagaaggcaaggaaaaataccacccagctacacaccatgtgctatggtcagaatgtctgcatcctccaaaattcatttgttgaaatcctaaccacaaaagtgatggtattaggaggtggggcctttgggaggtgattaggtgctgggctggagccctcatgaatgggattagtgcccttacaaaaaaggcctaagagagcttgtttgccctttcaccatgtgaggactcaatgagatgatgtctgtctaccaggaagtgggcctccccagacaccaaatctgcgatggcctgatcttggtcatcccagactccagaaccatgagaaataaacttctgttgtttataaccccccaaccccccagtttatgatattatgttatagcaggcaaaaagcattaagacaccatgcacttgaataacaaactctggaaatagagccactgtcaagcctattagtgactctcattgtgagacttccagaataagcaggccgtaagatattctgggggaagactgggtggggtttatgacagcatccaagtcaggttcggaggaatgggccttcctctaacctacaaagtcataactagaaagaacttaactatagcattcacttctccacctgccataggaaagaaaagagtaaatcataggggagacaaagtgattcctttcctcttggtttataaagcctgcccagagccagcacacagagcgtgtgcccatgtcacaggtggccctccccttctgcaccaggtacacagtcaggcctcacgaaacattagctactacaaaatgtaggacttacccaaaaaagaacatgtgtagagatagaaaacaacatattctgaaatgtccatttttcattctaatgctcagcagtcatataataaccagatgaactaagctgctttcatttagacttttgggaacagaatggtatctgtttcaagacaaatacaaccaattttctatctatacttgaaattacgtgtgtgtgcatacagacagattcactatgttatttatatgttcctcagggatgatttactgttccataacaaacgtggtgatcaaatgattctaatcactgactgaaaagtaatgaaataatctaagatcatctctgaaaagctgaagcagatccatattagataaaaaagaatgacttccataaatcgactcattcaacacacaggaaagcattctatctttatatttctgtatttttcaacctcctctggcctgcttgccaccccactgcccatggcctatgtcaccaatcacctccaagtgacccccaccctcgcccctgccccgatgaccaccataaccacagcacccagagatgagtccactgcactgtgccactttcacagatgggggaggaagagagctgtaactgtcagaaatacatgaaaactgtcaaaaatacatgccatcagctctggagattttgaagcactgatgtctctctgttctgtgaatgtattaaaaaaaaattacattatccctcctttcaaggttagcaaaaataaaagatgaactctacttccacctctgcaaatgacctcctacgaccgcaggcaggcccacgctgcctttgccttccccacctgcttgaggccacacacatctccgtggaccactcctcccttccagaaactcccctgttcgcttcttcagcctctacccaggagtttcctttgctggcccctcgccttctgactgcctatgcactggtgaggttccctggccctgccttagtcctctctctgttcacaaaaccatcctagcagtaaaatcctttttcccaaataaaatggtctgtgctcctcaccctccagtagaacagataaaagcagagctactctggctgaaggggggaaggaggcttgaggccaccctcatggggcatctctacagacctctagggttgggaaccaccagcagtttccttcaaccagctggtgtgagctccatctccggtcccccctctgccccctcaacacctccccactttttgcccaacaaagtcatatgagtccttccagatccagtttcccagccaccttgtttgtgattctttatgtacaaagtagctttgagcacttcgttatcccccaaggcactctgcaccgcctccaccattgtacacgtatcacgtgtttgtttacatttttgccggctccactagattgtgaccattttaaaggcagacaagatgatgacaatggcgtgcatgcgtgtatgtgtttgcatgtgatgggacaggggagtctcagatgaacctaaagttaggcttaaactgctctgggtgtgaggctggtgcactggtctgcatgaagaggccgtgaggagggaagcgactggagaaatggggaggagaggtggctgcggtctccatgcccgcccaccagagctgcgtctcagccctagacagagagggtcaagcaaaatccaggaactgctttcatgagagacttcacaaaatatttgttaaaccagaatactgaacgcataatattctcttctttgaaataacattttctctattcttttcattaagacccaaatttctaaaaggcctatattttcttctcagttctgatgaataaaattctgcctaaagtcagagtcaataagctcccgaactagcagttgctaatgaaaagaaactctgaagagatgagagatgatggcacaggtcaactggaatggagacaaaatactgagctgcaaaaccgatccagaaagcccactaggtggagatgaaggccggtaccactcacaagaatggagtctttgcagcctttgtacttacaaccattttttaaaacaagagttcttgcaaggttgtctagaagactcctttagaaatatctgaacattcacagtttaatcaagaaagtatccattaagggcaaaaatctcctaccaattagttgtcaattggcaaactgcattcagactggcctctggaactcccaaagttataaaaatagctggattcctttttctgcaaaagagcctcaagtctctctgactcctctccgtttggaagattaataacggtgataattctggaagactcctttaccacacagcggtgcgtacctccgcagagggctggcagtgggccacagcacactctgatgtcccgtgcagttcactgacacccaggttagcaacacaggctgtatgctcagtgaactggggctggcaagggcaggcccggggggacctgcaagggaggggacttgttcataagcacctataagaaccaactcccaagtcatttttcttttcttccttttttttaagtgaatactctctgtattttggttaatcaacaatctttagcacccattatggacaaaacaatatgctgcacacataccaaggatacaagaaggaacaaactaccctggcctgtgctctgatggagcgcactttctcctggagacagatgaaagaataaataaaataactgcaagctgtgataagacactggtgaaaccaagaccaccagctcaccaagtaacactagaagatcgccacaagggattttatatgtgtaagagagagagcgggtgggcatcctcttttgacataaaagatgatggagaaggtcttttttaaaacatgcattcagtcaaatccatgaatttagctaatccttctttccctaagtgtgcaattagggaaaacctaatgactactttacaagttatagttttggcttcttttgctatttattaaaaacacagccaggcacagtggctcacgcctgtaatcccagcactttgggaggccgaggcgggtggatcatgaggtcaggagtttgagactagcctggccaacatggtgaaacctcgtctctactgaaaacacaaaaattagctgggcatggtggcgtgcgcctgtaatctcagctactcaggaggctgaggcaggagaattgctggaactgggaggtggatgttgcagtgagctgagattgtgccactgcattccagcccaggctgacaacagtgagactccatctcaaaaaaaaaaaaaaaaaaaaaaaaaggcaatattttcaggccaagcatggtggcttatgcctgtaatcctagcactttgggaggccaaggtgggcagatcatctgaggtcaggagtttgagaccagcctggccaaaatggtgaaaccccgtctctactaaaaatacaaaaattactgggtatggtggcgcgcgcctgtagtcctagctactcaggaggctgagggaggagaattgcttgaacccagcaggcagaggttgcagtgagccaagattgtgccactgcactccagcctaggtgacggagcgagactccatctaaaacaaaacacacacacaaaactaaataagactaaacaaaaattttctacctgttaaggtacttaaaggaaatattttgtatgtaaaaattaaaaatcgttagaaaacaggtacttgactttaaatttatttatttatttatttatttattttatttatttttgagacagagtcttgctcagttgcctaggctggagtgcagtggtgcaatcttggctcactgcaagctccgcctcccgggttcatgccactctcctgcctctgcctcccgactagctgggattacaggcgcccgccaccacacccggctaatttttttttgtatttttagtagagacggggtttcaccatgttacccaggatggtctcgacctcctgacctcgtgatccacccgccttggcctcccaaagtgctgggattacaggcgtgagccaccgcgcccggccttgactttttagtatcacaattttgacctagtgaatactgtgaccagcttttgttggtggggggacggggacgggggcaccaaggaatttatgaccctatgtttataaatacagatatctgaattggaattacaccaacactggcaacatcttattgacaaaatattttaatttcataaagccaatataatcccttgttcaattttctctaaagtacacgaaacagctaattttttccttcttcaactgatcttttcctgcaattattttcactgagataaggcttttctaagtaaattttaaatcaatcggattttacctacttcaaatatttaccaattatagcttctgtcattatgaattctctctactggcaactgctttttgtttattttataaagtccaataacctggatcaaagtctgaagattttaaatctgtcatgaatatttcattcttttgttgatctgaattcaaaaacaaattttactgtattaaatatcagcaaatgtcaattttaattttacttcttctgtcagcttttcaactgtatgaggtttgactatgccacttaacccagtgtctgtcttgttttatgttgactatttctaccaggaattgtcattatgaaatattctacaggactggtctactttaataaaaatccaaccctcccacatacttgtacacttgtgatcacttgggatctcatactaaccttcctcactggtgagtaactcccctctggtgtttcaagtatatggtcacggagacaagggccaggtcaaaatgtccccaagaccaaaaggtctaggccctaacactggagccaaatgttcagtgcatgtgtagacaacgtgtagcacaagtatgtgcctaagtaggaattatgttagctaggagaatctggaaaaagtaagaacttttattctaagaatcaccagctgatattcttttcactaatttccaaagagaaagacatagccaagtcagttggtgagatttcaacaagtacttatcgagaagctgaaactgccctacaaacttcattacttcaaaccattccatttgagataagagctcctctactctctctcactaaaacctcacttgccaagaattcccccaaagccacatggaggcccatggcagcacgaaacccaatgcccaggatactgggcactggtgggcagaggaggatcagtgtgcttgggagactacttacactgagccaagagtaagtttgacagcaacaaatgaagggatgaggacagggaaagctaggtttctcactactggaacacagaaagggaggaaagctagaaagaactatgaggcaaggaacggaaataggagtaccagtgagaacttaaggctattaaacacacacacacacacacacacacgcacacacacagaaggacacaggttacagatgataatgtatatgtgcttgcatgttcatttatattcactgtatcttttctgctgtctgctgagagggcctggaagaaatgtacagtacatcaaagaaataagcacactgaaccccctacatcacggtttctaaatactccatcaaagggaaccagagcctccttgaagaaaaggcttattccaggactggggcaacaaaagtataaactaaacctggaacacaatatgcagaaaacaaggaagtgttcaaagattgaaagggacatgtcacaacatcaggagagccaggctgaaggagctcccactgtctaaatcacaggtctccacgagttgacactgttacaaagaaatgaatgacaatgcaaattaatagacaagagaaagctttttactacagtggaatgccaactaataaatgcagaatgaatgaaaggaatatgaaatcactatttggcaatcagcatagacgtggctgatttgggcaggagtcatccgtggaggccagggctagtggatgaaagtctgatgagagacactggtgtaatcttgaaacatctcaccacaaaatactaatgaattaccaagaggaccacatggtgaattaagtgtgagagaatctggcagacgcaacatgcccaggccagcaaggttaacctcagggcatgcgccctgatgcgaggctctgagaagcacagcatcatttccgtggtatttcttcccaggatgcatggcctgaatctgctcatgaagaaacactcgatggacccaggctgaaaattctttaaatttgtcaaggccatgaaggacagggaaaggccgatttctgtttccattttcagtgcccctttcatggcctaactgccagcaaggccatttattcacttaatcatatctattcattcatttgacaaatatttatactgagctgcaccaaacccttaacattatgccaggtattataaagcaatctaattttatggcacataagctgtcagaaattggggaagcaatatgaacacacaaattctaacataagggatcctgtaaggttgcacagtaaaacaagacttcctgaatgagggataattcggggagcaatttgtcctagatagacaagttttcataagtctaactaaaaatgctactgcaggcactaaatctttttgtattttaaccatttggctgcatttttttgttgttctaaaatatattactcactttcctgccttcgtaaactgaacacaatgtggtcattattttatgcaaattttagttgtataaatctaaatcatgcaacataaaatattaataaagtctcacttcatgaacacacctgaaattatgcaaatgtcccaaattaaaactaagcacctagaattacataattttaaactggcaggctgagtgaattaacctgtgtgtctattactggtccatggcaaaccgatttatctgaaaacagaaataagccaccatacttgtagcttattgagagtcctatgggaaaaatagtctcagaatcataggaattttgaattatgcagacacctcagatacgtatctctgaaaatgccatgacagcaactataatttaacctatttatgagttggcttctactgtggcattaattttctggtctgtgagttaaagacttgctgggaggtctggcggagcagaccctgctagttacctacaaagtacccgtttcctccttcttccttactagcagaacccattttcatccctaggagcctgtgccaccaaaactccccattttccaccctcccttagaacagaaaatggcaatgtgatgcaattcttgccaaggagatgtagagagatgtccctggggagggcatctcccctgaaactaaagggcaaagcttcactaggagaaagttttctgaccctttactctgccccattatttttgttagaaatacagcatgtgagggcagagtcacagcagccacctagagactggacgaatgagggctgaggcctataaaacgagggcagcctggaacagtgcggaaggctggtctctgggaacatcacagcacagctgtgccaaccctgggctgccttcccccacactccttgctacaagagaaaaatgctcctgttactttactttaaatgacaatcatttgggtgggcacggtggctcacacctgtaatcccagcactttgggaggccaaggtgggcggatcacgaggtcaagagatcaagaccatcctggacaacatggtaaaaccccatctctactaaaaagacaagaattagctgggcatggtggtgcccgcctgtagtcccagtcactcctgctgaggcaggagaatcgcttgaacccagcaggcggaggttgcagtgaggcgagatcgtgccatcacactccagcctggcaacagagcaacactccatcacaaaaaaaaaaaaaaaaagacaatcattcaatcaaccaaaggcactgagtgatatttgaggattatttatttgctcctgtcctaaacagtcttaccttattaataccatgtcttttatcttttatattcttatggccattatttatggagtctcagacttttcctttggtcaaagaacccagctaagaaaatcaatacatgacattcaccaggccagagcctggtccagcataaggtccagtgagacagaaatgagaagtaggaaagagaactttaggggaagttttctatgcttgaaagagagccacagaaagagacactgcccctggcctttatccttgtggacgtgaggcctgaactgctgcccatggcatggcacaagcctaccgaggaagcctacgcagaggaggggagatgcaaagtatcccaggaaaatggaaccagacccacaggattcaattagccctgaagaacatcctactgcagaacttctagtatataacttaatatctttattatttagaccagtttgagttagtgttctgttatttgcaaacaggaacatttcaacgacctcagaacgtgaaagactcagcccactgtaagaagagaagaaggctcaatcactctctacctccacatctactactaataacacctccaccaccacctcctcctcttccaactccaccaccaccaccccctccaccacctctaccatcacaacctactccttcaccaccacctccaccacttctaccctcacaaacacccaccaccatcacctccgccacctccaccaccacctctaccaccacaacctactccttcaccaccacctccaccacttccacctctacaaccaccacctccacctccaccttcaccacctccactactacctccaccaccaccacctccatcacctccaccaccagcacctccaccaccaccacctccactttcaccaccactacctccaccttcaccaccacctccaccaccaccacctccatcacctccaccgccatcacctccaccaccaccacctccactttcaccaccactacctccaccacctccaccaccaccacctccaccacaaccatcttcaccactgctacctccaccaccaccacctccacaaccaccacctctacctccacaaccaccacctccacctccaccttcaccaccacttccaccaccaccacctccacaaccaccacctccacctccacaaccaccacctccacctccaccaccaccacctccaccaccaccacctccacaaccaccacctccacttccacaaccaccacctccacctccacaaccaccacctccaccttcaccaccaccacctccacctccaccacctccaccaccaccacctccacctccacaaccaccacctccaccttcaccaccacctccaccaccaccacctccatcacctccaccgccatcacctccaccaccaccacctccactttcaccaccactacctccaccacctccaccaccaccacctccaccacaaccatcttcaccactgctacctccaccaccaccacctccacaaccaccacctccacaaccaccacctccacctccacaaccaccacctccacctccacaaccaccacctccacctccaccttcaccaccaccaccacctccacaaccaccaccaccacctccaccacaaccatcttcaccaccacctccaccaccaccacctccacaaccaccacctccacctccaccttcaccaccacctccaccaccaccacctccaccaccaccacctccaccaccaccatcttcaccaccacctccaccaccaccacctccacaaccaccacctccaccaccaccacaaccaccacctccaccaccaccacaaccactacctccacctccaccaccaccaccacttccatctccacctttaccaccgctacctccaccaccaccacctccttcactaccacctctatgaccaccacctccacttccaccttcaccaccgctacctccaccaccaccacctccttcaccaccacttcctgtgccaccaccaccacctccattaccactactaccaccacctctacctccaccaccataaccaccaccacttctaccaccataagtacaccatcatcaccaccacctcctcttccaccaccaactccacctccaccatgacctccacctccaccactaccactacttctaccaccataaccactcaatcatcaccgtgtgcccagagcagaggagcccacgatgctccctgcagtttcttccaggctctcgtactggtgatgggagaactggtgataagagtgggagtgagaacgggggaaggggccagtcccttccacagaactgggaagcccagaagtggtgtccatgtccctccatggactttctttctaccgtgttctcaccatttcatgcccagctcccttctcaccagccaggcgcccatggtggagaaaaacttaggatgtgtttaaagtcaaaaggcagttttgtgtcaaaacaggtccctgaggcctctcagggtcccaccagtctcatagtaggaagtctcgaggttacattctgtaaccccatatccttatctgtaaaatgaggctgatggtaatagctgtatctatttgacaaagttgttatgaggaggaaatagctaatgtaattaaagtgcctagaacagtgcgtggcatttagtgagtgccacacatagaatcatttgttaaataagttaaattgatcaattacatgcatcaattacatcaattacatgaggggttgagggaggaggagaaatttttcatcttcgatatcttcacagggttacagatatttcctgttagtctgcatggatactctttttttcttttcctttttttttgagatggagtcttgctctgtcacccaggctggagtgcaatggcatgatttcggctcactgcaacctctgcctcctgggttcgagtgattcttctgcctcagcctcccaagtagctgggattataggtgcccgctaccatgcccagctaatttttggatttttagtagagacagggttttaccaggttgaccaggctggtctcgaactcctgacctcagaagatccacccgcctcggcctcccaaagtgctgggattacaggcatgaacctccgtgcctggccagatgcttttttatatcaggagaaagaagtgtcttttcaaatcgaaaaaaaatcactgctattaaaaaaacaaaacaattattcaaggagcagtgacatgtgatttattaacccaaaaatgtactcaaatgtaacattccaaataatatcttctcacatatttccccctctaatgacaaaaactcctctaaagtttttgaaacatgtatcccttttgcctaatgattatcagtgatgactgaatcccctgtcactcaaggttaagggaacatcaccataaactgttaattggatcattgtttctattcactgcacaaaactttttgtagtatttttctgttggcagagagataagcagcaatctagatttacacccacaaagcaggaaataaactgcctaagtttatgttctagaataccttcctcccaaacagaatgaacttcacccaactggctccattcccctattttaggaaggaggtttaataaaagaagctgcaaaatttcaagcaatttgttaaatttttaaattatcacttaaacttctttgactatacacttagaatccaacaccagagtgaaatggaacagctaggaatgtaaacatcattcactaaatctaaagacaaaaggtcacttttctttttcatattgattgttatatgtctatcacccccagggggaaaaaaaagaacctgccatctggtttatgtaccattttactcattacaacattgaagaagggctcaggttttctaggcaaaacacatacacagaacagaattgttgagtccaggctatgcctaagagaattttaccaagcatctctgggacactgcctcaaggaaccagggagactggatggattccaatccctgtcagtaaactaggatgccaatcaattatcctgcagggttacaaaatgaactagaatgcccatcccatttaatccccacagagaaagctgaaacaatcacttctccccaggagtgaaatggcatcattctgatgatgcccgggaccaaagccaacaggctcagctggaacctgaggcctctcagccagaaactgggaccaggaaactacagcaagtggatctcttgctccacttgctatgtttttctaaaagcaataaaagttgtatttttccttagacaaatttggaaaaattaaaagtaaaatataaaaataaaaatagaaatattattctgttagttatacaaatttgatatgtatatatgccaggagattattaactaagtctaagctttcctatttcaaggttctgtatttactttggcagtcatagggagtcatacatttaatcagaatttttaaataaatttgtaaaatagtgtgtaaagttttcagagttgtttgaactgtaagaacatttacaaagtggtatctatggtggctaaggtacttcctaaaggaaataaagatttctattcctatgtaattagaagtcattacagatcctttaccaaataccttcccttcagacttctgtggctaaggttttaaattggttctacatgattatattacaaagtcaacttccttagaaaaacaattctgaatacctttcatcttctaagaaacccttttcgaatccatgtttttttcaaatgtgtagcccccctcttccttctttcataaaagaagacagatttttttttttttttttttgcaacggagtctcgctctgtcgtccagactggagtgcggtggcaccatcttggctcactgcaacctccacctcccgagttcaagccattctcctgcctcaggctcccgagtagctgtgattacaggcacctgccaccacgcccagctaatttttgtctttttaatagagacggggttgtgccatgttggccaggctggtctcaaactcctgacctcaggtgatccacccaccttggcctcccaaagtgctgggattacagacgtgagccaccatgcctggccaaaaagacagaatttttaaagtgtagggaaaaaaatgtttttagccccatgccagaaatgctatatgcccctacatattttgggtattacagtattaattgccatatcttatggtagaaagtgggaggagccaagctgttaagctcttcttatttattttttttattgcttggaaaatcagttattgcttttctaaaaatgaaacatgcgcattgtgaaaatttctaacaatctaaaaacatgcagagtaagatacaggaaatgtaaattgttgctccaccacgcatgacctcaaaaacctgagtaagaaaatgaacacaagttgcaaaaaactcaaatgaattgcagaaattagacttcattaatacattcccattgctgaggaatgaaatgtcagcataccaaagtccatggcttttcaatgcactcttcagaagtagaaaaccaaaatttaaaacaacatcgtccatgaagccaagggaaccattacaccagaacatacagctcctccctggaataagccttctgtgaacctcaacttttcctctcttttaacatcaatgttaaaatgcctcccttcagggatactaagacatttcacttttgagacagagtcaaatagaaaaaccatcaaaaagaaagaaattaattctgcacctgggtagcattattttttccctgcttggagtgtgtactaacttcaaccagatcaattctttcatgaaatgagggagaaaataaactctccataattttaaaacatatttattatgataaaaacatggctctatttgtcatttctatttgtggaaaactgaaggccatctttttctctgtaaagctttttgtctgctacattctagaaacattataacctctccaccaaccagaatgattctgtttatgcaaataaatatattttatgacatgtaaaattaattagttatatgattatgcttcagtaatgacaatgttttgcacaatagaaaaaaagctgataaaatttaaatttccatttttatattccaacaaataatttaaatttgtttcttgattaattcaatgtttcacttttgaaaagcaattcacttcattttgaagtacatttatattttctttagtcaccttaactgttagttctactcagcaagaatttactgtctttttattctttttctgttcttggttaaatgtcttctggtaggtcacattttacctatttatgtcttgtgtcataaaagcattcaagaacattttaaggtaaaatgcttgaataaaattattttagtaaaaatgtaaaaatacatgtaaaataaatgtaaacaaattaaaataaatgtaaaaaaaatagagtattggccgggcacggtggctcacgcctgtaatcccagcaatttaggaggccgaggcgggtggatcacaaggtcagtagtttgagaccagcctggccaagatggtgaaaccctgtctctactaaaaatacaaaaaattacccaggcgtggtggcgggcgcctgtaatcccagctactcaggaggctgaggcaggagaattgcttgaacccgggaagcagaggttgcagtgagccgagatcgtgccactgcactctagcctgggcaacagagcaagactccatctcagaaaaaaaaaaataataataatagagtattcacatttactgagcttttattttcagtagttatagataagagatgaaaaagacagaatttagtttcatactttgatgtcattttttgaaacaatggccgatggtacctttatcattcaaaatttttcaaaactcaaaggacagaaatgaacatatcaggtctaccaaataacctaaacattcattaatttgccattgaaccttatgatacaccaattgaaataaaacctttttacagcaaagaaaattctagtatttgctttatggcattacagtatcttttttattcaagtggggcctgaaagtgccagtgttcctccaaaaacatgcatgaatttaccacatttccatatgagaaataagaacctgtcacttggccttgaaaaaaatatgaccattaatgtaatcacttagaataaaaagaaagtgccaggagttcaagaccagccagggcaacatagtgagaccccatatctacaaaatattaaaaaactagccaggcatagtggcacacgcctatagtcccaactacttgggaggctgatgtgggaggatcacatgagcccaggtgttcaaggctgcagtgagccatgattgcaccactgcactccagtcagggcaacagaaggagaccctggctctttaaaaaaaaaaaaaaaaaaaaaaaaaaaaaagaatagaaagaaagcaccatcattaactgaattgggatccgtactaataatatcagagtaattattgtctggcactaccaggaagctgggtgtttggggttaatcagacacttaagtctctacttatattaacatgtggatttgtgattttataagatattcacattaatactctatcgaacttaaatcaatttttcttgtagaggtcaggaagcatttctctatcttcatatttggatcagaatcatcattatgaaccattttaccaatgttatcatatccatgctagttaagaaaacattctggttggtaaactgttgggtgaaccatttctaaaattaaaaaatgcctgccacaaaataagtctgctgcatttttatgaaaataataaaataaaaactttcatactctttggaaaaatgagaaaagcattgatcagtccacttacagtgagctcacagaaatccatgctatcaaggcttttgcttctgtgtaatctccctttaattcgtcttaaagagggttttccttggctgacactagaagtagcaccattaggattttcagaggatggcgttaccctgcaagaaagaaaaaaattcttaaaaaggcaggtttacaggtgaacacatttctcaagtttgaggtaagcatttactcaaaggcagctttggaaatgtcacactcctttttccagccaaaaagctaagaaccacagcagagctacattctatcagataccctttctaactatttcttagctagttaagacatcttgacaggattcaaatagtacaacattaagatttattagactgtgggtggtggctcacaccttgtaatctcagtactttcagtggccaaggcaggaggatcacttgagcccaggggttcgagcccagcctgggcaatacagggagaccctgcctctacatatacacacacgaataaaaaaattagcctgtcctggtggtgcatgtctgtggtcccagctgcttggaaggctgaggtgggaggattgcttgagcctgggaggtcaaggctacagtgagccaccactgcactccagcctgagagataagagtaagaccctgtctcatttataaggtttttttttaaaaaaagattcattaaatatcaattctacaactattgaagaagccattaatattagactgaagttttctaggtaacttaggggcatctgcttccttctgggcagttatttattcaacactcagtccggtgcctagcacacccagtacaagtgagctatcattgtgtccatcacagatactgttcagcatggttttgttaagcatgaaaataacataaatctaaacatgatagcacacacttaattcagcataattatggaaacatgaaaacacagacaacaagaagtagcaaatagtataagccatctataaagtgcacactggaatacatgttcatacatatacatacagacacagtaaatatcataaaatagactagatatggctacagtttagaataaaagtaatacatccatagagttaaaacatttgaagggtataaaaagatataaaaatggaaagtaaaagctgcccttttctccctcatcccaaactccccttttccaaaatcaaccactattaacagttgtttgtattgtataatctcccagacaaatgctcatgcttatatacagatgtgtttatttccttttcaatttttttaccaaattgtgtgtattgtcctgcaccttacatttttcacttaatatatcttaacgttcttcccataataatccatacagaactatttcactctttttaatggctaaatggtatcccataacatagatgtaatataatttgttcaactattcccctactaatgggcatttagtttgttttcctatgtttgttaccaaaccatacagcaatgaacatccttggcaacatctttgggtacaaatgcattatttagttaggaaagattgctcaaagtagaaaggcagagtcagagatgggagtttcctacatgctgataggtaatacctttccaaaaagctttacaaatttacacttccatcaacagtatatgagaatacccatttgggggagtccttaaatacaagggcaactttatcactttattatttttatcactcaacttctccatgtccttcattatatttttgtctgttgaactgctgattctgtataaaggactattgtaggatttcccaccttgaacatggacttgtcaattaatctatgtcttttagtttttgctttttatatttcaattgttttttattagatgtcttgatgtttatgacacatatcttcttagggatttaatcttttatcatataaaaagactatgccaattaaatattttaccttaaatgccattttgtctgatgataattttcccatctacatttttatattaaccatttcctgatttatcttgtgtttgtattttcaagtgttcgaagtctctctctctttttagttttttttttttttaagttgtacctttaactctggataagtagcatgtagctggatttttttctttctttacccaatctgagggttaatgtcttttaagagaaacttaatccattcaaatttattgtttttactcatatgtttagatctattcctgccatcttgttttgtgtttaatgctttcttcttaagtttctgccttattaatatgattgagtttactttgtcctcaaccaccctaagacctttttccctttccattcagtagtttgaaagttatacatcttattagggaaactctaactctagttagctatatacacacatgtacattaacatctttatatatgtatccatcacacacgtatatgtacacacacacacacataaactcatattttcctatcaacacctagggctcatgagtatgctcacctcctcctaaacaagaagtggcattagcacgtcttcattccccctctttcccagcaactccacatccctacaaaaagccccaccttcccttagaaatagtgttcaggtttcctggcttcttgttcatacttttgatctctttgctcttttgtgattctttaacttacttctccagattgcaaacttgcttttttagttttgtgaattcagccattgtcttttctatgaatcagtaaattctaaatttctaaagtagctagttttttttttttgtttttttttgagtcggagtctcgctgtgcctcccaggctggagtgcagcggcgcgatctcacctcactgcaagctccgtctcctgggttcacgccattctcctgcctcagcctcccgggcagctgggactacaggcgctcatcaccacacctgactaattttctgtatttttagtagagacggggtttcaccatgttagccaggatggtctccatctcctgacctcgtgatctgcccaccatcagccttccaaagtgctgggattacaggtgtgagctaccacgcctggcctgtatctagtatttttttaattaatgcaatattctcatgcatctttccaaaaataacctttttttcttctgaaaatcaccatctaatgtttttctattttctcaggagttagttctgtgttttaatttggtaattctctgggtactggctttcttgaattgtttggtgatttttaatgtctacttacatttgtattggaaaacatccatttccccactgcgactactgtggcctgccttcaggaactctggcagagagatgggatacgctgccaggtctgtgaggcagcttctcttgcaagtcagtagctacctctaggacagccctgcctctctgaccccagtgctccggacaactgtaacgttttctctcaacagatctatccctacctactagttacatttcaaagagtcctcaaaattacgggtccactgatgacattctttattgtttactcagattattattaattttgtcgtagctttaaaaattaattttcttctttcattgaatttctagggcgtcttcctttcaattggcctcccaaagtaaaattttactgatgccactttcatgattcttaggataaaaagaaacattgtacagctttgttctcttctccacagggtaaaagcttccatgaaaacaatgaactttattcaaaagaggacatatgggaaagaaaaatagagttataaaactaaatacaaatcaacttctcatttctctctcactttattttgatagcgctggtaggtgtgatcatattttagaaaattaatgcaaacatttaatataaataaataaatctgtctagtgttcttcgtaagtttttctctcatctgacttagaaaggcatcactattctccctttatgccaaatctagaagcctaaaagagcctgtaataaaaatttatatctaccaaattttataaatggcagatagtcaagaaatttaccagggttaactcaatgtaatactaaatccagtgacaaagtaaaacagaaaaataaaatgatcataaacaaaactagaagaatagatccactgccctccctaccaggatcataataaaaacatgctgtaatatcagcactttgggaggccgagacatgaggatctcttgagcccagaagtttgagaccagcttgggcaacatagagagatcccgtctctacaaaaaatacaaaaaaactcgccaggcgggattgcacatgcctatgggtcccaactacttgggactctgaggtgggaagatcacctaaggccaggacgtcgaggttgcagcgaatggtgatcataccactgcactccagtctgggcaatggagtgagaccatgtctcaaaaaaaaaaaaaaaagtaataatcagtagcgctaaagtggtgtataccaggtgaaaatcagctctggacctaccctgcccacagactccacaggaagatggtaccttgtctaagaatttaaccaggcttctacagagtaacttcaggaactttaaagctttgaccagatctttgggaagctgaggtaaactgttaaaaggcatatggctcaataatgacccccctttgtttggtgtggaataaagaaaagaaaaaacactgatctagataataatgcagaatattaactctggtgtaagtagaagtgctcttgtaggaataggtgaattttagatgttgcttctcttttgtttattactgtctttaaaaatatttgtcttggggaggggcgtgtgtgtttcattgttttctggacactcacaagaacacagctgcgtacctgtaactcaggtgagaagagctatacaaagagtccaccaaggacagttccatttgacatggaatataaattcttttaatcccctggtactactcttccccagccctgatggtgcagatctgagctgagtaactcagacttcagggattattccccgcatatttaggggaatggccctttatgacagggaaataaagttgggaactgatgtagggaaatcaatatttagcttacaatgaggttttacttttcctaattctttttttttttttttttttttttttgagacggagtctcgctctgtcgcccaggccggactgcggactgcagtggcgcaatctcggctcactgcaagctccgcttcccgggttcacgccattctcctgcctcagcctcccgagtagtttcctaattcttaattccattttatcctccctagagggaaggtggggagaaaacttctgcctctctccacctgctttgtaacttcccttgtgagagtgtactttacttgtgggcatggctgatatgcatcaaacgctgaagtccagggcccaccctctcgttccacttcctacccctaccggatgaacacagaccacaggcctggcccctggaggcagtcccccacttgatctgcccatttcccttctcttcacctgacactgctagaacaggtctggtctgcactgcagcctccaccatcatagctcccgaggtaagagaggaagcatcccctcagaggcttgcagaccagtgtggcctgctccagcacagcttcctagacagaccctcatttgggtgatagccagcacctgccccaatattattaacaacccagaaaactgttaacatttagttcttgttccttgaatgtatcttccctggtcaaggacatgcaggagaaagatatacaccaatccaactccacccattatgtcacacctacaaagctctgttgggcgctctgctggctacaggccaaatgtggactgctacatctttgacatgggactcggtccttagcaaagtcatttaaatctgacagagatacaaattttcactagtccaaaatacttgcaccacagtgcagcacaacttcttgacattctgcaaccatccctcccacacccttccctctgctggaatgcttttctactccccatccttgaaagcccaatgttcccaggaagcctcagatattcatgccttttgtttccaactcaggagctttggctacaaatatttctgaccattctaagacaaacaactcccaagctcatctacaccacccatttctaatttccagtggaaaagaactcaataataacacagaatcgggcaaaaataatcaagatggcaaaaacaaagcagtcacacaaggacaaatctatcaacaaagtaacatctaataatccttctacaagatatttgttttaagataccagcaactgacagccacagccaactcaagagaaggctaatgagtgacagcaaagctgtccccttcctccacttgaggggaattccaaacaacagtgtgagccaaggagctgtgagacactgctaagtacagaagggcagctggctttaaaaggatgctaaatccttctgaaggacacttcaggaaaagctagtaaaatgctaatttttgtttataagcattggacttcagaaagcttaataactcatgtaataggttaacagtaaatagtcatctgatgaacttagaaaaaataatgtgcacaactgccaataattaggtcatttaaaaaattgtgggctgggcacagtggctcacgcctgttatcccagcactttgggaggccaaggtgggtggatcacctgaaggtcaggagtttgagaccagcctggccaacatggtgaaaccccgtctctactaaaaatataaaaaattagccaggtgtggtggtgggcacctgtaatcccagctacttaggaggctgaggcagaagaatcacttgcacccgggaggcggaggttgcagtgagctgagatcgcgccattgcactccagcctgggtgacaagagtgaaacttcgtctcaaaaaaagaaaaaattatgaaaggacttgggtattggagcccttcacgtcccaacaggaggacctcagtgatccatgagtgggccgggggaccacccttggagaaacaaccttctatcgggcaattaccagtcattttagtatctgttttcagttattctctccttctagactgtcatctcactgatcaattgtcttttgaaccttgatcaattgtatgagtctgagcaagtcaatgacctaatttgtaaaaccgagaaaatacagcctcatggggtgctataagttaaataatgacaagatacttggaaagcactaatatagagtgcagcaagtaatagctcaatgaatagcaactcttattgtttttggaatctgattattagatgactacttgaatgaatatactgatagtgcatggccttaaataatcactgaatcaaataactggggaaatgtttttagagtataaagaaaatgaaatcacacccccttttctccctaagatcactgtaaatacttttttctttttgagactgagtctcgctctgttgccaggctggggtgcagtggcatgatctcggctcactgcaacctccacctcctgggttcaagcgattcttctgtctcagcctcccgagcagctgggactacaggtacgcgccatcacgcccagctaatttttgtatttttagtagagacagggtttcaccatgttggccaggatggtctcgatctcttgaccttgtaatctgcccgcctcagccttccaaagtgttgggattacaggtgtgagccactgtgcccagcccactgtaaatactcttaaagcacttagtgcaaaactcaagactgctgatagcaataaattatgaaaatatttttcacattttacattaaaaaggagtaactattatttgtgcctcatacctgcagaacagcagcataaatgtcaccttacttagaatgttaccatgtttagaaacaaagtctttgctgatgtaattaaagatctccagatgagatcatcctggatcatccaggtgggccctaaatccaatgacaagtgtccttataagagacagaggaataaggaagcaagactcaaggatgtcagaggagagctgttttagttgcagtggagattctaatatggcctgcagaagaatctgtctgcatatgtatacatcatattataaaatggagcatttattttatgagttcctagtttataatttgaaataaattaaaaattaaaagttttagtcttttaaaaaaagagagacaggagaagacacagagacacagagacacagagaaggtcatgtgaagacagaagcagagaatggattgatgcagccacaaagaatgttcgaaagaggcaaggaaggatcctcccctacagcatttgagggagtgtgaccctgccaacaccttgattttggacttctagcctccataactcagaaaataaatttctgctgttttcagccaccaagtttatgtgatctgttacagcagcccctgaaaacacaaagccccactgcttcttttcatcgctggcaattccagggtgtcccccaaaggaagccagcaggctctgcaaacttatacctacctcaggtagaggtaaccaggctttgttctgtgttcctaagtaatgattcagaaccaaacactgcaaacgcccctgctttctaaatttcttgaagaaggggatgaggaaaagagagttcctacaggctccactgatgtgggtctgactgtctgctttagtttccacctaagttggtctgcaaatataattctccttacgagatttgtagagccaatcagaaagacaggagatattgcacaaagaaaaactgacaggcacaaatgcccaagcgagatggaagtgtgggaataaggcatgcaaccctgccctttacactggcagaagcctttccatatagactgcagtaaagacagagaaacacagatatataaatatcttcatataaatcttcacatatgccttgaccagttttcataatacatcctcacatttatttatttatttatttatttatttatttatttattttgagatggagtcttgctctgtcacccaggctggagtgcaatggtacaatctcggctcactgcaacctccgcctcctaggttcaagcgattctcctgcctcagcctcttgagtagctggaattacaggcacacaccaccatgcctggctaatttttatatatttttagtagagacagggtttcaccatattgaccaggctggtatcgacctcctgacctcaagtggtccacccatcttggtctctcacagtgctgagattacaggtatgagccaccacgtcaggccctcacatttgtaaacaggcacaagctggtgcattccaaagtcttacaagcattgttgatgtctgctattggtttccacccaccactctagagtcaggacctacatcctactatcttctagacatatgatggtgccttatgtctccaatgctccatgtgcggttgctatgaaactagcaaaatgaaacattatctaaaaaataaatccaaagcgtataagagaaaaataaatctggcggcacaatgttctccaacttaagaatatgaagtattctacatctctgtttaaaagagccactcactccagagtcttcatagagcatacccttccctttgccgctgtagaatcagatgaatgtttgcaagttaacaatgagtggaaattaagaaatgattatctaagatcatggaaaagctcaacaaaagcctcttgccttttccaggccgcctcttagtaagatggtttttatccctggccctaactcactgcctacctcaaacatgaattgcttggatataaaagttacctggattttatttccttgtgtcctctcttcagaaattctgtgtttagagaatgtgttttcagaagcagaaccccaatgatggaaaataataaatatagtttcctaactttgtgaccaaatgctgctaatattgatgtctaataattcctcaaatattattcccacatcttgatttttaaactggcccgcgcgcagtggctcacacctgtaatcccagcactttggaaggccaaggcaggtggatcacctaacgtcaggagtttgagacgagcctgaccaacatggtaatgccccatctgtactaaaaatacaaaatattagccgggtgtggtggtaggcgcctgtaatcccagctactcaggaggctgaggcaggagaatcacttgaatcctggagtggaggttgcaatgagccgagatctgccattgcactccagcctgggcaagaagagcaaaactgtttcaaaataaataaataaataaataaataataaataattttaaactgaacattaagaaaacagatttcctaacatattatttcccaatcacaaattattaagaatccatttattcaacaaatatttattgagaagctttctggtacatttgtaccagacatccgttgcagggttttacagtaatggatgaaacaaacaaaagccctccctcatgcaacttacattttagtgaggagaaggggaatatatatgaaaaataagtaaaataaacaatgtgttagttattgataagggctcaggagaaaagcaaaatgggagatatgactgctggtgctgatatttcccatacccccacataccatcaatctgagaagcgatcttcaaatgttaccccttcttccttcactgtagtgacagtcttcatttatttgctaacatctcccacggacatgttttaattgaactgtggctaaccttgtcttctaagtgttgtcacttgctgttcatcacattaaaatatcttttttttttttttgaaataggagtctcactctcgcccaggctggagtgcagtggcatgaccttggctcactgcaacctctgcctcccgggttcaagcgattctcctgcctcagcctcccaagtagctgagattacagccacacaccaccatgcccgggtaattttgtatttttttggtttatttgtttgtttatttagtagagatggggtttcaccatgttggtcaggctggtcttgaactccagacctcaggcgatacgcctgcctcgacctcccatagtgctgggattacaggtgtgagccactatacccggcacattaaagtatcttttgcagaataaatttatttaaaaaaaaaaaaccaaactggtgggggcagaaagacactaacatttactaagcacctattattaagccaagcacagtggtagacacctttgtattcattatcagagttgatctgtgtatatccccatgagggagataacaagattctcactttacagaggaagaaacagacactccaggaacttaaggtcacacagtaagtggcacaactgaattctgaactttgctgtccatatttgtcttaccttcaaaattctccacttttaggattctttttcttaacccatctttttcttggctgatcacgctatatacttttttggtaaggatcactctttcacactgtcttatagagcaggaattactttcctcattacctaaaagcagcctcatctcctttctctacaaccttaggattaaattagactgtgctcaattgaattgaataaaacctttatgaactacactgaccactaattttaaaattaaaatgaccaatgccataactggcatcttttttctgtagtcatcttccctttactaggttatttcttttgcaaaagaatcttaatcctaaatctcaagccagtggcatacctaggtggctcctgggattccgcatggattacggattattattaataaaatgcaatatacaatcctgtagataatcagcaacgtaaaccagtaaggtccagacatttttctttaaggatgttttttcctcattacctcagtaacagtttccaggtcggaggaactggaacgcatgcaggtggaatacagtccctgacaatgcaataataatttcccaacttattccccttgccttgctcgtcctctactatgcactcagcagcagacgaatttttggaaaataactgaaaacgcacaccgtgataccaatgaattcttctgctgtctccgcgagagcctggctggaaattctgagccagaacccgccgtaatggagcagaaaggacagacagaggcgggaggccgacgcccgggtgcgggtgccaggcgtcccggccgctccccgtcgccctacgcgccgcgggcacagcgagggtctcggcgaaaccagtcagcgggcacgcggtacaaggcggcgctcggccctgggctcggccttggctgctgcgccccgcgcggcgcgccccgcgtcccgtcgggcccgacagtcgcggcctcgccccccgcccgaccgccccggccgccgctcgctctcccactccggcccccgccccgctccgcgcctagcccggctggggctccgcgcccgcgcggccgcctcaccacagcttcctcttgagcggcaggaggctgccgcggttggagggggtgacgccgatggccatctgcagcaccgtcaggtatttctggtacttcatcttgtccccgctccgctcgcgggcagggccccgccgcctccgccgccgccgcagacacagcccctccaggcgccgcatagatcagctctgggccatccgccgccaccacagctcccaccgctcccgcgcccgccgcacccgcagctgcggccgtgcgtggcccgggctcccgctcccgccgccgccgtcgccgtgcgtgcccggccgctcccgccgccgccgccgtgcgtggcccgcagctcccgccgccgccgccccttccacccctgcaggccgtggcccggcggcgcgctccggtgggcgggtgcgggtctcgcgggaggccgggctggcttggcccccgctccggagccgctgggcgaggccgggccacctgcgcgccggccgccctgcccaggccctgcgcccgcgtgccgcggtgttttcagcggctggcaggagctccttctcaaccgttagcacccaaagagaatcccaacagcacacttccagcgcggattaaaacaaacaaacaaacaacaacaacaacaaaaacgagacgctgcctgttggtttgtaactatcaattgatgtgttctatcccaaagtggttgacttcacattgacatataatgcatatggcgaatacgtactacacgcgcatgcagtcctcgcttgcacggtaattctggacgctggaaatgactgaaccatgcaaaactaccttaataatcactgggaaaaattaagattgtttcacgactttaaacagtttttctcaaaacattcaaagcagtccgggcacggtggctcacgcctgtaatcccagcactttgggaggcccagacgggaagatggcatgagcccaggagttcgagaccagccctgggcaacacagtgagacccggtctctacaaaataaaaaaaaaaaattagccaggcgtggtggtgtgcacctgtagtcccagcttctcaggagaatgaggggggagaatcacttgagccccggaagccgaggttgcagtgagccaaggtcgcaccacagcactccagcctgggtgacagagcaagtccttgtcttggaaagaacaaacaacaacaaaagaaccattcaaaactcgcttaactgatggttacaaataccctgtatatggaaatgaaaaaaaatcagtttaaaacattcaaacattgagaattaaagtattttttgtgtttgtaaaaataaagcttattaagaataacttgaacagtgcttgtcttcttctagtgtaactcttatataccaccttttctgtactttagcaaaacatcacatttggattacacgcaagtattttatcctttgcacttccaatgccatgcaatgtctcagagagttcctttaatgtaaaatgtttttgtggacctcatttcctccgggacatcctcatccttttagtcacagccattttcctcattcagtgtgctttgagtaagtttcactgactgcatatctagtctctggaaagtcagcactcccacagttgtctatttcttctatagtacttcatttgcattcaatttgaatttcacttcaattccatctttaccatttttttatttctttgctgcactttcatctttgttgaccaattccctttcaattattcatttttatacaatgctgtgtgagtttaacacttggagaaaaggaagcaacacaattgcacactttgctgccagtgcctaaactaacagtgcaatgacccgtcactgacagattttgaaagaactgctgtgattggtcactggttgttatggacatctattgtttacatagggttttgtggactaaagagctagaagcaaagattgtactatgtttgttcacagctaaaatagcatgataactaaaatttgttttttttgtttttgctttgttttgtttttgagacaggatctcatgctgttgcccaggctgcagtgcagtggcacaatcatggctcactagagcctctacctcccaggctcaagcgatcttcccacctgggcctcccaagtagctggaactacaggcatacaccactaagcctggctaatttttgtatttttattttttgaagagacgggatctcactatgttgcccaggctagtctcaaactcctgggctcaagcgatcctcccacctcagcctctcaaagtgctgcaattataggcatgagccaccatgccccatccagtaactaaaatttcaaccatattgttgagatactggtgttatttaactaaatagctgacatcagtcatatctgaacctgcaaagcaaaggatgcctatttggatatatgcatactatatatatgtgtgtatatatagtatatatgaagagtaccaataataagcacctatgcatccaccaggcagaagtgttaaccccctccctccacagtttatccctcctgcacctctatttaaatacttcatcttcaaattaattagcacataagattaaaacaacacaatcttcctggggtttgggttcccaacatgatttcacagtcacttaggtaggaaagcaggtctaaatatttcactttcatttacccagaaattttagctctcacataaaatgaggaattggcaggtttttgacacttcggttgtatactcccctggggagaggacatccttggagcagaacttttaagaaacatcaaggcctgtttttatatactcaccatgtcaaatatatgtttggccttttgcattactttgtcataataattgtaagatatttgatgaaaatactacactgtgctcaaagatttaggcacctggaagctgagggacctattcaggataataagcaataaaaataaatctgggagaagcacttctagagtggtagaaaatctgcttctccataaaagggagtacactggcaaaaatagttaaaaccaactccagaaattaaccaaacacaacaatccaaggagtatttattaaagaaaaattactgaatcttggtgagtacagtgagctttagggcattttgatctgcccaattctcaactacttctctccagctctacagtagcctagtaagccaacagcctcacaactacagtagctttgaaaaccatccagcagccactggatggggcagaataggtttagatcttctcaaaagccccatactaagtaaactgtcattatttgacctgtctggaagcaccttgaaaagttccattctcagggtttgtctttatttgacctggttcagaacttgctctgtgcaaacagccctatccctggtgcatttgttgaaaacaatcagttgcaactgtttaacatcacagatacctgcggtggtgaaactgtttggtactaacaagaagctaaccaaaaaagttaaaaaaaaatgggcaataagagtccatatagttccttgaaaagctctgacatatacctaggaatccagaatttcatgcaggacatgcatgtacatgcaggactgtgaacacacccaaaaaacacctaagaagactctaatctctcacctctgtctgaccttgagtttcagtacaatgcagaaaataaaggctaaggaagaatcgtaaactacctaccacaatgtgcaaggcatgccccagcacacacagcctctcagcaaaagctaggggatttattggctcaaagcatttaagaaaatatccattcaatcattagctaagcactaaactatccaagcagagactctaatggctgcacacaacaaacaatacagactttatagattagtccagcaaagtcactaaaccagcaacaaacctcagtggagaggaggggatatgatttctagagttgtcacattacattgttcaaaacatccagatctcaacaaaaaagttcacaacatccaaagaaacaaaattatggcctatatgcaggaaaaagcagttaatagaaaccattcctgaggaatcccaggcattggacttactgaacaaagactttaaatcagccattatgaatatgttcacagaactaaaggaaaccatgtctaatgaactaaaggaaaatgtgagaatgatgtcttactaaatagataatatcaataaacagaagttttaaaaaatagaaactctggagttgaaaagtacaaagagtgagatgaaaaaattctctagaggagctcaataacaacatatatgaactggtagaagcaaaaggcagtgaacttggagatagctcaattgaaattatccaggctgagaaacagaaagaaaaaagaatgaagaaaatgaacaaattctcagagacttatgggaaaccatgagtttatgtgtatattaacatgcacataaagtcccagaaggaaaggatagagagaaaggaatacaaagaatatttgaagaaatagcctgcccagactttatgaaaaacagtaatctgccatccaaggagctcaaaaaacttgaagtagtgacctagacacataatagtcaaactgttgaaagccaaagatgatgagaaaattttgaaagcagcaaaagaaaaacaactcatcacacacaaaggatcctcaataagcttaatagctgacttctcatcataaatcatgaaggtcagaaggtggtgggaagacatcatatttaaagggtggaaggaaaaatatccttcaaaaatgaaagagaaattatggcattccaggtaaacagaaagtgaatgaaatcatcactagcagacatgcactattaccaaagggaaccttgcaggctgaaatgaaagaatattagaaatttaaatccacataaagaaaataagagcagtgattctgataactacacaattgaatataaaaaattattttaatttttaaaattaaaaaattttaaattaaaaaatctgaacactctgatttaaaacacaactgcataaaacaatggctatgagctgtgtcgataggcttttaatgtataaacatacaatttgtttgacaatcatattacaaagataagagggacagagtggatgtatactggagcatagttttggcatgctattgaaattaaggcaagtcggctgggtgcggtggctcacgcttgtaatcccaggactttgggaggccaaggcaggtgggtcatgaggtcaggagatcaagaccatcctggctaacacaatgaaactgcgtctctactaaaaatacaaaaaattagccaggcctggtggtgggtgcctgtagtcccagctacttgggaggctgaggcaggagaatggtgtgaacccgggaggtggagcttgcagtgagctgagatctcaccactgcactccagcctgggcgacagagcaagactccatctcaaaaaaaaaaaaaaaaaaaagagagagattaaggcaaggcacggtagctcatgcctataatcccagcactttgggaggcctaggtgggagaattgcttgagcccaggaattcgagaccagcctgggcaacacagtgggacttcatctctagaaaaataaataaataaataaataaataaataaataaaaaattagccaggcatggtggcacgtgcctgtagtcccagctacttgggaggctgaggtaggaggatctcttgagcctgggagatggaggctgcagtgaaccatgattgtgccattgtactccaggctgggcaacagcaggagaccctgtcttgaaaaaaggaaaaaaaaaagaaattaagttagtattaatactacttaggttattttaagttaagaagctaattgtaatccccgggatgactattaagaaaatgattttttcaaaatgttatacaagaaataacaaggaaattaaaatgatacagtagagaatatatagcacaaaagaaaacagtaacagaagaatagaacaaaacaagatataagacatatagaaagcaaatagcaaaatggcagacataaattctaccttaccactaattacattaaaggtaaatgtactaagcattcccatcaaaagacagagattggtaaaatggatcttaaataaatgtataacctaatctttcactttgagcaactagaaagaggagcagaataaactcaaagcaaggaaaaggaaggaaataaggattaagagtagaaataaatgaaatgatgaataaaaaaacagagaaaatcagcaaaaccaaaagttggttcttaggaagtattaaatatcaataaagatgacaaaccttcagctagactgaccaagtgagagagagaactcaaattactaaatttggactgaaagaggggacattactaccaaccttgcagaaacaaaagtgattataaggagtatactaaattatgttgtcccagctactcggcaggctgaggtgggaagatcacttaagcccaggaggtggaggttgcagtgagttaagattgcaccactatactttagcctgggtgatagagcaagactctgtcaaaaaaaaaaagaaagagagagagaaagaaagaaagcaagaaagaaagaaaagaaaaaaggaagaaagaaaaaaaagagagaaaggaaggaaggagggaaagaaagaaaagaaagaagggagggagggagggaaggagggaaggacctacctacgtgaattagaaaactttctagaaagaccaacctactgaaattgactcaagaagaaacagaaaatcaaatagaagtataacaagcaaagagattaaattggtaagaaggaaaacttcccaccaagaaaaaatggctttatcagttttgttcattcctttatctcctgcacccagaacagtgcctggtgtatcataagcaaccaataaatatttgttgaacttgagacaggatgttaatataaagtgaaagacttcatgacttgtcataaggcatatcatttttctaaagaacagagttttgcatgcaatgtagataaatattacagctggaaaattgacatcattttatgtagtcaaagaaataaaaattcgctattagttctcagatgatagttaatgcttcaaaggaaaatgtgggagctgctactattggcactatgcaaggtccaaggtagtgtttttccaacctgcctcccagtgaatacaacctcaagggttatagcacctgagcctgttgctccaccttcctcaaaaacaagatcctttcacctattttgactaccacgcacagttagaagtatattttattttattttattttagatggagtcttgctctgtcaaccaggcttgagtgcagtggcgtgatcttggctcactgcaacctctgtttccttggctcaagcaattctcctgcctcagcctcccaagtagctgggattacaggggcccaccaccatgcccggctaatttttgtattattagtagaaacagggtttcaccatgttggccaggctggtctcgaactcctgacctcaagtgatgcacctgcctcggcctcccaaagtgctgggattacaggtgcgagccaccgtgtctggccagaagtacatgttaaatagtggcacagtacacacagacacatacaggcgtacacacagacacatacagacacacacacacacacacacatacacacacaactgaagcaaaagcttctgaaaacaatattttaccttactacctgggttgaacttttctgttctcttctacagcaagccactctacatccttagcattttgttggaacattctcatcagctcctatctttgcttgaagctggactgtcccccaattcagctgccctcggcagccctcagtgccccaatgctgccctcggcagccctcgacaggaggtgttttatctcttgcaccccacatgtctaaaggccagaggttggggtaagtttcttccttgttggtcctgccccttctaaaccattccttgctctttctcatgcccaaaccaaaccaaacaaccaaaaaaaactaaaaactggctgccctgaagtttatgcccttaaaggatattacctacccctttcccctcttctttattgtcgtttactgccttcctctccacttttattcctggcataattttttttttttttttttgatacggagtctcggtctgtcgcccaggccggactgcagtggcccgatctcggttcactgcaagctccgcctcccgagttcacgccattctcttgcctcagcctcccgagtagctgggattacaggcgcccaccaccacgcccggctaattttttgtatttttggtagagacggggtttcaccgtgttagccaggatggtctccatctcctgacatcgtgatccacctgcctcggcctcccaaagtgctgggattacaggcgtgagccaccgcacccggcccctggcataagtttgaatgatttcaacatccatgtgggtggaccatccaatgctcttgcctctcagttccttggtcccatctcttctagagatcttttccctattctacttcagccttgcacttgtgtggtcataccttaagcctgggctcacaaactcaaatgccagtagggtaaggcccttactaccaatgagtgaagaaggccagatgttagtcagcagaaaatagtggaagctgtgacctccctgcctggtgctacagttctcttttagaaaggagtgaccgccactcagctgcagccagctgtcatgtggaaatgctagaccaggatttccacatcttccaattcatggaaacacaggttgtcatgtgctatctcccaaattttacatattggcaataatatggactttcagtctaaatattgtgacattaaaaaacatttcccctcttaaaaatcagctcaaaagaagaaaaaaaaaagggaaaattaaattatatcttccttgaaacgtggagatattccagaagttagaaaacagtgaagatttggccggacgcagtggctcacgcctgtaatcccagcactttgggaggccgaggtgggcggatcacgaggtcaggagatcgagaccatcctggctaacacggtgaaaccccgtctctactaaaatacaaaaacaaaattagctggacgcggtggcgggcgcctgtagtcccagctactcgggaggctgaggagagagaatggcgtgaactcgggaggcggagcttgcagtgagccgagatcgcgccactgccctccagtctgggcgacagagcgagactctgtctcaaataaaaaaaagaaaagaaaacagtgaagatatggtaagtgacttagcagaagggaggggaccaacctcagtgactatccagggcaatgccatgaagaaacaagctcattgcattgcagaagcacggaaatattcaggaatgaattggaggctccaggtaccacaaaagatagatgggaatggaaggaggtggcaggcactgaaaataggagattgatctaaaatgtggaataggaaacacttattaccccggtatcctctctcatttcagcggaaatggaagtatattctcaggagaagaactagagagtggcattaggtacaatagactgaaaagaaaaggttacaggaaagttgtatatggagtgatgagatgctaagctcctttctgccacccagatgcagaatgctagcaacctcagacaagagatttacgtatcttcccatgtagaccgttacaattttttgttaaatccatagatttcattgttgtgactgtttaaacattgtttagtaccgaacctagtattgtcccgtgattatattttcctgccttatacaatttcttattttacctggagttaataattgccttgttttcaacttgttgttttcctaaaactcatgactaagtgttcccacatccgcaagagtaatgtcaaatgcctgcaatacagttttccacacactcaaaccagacagagagtctacccatttcagtttttcttggactcagccctctgaagccctccatcctgctgctcctatctgtacagatgtgctctccgggtttctgcccagttcagagagagagagagagagagagagagaggaaagagagagagagagagagaggaaagagagagagagaataagaaagagctgtttattttaaggaattggcacatgtgattatcctctctgtacagatgtgctctccggggcttgtgcccagttcagagagagagagaaagagagagagagaggaaagggggaggggggagagagagagaagaaagagagagagagaggaaagagagagagagagaataagaaagctgtttattttaagtaattggtgcatgtgatcatggaggcttgcgaaatacaaaacatgcagggtagctggcaggctggagacccagagaaaagttgtagtttgagtccaaaggcagtcggttggtgtcagaaattttcttgctcagaagacgttagtagttttattctattaaggtcttcaactgattggataaggcccacccacattatggatggtagtctgctttactcaaaatccaccaattaaatgttaatcacatctaaaaattgtcttcacagaaacatccagaataatgtttgatccaccaggtaggtttgagaaacaaggaatgaagagtaaagaaagtggtaaatatgtggatgaatctaagcaaatactgataaaaaaataataataacaatgtcttaatgggttaaaaagaataattaaaatacatagaataatagttcataagttgggaattaagtaaaaagaattaaagttttttttttttttttgtggtggggacaggttttcactcttgttgcccaggctggagtgcaatggcgtgatctcggctcattgcaacctcagcctcctgggtcaagtgattctcctgcctcagcctcccaagtagctgggattataggtacccaccacccctcccagctaatttttttgtatttttagtagagatagggtttcaccatgttgagcaggctggtcttgaaattctgacctcagctgatccacccgcctcggcatcccaaagagctgggattacaggtgtgagccaccacacccggtctagtgttctttcttttattatgaggagaaagttaaaggatctgttaactttagacttgattatattaagtgagcatattataatttctaaggcaactactaaaagaaatgaacaatgcatagcttttgaactatttaaaggggaaaacattgaaatgattaaaatactcagtatatcaaaaataaagtaaaaaaggagaaaagaaaaaacatggaatgggtgtgtcaaatagaaagcggtggctcacacctgtaatcccagcactttgggaggctgagatgggtggatcatgaggtcaggagatcaagaccatcctggctaacatggtgaaaccccatctctactaaaaatacaaaaaattagccaggtgtggtggtgtgtgcctgtaatcccagctactcgggaggctgaggcaggagaattgtttgatcccaggaggcagaggctgcagtgagccaagattgcgccactgcactccagcctgggcgacagagcaagactctgtatcaaaaaaaaaaaaaaaaaaaaaagcacaaaatatgtttgcagatttaaactcaaatatatataaaatgtgagttgtgcctttaggaatggtgcaatgtcatggccttaacaatgtagtgttaattacatttcatgtaaataaactaaacgctccagttaaaagattttcagacttgataaagacaaattctatctccatgttatgtacaagaaacatgttttagaattataaagatatagaaaagttaaaaggtaaaaggttatataagatataccaaaaaagcctaagccaaaggaaactagtatagctatattaagaaagatatggttttaaagaaaataaaattacaataaaaaatcagtgaagacacaaaaggtttgaataagataatatgattgacatagtgagatctccacctaactactgcagaatatatatatatcaaacatacagaaaaattattaaatacaaatgaacaaataaaagcaagtctcaatacatttcaaaggtttaaaatcatacaatgtgtgttcttagattataagacaagccagaaatcagcaaaaattcgaatgagaaaaattaatatgttagggattaaaagacaatcatgcttcaaaacaaaattgtaaaaatgttagaacatattttgaacagaattatagcaaaatattgcatataaaatttatgacataatttcaaaataagtatattcagagaatctaaaaattaattaagtaaacattcatctcaagaagttagatatgcatgagcaagaaggaaataatgaagataaaaggagaagtctttgaaatagaaagcaaatatataatagattcgacaaagccaaatgctgcttcattgattttaacaaaattaaaatatctgtcaagaagtattaaaaaaaaattagaaggcacaaatagtcaatatgtagaaacagaaaagagacacacttaggtatatttcagatatttaaaagataatacaaggttaatatgaactggaaaaatttagacaaaatggataatcttctaataaatatataacccaccaaagtttattcaggaagaaataggaaatctataataagagataggaaattttacaattatggtgcccatacaccccattttgcccaggacagtcccagtttatatctattatggattaatgtccattaattattttcataacccctttaattctcaaaagcgctccagtttggaggataagccatatggtcatcctgcctgtttataataattagagtaactaaatccgtagtcagaaatgttccgcaaatgttcctcctaaaaccattccaggcctcaattcaccaaccagttctaccaaacattcatggaagaaataatttcaatcttagccaaactctttcacaaaatagaaaaagaggaaatttttcctgactcttaagactagtgtaaccttattactaaaatgtggcaaagacagtacatgaaaagaagattacaggcaatgtcaagcacgaacacagacacaaaactcgtaatccaaatatttgcaaactgaatttagcagtatctaaagggataataaattatgaccaagttggcaatatcccaggaattcaaaattggttttatgttagaaaataaactaaaataggccgggcctggtggctaacacctgtaattccaatgctttgggaggccgagatgggaggaccacttgaagagtttgagaccaacttgggcaacataacaagattccctctttacaaaaataagaataataacaaaagctggatgcagtgtgtgtgcctatactcctagctactcaggagactgaggtgagaggactactagagcccaggagttcgaggctgcagtgagctattattgtgccactgcactccagcttgggcaacagagtgagaaactgtctctaaaaaaaaaaatcaactaaaataattcaccatgttaccacattaccacattagagaagaaaaatcataacatcttctcaatagatatggaaaaaagcatttcataaaattcagcatacattcatgatttaaaacctcttatcagagtgagaatacaaaggaacttccttgatagttatcttcaaaaatcatacagcacatctcactcttaatggtgatattaggtggagatcagggcaacacaagcttcctactatcattgcctctatttgatattgtgatggtggtcccagccaataaagtaagaaaaagattgtgtaagaactagaaaggaaggaacaaaactgccattattagtgacgaatatgcttatgtaatagaaaattttaattaaaactacatatattattattagaattaatgagagatgaacaacttttctggatatgaaaaatcaaaattgcctttctttacatcagcatcaaagcactggaaaatggaaaaaaaatatacatttacaatagtgtcaaaacatataatgtacctaggaagaaaatctaacaaaaatgttatggagaaaacaataaacctttattgagagatatcaaagaaactataatggacaaatatatagtagtccccccttgcccatagtggatacgttccaagacccccaatggatgcctgaaactgcagatagtactgaaccctatatacactgttttctcctatacacacaaacctaggattaatttgtaatttaggcacagcagagactaaaacaactaaaaataaaataaaacaattatgacaatgtgccagcattattactctttcactttagggccattattaaataagataaggattccttcaacacaagcactgcaatactgcgacagtcggtattgaaaactgagatggctgctaagtgactgatggatggggggcttgtatagccgtgggtgctctgggcaaagggatgactcatattctgggctatgcagagcaggacagtatgagatttcatcccccccagtcagaacggtgcacggtttaaaacttatgaattgtttatttctggtgaattttccatttaatattttgggactgtgactgaccaaaagtaacagaaactttggaagcaaaatagtggataaggggagactactgtaacaagtttctggattagaagattcaatattgtaagcatatcagaattttccaaatcaacccatagattcagtgcaaacacaccaaacacataatcgtttaagttattgagcttggcaaactgattctgacgttaaaatggactgatagctgataatttttttttttttttttgagacagagtctcaccctgtggcccaggctggagtgcagtggtgcgatcttggctcattgcaacctccgcctcctgggttcaagcaattctcctgcctcagcctcccgagtagctgggactacaggcatgcgccaccatgcctgctaatttttgtatttttagtggagacggggtttcaccatgttggccaggatggtctcaaactcctgacctcaagtgatccgcccgcctcggcctcccaaagttctcaggcgagagccaccatgcccgaccagctgagactttttttttttttttttttaagacacagtcttgctctgtcatccaggctggagtgcagtggcgcgatcttggctcactgcatgctctgcctcccgggttcatgccattctcctgcctcagcctcccaagtagctgggactacaggcgcccgccactacgcccggctaattttttgtgtttttagtagggacggggtttcaccgtgttagccaggatggtctcgatctcctgacctcgggatccgcccgtcttggcctcccaaagtgttgggattacaggcgtgagccactgcgcccggagctgagacattcttaaggaagaaaagcaaggtggaaataaatatttgtcctgtacgatgttgagacttaatacatcactagaatgattaagaaggtataaggttggctcagggatagacaaatagacccgtagtacagagagagagccccaaaatacacctagacacatatggatacttgatatacaacagagttggcattgccaataagtcatgaaacgatggctttttcatgaaaggtgctgagacaattgggatttcttataaaagaataaaacccaaaatggtcctataccttacattacactaaaaaatcatttataggtaaattatatgtgaaaagcaaacctgtaatgcttttagaggataatatagcagatatctttaagacttgggaatatggaactatttcttaaatattacattaaagcatctagccataaagtagaagattaataaataaggcaatattaaaactaagagcttctatcatcaaaagacacaagactgggagaatatattcacaatatatataattggtgaaagattaatctccgaatatatatatttatatagtttttaaaatgcctacttatcattgagaataaggcagacaactcagtagaaacatgcacacaggggccgggtgcggtggctcacgcccccagcactttgggaagctgaggagagcggatcacgagttcaggagttcaagaccagcccggctaacacggtgaaaccccgtctgtactaaaaatacaaaaaaattagccgggcgtggtgtcacgcccctgtagtcccagctactccggaggctgaggcaggagaatcgcttggaccaggaggcgaaggttgcagtaagccgagatgcgccactgcatttcagcctggtgacagagcgagactctgtctcaaaaaaaaaaaaaaaaaaaaagaacgaaagaaagaaaaaaagaaacatgcacataggagttgaatagacaactcaacaaagaggcattccagatgtctgataaacatatgaaaggtgtcatcttcatttgcattcacggaaatgcaccttgaaacaacagcgagataccctacaatcccaacaggctggctaaaattacgaaatctaaaataagtttgggaactcaaaagcattgctagtgtgagcacaaattggcaaaacaactttggaaaacagcatgacattatggcatagttgtcaacgtattgcttctcagctcaaattcacttttcaatacaagctttgagatgagggaatttctttaagcatttctcctctaaagtgagcacgatgttgagctttctcagtagagggcgctaggcaggtgttgcgggagggaggggcgcttctgcagtttctggcggaggctcagtggtcaaccgtgcgggtgggaaggggtcgggtggattctgcccttccatatgcccagagttccaagtccctcagcgacttcacagcccccttgtctgctcaacacggtcactatgtgtttcaggcgccctcaggcctgttgcacagtcacacgcaggccaccagctgcggctcccctgcccagcctgcactttggagggttgtttcctgttttttttttccaccactgcaaaccatcaaatttctctgccatccagtgggttcaactacaccttctccaacgaagtcagaaccacagttttggagagggagccccttgcaagtttattcttccttgggtaactctctcttggccccaaggcaccatgaaagttttcttattttctatagctactcctttatcccaacttaataattctttatattaaactctccctttgcggtaggagtttatattaaactaaaccctttgtgtttaaaataattgcgtggtttctatcttctgattggatccaccctgctaagtattgagaatgtgccatacaattccacagcaattccacttctaattatcttttctagaggagatttttgcacacgtgcattaattcacaggaaccaaaacgtttatagcagcaatttgcataaaagccaaattctgaaaataactcaaatgttcatgaagagagaacagataattaaattgttacagtcctacaaggaaatgaaaatcagtgaactacagctagacagaacaaaatggatgaatgtcacagacaatgttcagtgtgaaagaagcaggttacaggttggtgtttactatataatcccattgatcccatttaaagttcaactttatttaaaactaaactacattgtttggagatatatatatattaaaaccataaagaaaagcaaggaaatgaatattttaaaagttagaatagtggctacctttataaggttgcttttggggtgccctctttgtcatgcggatgtggttacataggtatttgaattacaattcctctttgacttatgcatatatgttctgtgcattctattaaagtctttgcaattatgtaaactaataaccacaacacaaagaaagacacagttcctgcctttatgaaacttacggggagaaagaacaaaacagaaaacgtggaatcacttaagatggagatagcatgattacattttctttctttctttctctctctttctctctctctctccttccttccttccttcttttcttttttgagacaaggtcttgctctgtcacccagggtgggatacagtggcacgatcatggttcactgcatctttgacctcctgggctcaagtgatgctcccacctcagcctcccgagtagctgggacaacaggggtgtaccaccacacctggctaatttttgtattttttgtagagatggggttttgtcatgttgcccaggctggtctcaaactcctgggctcaagggatccacctgcctcagcctcctaaagtgctgagattacaggcatgagccactgtgcctggcctgcgattcattttttaaacaagtatctttggactgcaatccggctagattagaccttggaacaatgaaatatgacaaacattttaaaaatgcattgttcagctggcaagaaagtatggtgaattccaagggtggaaaacaaagagataatcaacaagcagagatatggggagctgatgctgtagttgccttaggtgcagtagtgatgtactggtctcagtagccaggcagcttggattttaatggtcacctgctgtccaggacaggctttgggcctaagggagatgggaaggttgaagtgagaccctggataaagctataccacagggacatgatagactagaaaaaaaattacggacacagggagacaaaataaagcttttgtgttttggtttgcactccagttagaataaaatcaggggtgtaatcccagcactttgggaggctgaggtgggcagatcacctgaggtcaggagttcgagaccagcctggcaaacacgacaaaaactcatctctaataaaagtacaaaaaaattagccaggcatggtggtgtgtgcctgtaatcccagctgtccaggatgctgaggcaagagaatcacttgaaccctggaggtggaggttgcggtaagccaacattgcaccattgcattccagcctaggtgacagagtgggactccatctcaaaaaaaaaaaaaagaaagaaagaaagaaagaaaaaagaaaagaataaaatgcagggaaaaatgtgcccagagaagattgataatcttgataatccagggttggacctcatgttggtctgatattctaaattacattacccatgtgagccagtaatctctaggtagaaacattaacataagaattaatcactctaggatgatactactgctgggcacctggcagaagcaacataaaaccgctttagagaaatacacctgtacccaggtcacatggaacgtccaccaaatgggagctcatgaacctaaattacaataacatgatgaaataattcatcctgatgaaaagtcaacagacgcaatagtcagcaagattagactctcagaactttagaaaatataataaataaatattagtaaaatatcaagattataaaaccaggagtcacataacacaagaacatcttagtatcaagaaaaaattaatttgaaaaaactagactgaacttccagaaataaaatatgtggtcaatgaaattaaatatatcttcttgcataatagttcctaaggcattggcctcaaagtagtctttacaggaaattggagctgcctagagtcataatgtcaggtgagtgataatttacaagcaattatagatatagtgatatatttagaggtgagagcagccttatagatatactagtgacactccctttggtgaaagatataaaaatcttagccccaggatgtaaaccaagtcacagataacagtaaactcccatctagagcacacatgttctgacacctgttaagtgccttttcagatatgtcacattcccctatccatagacacaggcacctgctgagagaaagatcagggaagtttgatgacacttgttgcagtgaaaagctggtaaaaggagaaaggaaagaggctatctcagacctgaaaaggctgggagactatttttgtatataataacaggaaatagtcttcacattatataaacaggaatttaatggaggagagccacccagggactctggggaatgctggaatacatacttgcttacgtcctgcgagggtggatttgagtgaggagcagggcagtgaattctggcacttgtcagtgccagggctaaattattctgctcctgtttggtggaggtaacagctcttacatcactttaattgtttccttccattgacgtgaaatgaggaatttcttccatggagtgcttggttcaagcactgccaagagttggcaaagctcctagtggcatctttcacttttggtctctggtggctcttaaatacagatgaattgtgtaggaaacaaacaggaggaattatcaatcatatgtgtctcctctcaagaaaatgtgccattttcctcttatatatactgcgatggcatttgttttttcaagtttgctcagttcacaatctgcacacttcaccttcttcaagaagtctcctaggctgaaagctattgtcagctgttctgtgattctatcttgtgttaccattgcaggtgtacatgtcttacctccttcagtagacagtgacttcggaagacagatcctggtctgatccatttttgagttctctataatggctttcccagttcctcacacacatttggtgcttaataaatgtttgtcttatgagtgaaccgatctttgatttgttgtgtagtaaacatacaaaattctaggctgtatcagctagaaattatgttggtactagtgactgagaacctagcatagtggcttaaataaattaaagccttctttttctgtgatgtaaaaaaaaaattattagtcttgtcagtccaggatgggtaaggcagcttcaccacatcatgagggacccaagcacttccttccattctgcgttcttcagcatgttgcttgcatcttcgaggtcacaaaatatctgccagagctccagccagtaggtctgcattttaggagaatagaaagggaaagacaaggggcaagcaggctcttccctcattggcatgaaaaaaccccagtaaagagagttgcaggaaacaccaatcaaagacttatatttaaatttcattgaccagccccttaactgcaagggaggatggggagtaaagctttttagcttggcacactttccccctaagcaaaatctgagttatgtttctaaggcacaaagagagagaggatattgggtaagcagcctgcagtctttgccatgaaggatcttaatcattcatcagtaagtatgatcttttttttttttaaatgtcaattgtttctttaagatttttagtttctcttcaaagtctataggtaaatcactgaaatttatccagatcccagccttcacatccagggattttggtgtaccaccatctactcaatgctccccgtcctcctaccccatcaaatgagcttcgtttgtttttcctttatctctaagtggtatgacaccatctgctgttttctgcttttgacccagagccatgtctggcatcatcagactaatcaagaggtgggaagggacaaggtcaggcatgggttagtgacacaaaccacttggtaattaaaaaccccttggtgataacattttctccttgcacaacaaaatatccattgcaggattttgataaaattctgctctattaatcatcagcaattggaagctcagaatgtgaggctaattgtcagattgatgttgcggctgagaggaagtattaaaatttcgcaaagaccataagagaggcagttatagaaatagtgtgctaattcttagcttacatttccatatatgttaaatttctcttagaaattatttggattactgatgtacaagtgattactaaagataataattaatcaatttagtcctccattccattaatcaataattgttgagtatatactatttgccaggcattgtgctagctgcgagagctataaatgagagttttttaaatgtagacgtttctgagttaaagatacactgaaaggctaaaatgaacagcaggaaaatgagatgataatctgaaatcagcttccatagaccaataatcccagaaaggctgcgagaaaattaatagcagaaactaagcttgggtattttgcaattctcttttagccacacaaaattaaattagaaattctgagaagactcaagcagggactgttaatatggggttttgacatgtattaactagacaatctttatgaataaagaaaagagaacaagtcgcttccatggcataatattaaaataaggcctcctggatagccactattctgaataagataagaaagacgatgccattacagctaagcagctcaaaattccattagaatattttaagcgttagtataggaatttacacaagagttagagaaaatgaaatttaaaaccaagacctgaaaggcactcatgaatttaagggcaggtcattttgcaggggttgggtggggcaggagaatcactggattgtgaaattgaaattgaaattgaaattggttaatttcaacggactacttgatacaattgatagccatggatttggcaactgtggatgccagggcagacagagtttgctcctaagaagatgcccaactcagagacgctgggtcctgtgtcccatggtctccagtgcctttcatttggagatcatatcactgtcctgtgcttttgaccttgttagttggtctgacatacttgttttcttccctttagctgaatgaataatttataatctctggaaagtataaaaacccaatgtactcttatgtaatttgtgtttaaatgtaaccattatgatgtcctgtgcatactatgttaatgttttaaatgatttttgaaaggcttaaaaagatttctctctacaaaatttataaggctgatgtagtagattgttaagaggaaggtttcttacatttgtaactctccctttgtatatttcgaatgtttgagagggggagttatattaaaataaaactttcaaatagccaagggaatttgattggttaaatatgcaaatgatgtttaacatgaaacattactcctggccaggtgcggtggctcacacctgtaatcccagcactttgggaggctgaggcgggtggatcacaaggtcaggagattgagaccatcctgactaacacggtgaaaccccgtctctactaaaaatgcaaaaaattagccaggcgtggtgacgggcacctgtagtcccagctactcgggaggctgaggcaggagaatggcgtgaacccaggaggcggaggttgcagtgagccgagatcgcgccactgcactccagcctgggcgacagaatgagactccgtctcaaaaaaacaaaaaaaagaaacatcactcctgtaatcccagcactttgggaggccaaggttggcggatcacctgaggtcaagagttcgagaccggcctggccaacatagtgaaaccccatctctactaaaaatacaaaaattagctgggcttggtggcgcaagactgtaatcccaggcactcgggaggctgtggcagaagaatcgcttgaacctgggaggcagagtttgcagttagctgagatagcgccattgtactgcagcctgggcaacaagaatgaaactccacctcaaaaaaaaaacacaaaaagttaatgattatactttaaaaaaaattttactgaagtatgaattttatcaggttaaaaagagccttagctctagatttaagagcataattgctgggtcatatgtgtatggctccagcttggatggaaagttctgaattgttctccaacactcccactgcaaccccaccacacattattccatagtctgccaacacttgatggtgtgaggctctctgcttgttcccaacctgacgactataaaatgatatctcgaccaggcgcggtggctcatgcctgtaatcccagcactttggaaggccgaggtgggtggatcacctgaggtcaggagttcgcgaccagcctggccaacatggcaaaaccccgtctctactaaaaatacaaaaattagccaggcatggtggttcattcctgtaatctgagctacttgagggggctgaggcaggagaattgcttgaacctgggaggcggaggttgcagtgagctgagatcacgccactgcactctagcctgggcaacagagcaagactccatctaaaacaaaaaataaataaataaaatgatatcttatgatggttttaacttgacttttcctgattattagtgaaatttccatttgtcttttatgataatttttatgttgtctttttcttatacatatatattctggattagtcccttaggagagttagatgtgttgcaaatagcttctcctagtttatgcagattttttacttttcttttttttttttagtatgtcttttgatcagtagaagttttatattttaatctcgttcagtttattagtcttctcctttatagttggtgcttaggttttgaaatatcaagtaccttttggtaatttttcaacagcttagcttatatggcacaatgcatttcatatgtacatatacaaatgtcaaaattataaatatgcctaaattatacatctgtaactagccttaaatattgtaattaaaactgtataattaaactaagcatgcaagccaatagtttaaaaaagagtttcactccagtttggtactgatttagctcttgagctattgaaatcaatggccagcatatgaagcaattatctgacgcttgtgggtggtgaccttgcagcagctcagcctcttctttcatttcatcctatttttgtccttaatagcagatatttatctcagtttaaaattttattattttctttataactacaatcttaacagtttaaaatagtactaaatttcatgtggaaagaaacttcagattctcagcaccttatcttccttagcgatttccactctagccctcaatgttattaggtaaactcttatctcaattgttgttttcactgagtgctatctaaccataatgaaaaagggaaaaaaaatagagtccgaattatccataactgcctctgctttctgagaaaggcaacgtgattctttttcagtggaggaaaaacctctctatggacttttttcaccccataacagagagattagtgggagaaagagaagagcttgagattcctgtctatcagggcctttggaaattcaaattgtgtcccagagctgaattctccaaaagaatgtacagagatttggaggtgcgggggagagagggctaaatagtttggcgggaggctggaagctgagctggtagatagggtcagaagactttttaagaacaaagactggagacttgaggtgactccatcttcactattacttcagatctttcttataatgtgcttcataaacacacaccttgtgtgaaagctgcttttgagaaaaagaaacgtattttatgcgacgcagggtgcaacaggagcggcgcatgtggggcagtgagaaattccttcccctgacccgattcagcagtgaaggtgatcagagcaaataggaactggactgcttcacgctcctcaaggactttaaggagtgtgtcttccaccacccacagcaaagggctcagaaaattttatctgaacctcctgacatctgagttatacaaactaagacaaagaatgggaagcacatagcagccactggtccattacagttctaaagtccagccaggcgcgtatttacccgagatagaaaatgttccttagtcagggtctagtactgctcactggaagtaattccccgatccactctttttttgaggctctttagttcatcctctgtgctcttggctctgccctccaagttgtccttcattttcattagaagtagctttcacaatctgctgcttgcccctaaaaactggggacccagagagttcatttcattttgaaataatgtccctgctccatttagttagagctggctttagcaagtatgcagcaggggactaatatccagaatttagaaggaattcaaatgactcaacgacaacaacaaaccaataattccattaaaaagtgggcaaaggacatgaatagacatttttactttcttttttgtttgtttgcttttgagacagagtctcactctgtcacccaggctggagtgcagtcgggtgatcttggctcactgcaacctctgcctcccggactcaagcaattctcctgcctcagcctcccatgtagctgggaccagaggtgtgtgccaccacgcttggctaatttttgtattttcttcttagttagagatggggttccgctgtattggccaggctgatctcgaactcctagttaagtggtccacccgcctcggcctaaagtgctgggattacaggagtgagccatcgtggccggccaaatagacatttttcaaaagaagacacacaaatgaccaacaagcatatgaaaacatgcttaacatcactagttatcagagaaatgcaaattaaaaccaaatgagatatcatcttacaccaatcaaaatggctattattattattattttgagatggagtcttgctctgttgcccaggctggagtgcaatggtgcaatctcagctcactgcaacccacgcctccccggttcaagcaaatcccctccttcagcctccctagtagctgagattacaggagtgccccaccacgcctggctaatttttgtatttttagtagagacggggtttcaccatgctggccaggctggtcttgaactcctgaccttgtgatccaccagcctcggcctcccaaagtgctaggattacaggtgtgagccatggcgcccagcccagaatggctattattaaaaagacaaaaagtggcagatgttggtgaggatgtggagaaaagggaatggcttacacattgctggcagaaatgttaattagtacaacctctatggaaaacatcatggagatttctcaaagaaataaaaatagaactacaattcgatccagcagtttcgctactgggtatctacacagagtaaagaaatcattttataaaaaaagatacctgtactcatgtatatcacagcactcttcacaatagcatagatatcagcctaagtgtccatcaacaaatgataggtaaaagaaaatatttgtctatatacacaatggaatgctattcagccataaaaaagaatgaaatgatgtcttttgcagcaacgtggatggaactggaggctatgatcttaagtgaaacaactcagaaacagaaagtcaagtactgcatgttttctctcataagtgggagctaaccggtgggtaaacatggatattgagtatggatgatagacagtggagattaggaagggtggtgagatagggagagagaatgataaatcacttggtggtacaacctatgttatttgggtgatgggtaacctaaaagctccgactccaccactacacaatgtattcatctaacaaaattgtaccacataaatatatacacattttaaaaatttaaaaaaaagttctgagttcttgttgagtcttattgaggatcacaccatagcagaaggactacatccataattctttctaagatgcgcttttctgtactttgggccacatgtgaggctgctatggtaaatgctcttaagattcttagaagtccaactgtctagttgagaaagtctactaggtgctgccttaaatcttatagaagttttaataagggatcttggctgggcacagtggctcacacctgtgatcccaacactttgggaggccgaggcgggtggatcacctgaggtcaggggttcgaaaccagcctggccaacatggcgaaaccccgtgtctactaaaaatacaaaaattagctgggcatggtggcacatgcctataatcccaggactcaggaaactgaggcaggagaatcgcttgaacccaggaggcaaagttttcagtgagccaagttcatgccactgcactccagcctgggcaacagagtgagactccatctcaaaaaaaaaaaaaaaaaagatgggcattttaccttattaaaatagtaatcataagggagcttatagacaaaccttttttttaatgtttacttaccttggccatttcttactttgagaatgttttgctggccggagatgctgtcctgggccctctgtttcttcttactgctgcctaaaacctaaagagttctttctttccattcatctctttcttcctgcactttatcttcctgcactttactaaaacctaaagagttctttctttccattcatctctttcttcctgcactttatcttcctgcactttactaaaacctaaagagttctttctttccattcatctctttcttcctgcactttatcttcctgcactttactaaaacctaaagagttctttctttccattcatctctttcttcctgcactttattctgcactttcttcctgcactttgtaactttcttcctgcacttcatcactttcttcctgcacttcctgcactctccattcatctctttcttcctgcacttttaacacaggtaaaagaagccaattgtactttcaatattttacctaaaaatctccttattcagatcaagttcattagctatattttatttctgtctttcatgacattacaggtgacaatgtggccaaaaatctcactactatgtaacatcttttgtcacgcttccaaaagcaattttctcactgctattgcaggcttcctaacaatttcctcactgcccttctagcctctgctgcctcccaatatcagagccaatgacaaatgttttagggtttggttatggcagtatcccacttccagatagcaatttctgtttcaattatctactgctgtgtcataaacccgcccagcatttagtggcttaaatcaatatccattttattgctcacaattctgtgggtcaggaatttgggtgagggctgatggcaacagctcatctcagctccagtggggctaactgggaaagatccaagctgtcggccggctcgggcaccttgattctcctgtctgtggcctctcatcatccagaccctgttcctttccatgtagcgtctccaacaggacacgctggacttctttacacaccagctggcttccaagaaggcagaaacagaaactgctaggcctcttatggcctaggcccagaagtcacaatgccacttccagagctttctgttggttagatcaagtcatgaagccaatctatattcaagggaaggggaaagatatttcatttctttgctgggaatgatacatcacaaaacagcatgcaggataggatggattggggtgaccatttttagaaaggacctacctctcagaaagaggcaaaaattcatgaactgaaatactctctgagacaatctctattttatagtctagcaataaaccagaagttcaagctctgctctctggctatgtaagcaaactgaggtcagaaaggagttcaagcaacaacgaattgatacaaggctgctgttacaagattctcatctatagtggtttggtctttgctcgagcattttgagagacaaactgcctccaaaggagacctgttccacaattgaataattctaaagtctataacaatcttccatttgcaaagttcaacattgcctttctgtgactcctcccatggtcagatatctgccctccaaggccactgaaagaaaggctactccctcctcaatatggcattcatttaaatctaaatattttcagacacttttcttgactcaagacttcctaacttctttacctgtctatcatgttaagtcattatttcccagaaacatgtgtttatgtataacacatacaatccatagaataaaatttgcccagaatagtatgtttaagaggaaagaaaagtatgtaatagattattgaaagtttcaaaatatctggtggtacaatgagtgagttaaacatttatctggcttaaccattcagtttgatcttgtggaaatccagtgcttggaacttatcttgtcctaactttttcataacatagtcactgtttacctgaataattgtctaaatgtagtgtcctttatggttggttagtattcactgggtgatggggaaaagaaatacataaatcctgagaaaagctgaaagcaaagtttattcttacaaatgacaaaaaatgcccagatacaacagactctctgtttgatgtgtgtgtgccagaatgaaaactatgggtctgaggcaccttctttttaaaaaaaaaaaaatttttatttgcataggtttttggggaacaagtgatatttgagtacatgagtaaattctttagtggtgatttgtgagcttttggtgcacccatcatctgagcagtatatactgcgcccagcgtgtagtcttttatccctcaccccctttccacactttgtccctgagtccccaaagtccaatgtatcattcttatgcctttgcatcctgaggcaccttcttccataagcaccatccagaaggagaagtggttcttcaactatggctgatgggagcaaagtgctgaagcaactatgactggttgaaagaccatttctcctgtgaatggtgcttatggaagaaggtgccttagacccaaaactagagtgaggcttttattggttggggaaggtggctataaaaagataagaataatgaaaagctatgaccaattaaaaaaaatgagaacttaatcacagccttatcgacccacaaccaggggtccacaaatagccttaattatgacttatgttattaagataacaaccccaaattttccgggcagcaattttttggtgccaatattttggtcttttgcttccaaagactagccttttgataaagtcagacagctctaaaatgtatgtgtttaagttctataaatagacatacatttgaggatatatgaaaggagcaaagtatttatctcaccacacagttaagaattttaaaaacattcattgttggatagtgatttttaaaacattaaaataagtggaacgattgctttgaatttatgaagaataacacatataattaatgacttttctatttgtattatacttgcttagatggttcaggcttagtaagaaagctattgatagtagaaaacaatgtgtatatgtaataataaagaaataacgtggattgttagtgaatagaaaatagtccttttggccaggtgtggtggcttatgcctgtaatcccagtactttggaaggccaaggcaggaggatcacttgagccaagcagttcgagaccagtctggttagcatagtgataccctgtctctacacaaaattaaagtaaaaaaattatctgggggtggtggcgcacacctgtggtcccagctacttgggaggctgaagtgggaggatcccttgagcccaagaggttgaggctgtagtgagccttgattgtaccactgcactccagcctgggtaacagagtgaaatcctgtctcagaaagaaagaatgaaaaaaagaaagaaagagagagagagagagagaaagaaagaaaggaaagaaagaaagaaagaaagaaagaaagggaaagaaagagagagagagaaggagggagggaaggagggaaggaaggaaggaaagaaagaaggaaggaagggaggaagggaggaagggaggaagggagggagggaggagggaaggaaggaagaaagaaagaagtggatatgttttggatgtttatcccctccaaatctcatgttgaactgtaatcccccatactggaggtgggacctggtgggatgtgttggatcgtgggagcagatccctcgtgaatgacttagtgccatccccttgataatgagtgagttcttgttcagttggttcacgtgagatctggttgtttaaaagagtctgggacctcccccttctctctctctctcactctctctctcaccgcgtgaccctgcgtgccctgatttaaagcttcctgaggcctcaccagaagctgagcagatgctggtgctgtgcttgtacagcctgcagaaactgaaccaaaaaaacctcttttctttagaaattacccaccctcaggtattcctttatagcaatgaaaatggcctaacacaatagtcttttgactatatttagtttgaagatagttccagatatttccctacattactttctcatctttagtgagcaaatggtatactgaaactagatagtgatggtggtgcgacaatgtgcgtgtactaaatgtctctggattgtacacttaaaatggttaaagtggtaaattttatgttatgtatattttaccaccacaacaaaaaaaacctttcttttttttttttttctttttttttttatttgagatggagtcttgctctgtcgcccaggctggagtgcagtggcacgatctcagctcactgcaacctttgcctcccaggttcaagtgattctcctgccttagcctccccagtacctgggattacaggcacacaccaccatgcccggtttatttttgtatttttttagtagagtcggggtttcaccatgttggccaggctagtcttgaactcctgaccttatgatctgcccgcctctgcctcccaaagtgctgggattacaggtgtgagccaccacacctgaccaaaaataacctttcaaaacaaacaaaccaacaaaaaacacccatagttcacctaaatatgcctgaaaatgtactttgcagggaacctaaaatctgggatttgaagtaaaaaaggataaccccaagttgaatttgttaagattgcccaccttttctttgctgacaactggcaaatggtttgctaacttctgggcagatgagagttcagtcagcacaatcaacaaagaagtgacgttcactcgggcccaggcaggcctatgtgctgggagcttttggaccttaaattggtctgagttcactgttgctccagttgcagacaggagcaggcaggttcaagagtttctgatgctttgctgtccagcagtcagctgaccatgagcacagccggcacaagcagccctttatgctggtgagaatcctgccagcagtgctgaggcacaatccctcctttatgtgttccctttgcacatttgtattcttggggcctttgggatttttgttgctgcagataatgggaaatgggtgtcggtgggtgttacgagcagggttttcagtagactaggaagaacaactggttaaaaataaaataacaatagtgacaaataggaaaggtgggcaacctcaggcagtacagctcctgagcaaatgcttccagcttttaccctaaaacataagcaactgggcacaactccaggccttgactgtctcattggctgataggaataactactaggaactattaagattacctgatattctggccttttcataattacagtgcagcctagttgatgttgttggaacatgatggttctttgatagaaaagtctctactttcattacaaatggaaagtgcaaatcagaagggtttgtaccatttggggttaggatccaaaacatttgttccaccaagggggaaaaggtccaactacaacaagttatcttgagattgtccagggtgttctctaaagccctaaatccaaaacttttccttttttgaggcagactctcactctgttacccaggctggagtgcagtggttccatctcggctcactgcagcctccgcctcccaggttcaggtgattcccctgcctcagcctcccgagcagctgggattacagacgtgtgccaccacgcctggctaattttttgtatttttattagagacgcggtttcaccatgttgtccaggctagtctcgaactcctgatctcaagtgatctgctggtcttggcctcccaaagtgttgggattccaggcgtgagccatcatgcatggcccctgcatctgaaactttaatgtgcatgcggattcaaatggggatcttgtcaaaatacagtttctgattttgaagattttgcatttcttttttttatttttatttttattttattttttatctttgagatggagtctcgctctgtcgcccaggctggagtgcagtggaacaatcttggctcactgcaagctctgcctcctgggttcacgccattctcctgcctcagcctcccaagtagctgggactacaggcgcccgccaccacatctggctaattttgtgtatttttagtagagacggggttttacagtgttagccaggatggtctcgatctcctgacatcgtgatccgcccgccttggcctcccaaagtgctgggattacaggcgtgaaccaccacgcccggccgaaaattttgcatttctaacaaggtttcagggagtactgatgctgcaggtctgaggaccacacttcaagttgcaaggctgtcaggaagtgagagctagctagggggaaactagcatcatttcagttaggtctagtattgctgctaatttactgaaagttttaaaatgtagcttttctgtaaagaaacaaacaggacattctaactaaacaaagtgctgtgaaatcagtcattcacactgggtagctagagctactgtgtctcaactggaggaggcaccatctccagtggatcatttagaaacgtagagggtggctactggtatttggtgcctgggggcccagggcactaaatgtctggtaatgtgtggaagagttctgcacaaataattgtcccactcaaaacgccaagagagcccccctgccccgccccattcaggtacccgagctacaccagtggagatggaggctgcacccatacctgagacctcagccaatcaattctatggccatctccttgagtgtgtcatctggaatagaagatcctgcccatgtattgtagctcatctctttagaactttgactgcccttggaattctccagtgggaagagtggcctctgtctagtgtaccacatgtggttccatagcttgatgtattctctcagcaaaggatgagatcgacaggaaaggcttcaggaagccctacggaatttggattcatcaacattttgaatcaaaaatcagaaaagggaacatccagtgttccccttgagacgataccctcaagtgctgctggtgctcacctcctaaactcctaaacggggctgtgaccagcttgcctagtgccaacgacaacagctccaaggcatctgggcctatcaaacttccactgcgttcttttccacaaaagaaagaatcccacagcgctagatttgctggccatcatgtcaaacaaactctgacctctgatcccaacacagtgttgaacattacaatgaggatgttagaaattctgctggagactgagttgaggtaaaaatagatacaggggctgggcatggtggctcacacctgtaatcccagcgtgttgggaggctgaggtggaaggattacttgaggccaggagtttaagaccagcctgggcagcatagcaagaccctgtctctaaaaaaaaaaaatttttttttttaattagctgtgtgtgtttccacgtgcctgtaatcccaactactcgagaggctgaggcgggaggattgcttggtcccagaagttggaggagtgcaatgagctgtgatcccgccactgcactccagcttggtcaacagagcaagaccacatctctaaaaacaaagacacagatatgagaaataaaatagggatgaaaggaatgagttaagacaatgttagagaaggatgacgtagtaagaaacctgaagataacgaaaacccacattaacctaatgttgcagaaaagagggcttcatcattgttgtctgagaaacttgtgagtaaaagacaaaaataatacatattgtgagaaatacattcaatacaatataaggaaaatattctttagcttcttgagactccatgaagttcaagagttaggaaattctgaaaagggtttggcagggtcatagtgattccgtctggaaagggtttgtttgtgcttggtctcagggctgctaggaagatgggaaatgtctctggcactccaggagagcaattactctgtgccatgacttcatgtgccccctcaccatgatgcagtgccccatgggagatgttctgtcactgatcccactgtctcactacattccaacagtccaaaagacaggcaaaaatttagactgataactttttttattagtctgatttaaaaattagttacacaagtaaaataatgtctgtatcacactcataatcacgtgtgcacatgaaaatgttagctcagaggaggttgaatgcttctccagtgcagacttcctggaaagctggaaagctgggcaatggctcaggggcccctgggcacagcactgtcttctcctgaatgagaatcagctgtgctgatgcctacgttagttcaagaaccaggagctgcataaacaagcttttgagaagtatgccagaagaagctcagattgatgatggtgtgtttgacaaaattaatgaagccatgcttattagactgaaagataagattccaaatgtgagaatacaggcagttctggcgctttcacgacttcaggatccaaaggatgatgaatgcccagtggttaatgcatatgctactttgatcgaaaatgattgatttgaatccagaacttagacaggcagtgttatcatgtattgcaccatcagcaaagactttgccaaaaattgtagggtgcaccaaggatgtgaaagaggctgtcagaaagctggcttatccggtgttagctgaaaaggttcgtatgagagctatgtccattgctcagacagtaatgctccctcaacaaggttttaatgagagatgagatgctgtgaaacaagctatgtggaagcatcttctccaaagctggttatggttctctgagggaaatatcttcgagtggcttcagcagttggatgtagaaaattctgaagtggcagtctctgtcctcaatgccatgttttcaatgactcctctcagtgaactggtggcaatctgtaaaaacaatgatggcaggtacataaaggattcattctttgaaatgtaatactgattaacttctacaattaatttgttttttttcctccccatagcttaagattatattaatatctttaatcttacctcccttttgttttcttttagtctgatgaatatcttctttcccttcttttttcccctcctggtgtaagaactcattactttatcttagactatctactttagctgtggttttctacccctcggtttcttactttgatttttgaattagcctaccatgagaaaatccagcaacatgcacccctagtatatgtttgcttatttggttcttttttgttctaagttccttcattcctttctgtgttaatgactctaattaaaaggatagtggttttaaagcaaatcttcttattcttatttatgttctcttcaatttgtaatgatataaagatcatgctttctcttacactctttcttttaagtgaaggaaattgattctagtggaaacgttaactcctgaaattgctttgtattggtgtgccctttgtgaatatttgaaatcaaaaggagatgaaggtgaagaatttttagagcggatttcgccagagcctgtagtatatatagactatttactgaggtaaatttttttttcttttagtttggagaatgcttgtgttgctgcaactgttaacctcccagcccccttcctcgaggtcatgcttgattgtgaatatgttaaaaatcctttttttttttttgtacatgccgggatagttatatacattgagtctttttgaatatcttgtatatcttgtgctggtctgtataatgaaagagcaaatcatgtttaggatcatttcttcaaaactattaagatatgattatgaacatttctgcatatacagttgataatgatgatgtattatttctgaaattggttggcacattttctgttaagtgccagataataagtatcttagggtcttgtgggccataccatctgtcaaaaacaaaaacaaaaaacaaaaaagaccaggagctggttggacatttgtgaatgttctcttgccctacttcgactctcacttctcttaagttctgtacctcgactacacaaatcagaggctgccagcagatggatgtgtgcacgtgtgtgtatgaatgtacttcctgtccacctggaacttacctgcaaaaatccttgccacaatttggatgtgcagagaaagtgttgtttcttattttctttatatcctttcttgccttcctcaggtactacctattaccagcaggaaaacaaagcaaacaaaccaacagaacccaggaaaatggaaatggcccacctgatttaagctttagacatacacaatactttattgtacataagtgtcaaatgaaattaaaaacgaggaaaaaaagacatacacaagactttaaatggctccgtgggcactgtccagccctcagcttggatccgtctggctatccttgtatgtggtggcattgctttgggtgtcagggacgcccttggctgcttggcttctggactccctgcttacttatgagctcaggcctggggctggggggttcatggtgggacccgtgggcacaggaaccactcttgtggggcatagcccccaatggacccagattagacccctctaagtgcctgtagtgccatccatgcaaccacctccagccctgcctcagcctgacctcgctctagcaccatggacttggggcccacccagcggctctcagccacccctttcatgctgggactttgtgagggacactcagcacctacatcaggctgatcgcctcgccagactcttcctgctctttttttatccaccacgctgtagactgccgaggtagacttttctttacatttcctctgtgacatcttccccctaccacttcagagaaagccctgaggcccagcaggtccagcagatggatggaaggactctcttcatctccactgtaagaaatggtttaagctgcaaggcatacctagaccattcaaatagcagctgaaagaatccaccaaatccacaaagcacggatttcaagcctagcctcttgacaagagagaacatacctgctctcggccccaggcaataaaccccttgacttgattttgagatgaaagaggctagaaggaaatgtggcataaggacaaaaggcactggttaaatatttgtagactattctttccattaccactgttctatagagtcttgaggagaaaacaagacaaagcaacaaataattatataattcagtagctgcaatagataaagagaaccattaaaagaataggttttctcaattataaaatgaggcattaaccaaattttgaatattaactatatatttgactattcctggacaactagaaggctggcgattgtacatgcatttgtatttgccagttgtgtgtcttcctcctttcaacctcacacagctaatttatgttgaccctcaaaaaagaaaatgagtacttgaatgtcaaggcatgtgactttcattctaggacatatagtaacttccagagcactgagtcagcagtctaaaggtttagccttcatactcctgacagctgtttatttctttcagtgtaatttcagagaaacatatccagaagggatttgctgccctagatctatcagaaaacatatttaagatattctgtagttttatagcacaaaaatctaacactaaataatcacatcataacagggtttcaatttctgtaataatttatcttaaatcaggcacaagggtatttaaagcacacaactaatactttgtagagatttaatgagatgatgtatgggagcagtaggggctgagacatttgtttccagtactattttaaagcaataagagaataatagcatttgaaataacctttccaatctattggattcaggcttctgccttctgtatctaaaaagaagcttagtcactggcttctggtagatgagtaggacttctcaaagatcaggaaggcttggggtcatagctggtgatgcataaagggccccaggtcaagaagtctaagcccatcaggctcagattgaaaccaggaacctgagcgacaggccaaattgggacttaggaggtcctctaggcaaaatcagtccctgaaaaggaagattggagcagaaaccagtggctccagcaggtgggagagagcagacagcagttttcatccacaaggtaactggttgctttgatagcagctctgcctccctaagtgcttcagatatgaagcaactcctaagaaaagaactagaattaaaactatcaaaaattacaagaattaaaataatagagtagaaagtatctatttattacaaaagaaagcaatgaaaaggaatagtcacgagactaacaaaatgaagtcatgagcatgacaaataaatattgaaatggcagatataatttcaaccatacaaataataacattaaatgtgaatggattagacaccccaatcaaacgacagagattgttaagactggatttttttttttttttttgagatggaatcttgctctgtcgcccaggctggagtgcagtggtgcgatctcggctcactgccagctctgcctcccgagttcaagcaattctctgcctcagcctcctgagtagctgggattataggcgccccaccaccacgcccggctaatcttttgtatttttagtagagacagagtttcaccatcttggccaggctggtcttgaactcctgacctcgtgatccacccgcctcggccccccaaagtgctgggattaccggcgtgagccaccgcgtctggccaaggctggattttttaaaacaagacccacctagcagggtgtggtggctcacgcctgtcatcctagcactttggaaggccgaggcgggtggattgcctgagctcaggacttcgagaccagcctgggcaacacggtgaaaccccatctctaataaaatacaaaaaattagcccggcatggcggcgggcgcctgtagttccagctacttgggaggctgaggcaggagaatcacttgaaccctagaggtggaagttgcagtgagctaggatcgcaccactgcactccaggctgggcgacagagcaaggctctgtctccaaaaaaaaaaaaaggccgggtgtggtggctcacgcctgtagttccagcactttgcgaggccaaagagggtggatcacgaggtcaggagatcgagaccatcctggctaacacggtgaaaccccgtctctactaaaaaaattagccgggtgtggtggcgggcgcctgtggtcccagctactctggaggctgaggcaggagaatggcgtgaacccgggaggcggagcttgcagtgagcccagatggagccactgcacttcggcctggatgacagagcaagactccgtctcaaaaaaaaaaaaaaaaaaatcaaaaaacaagacccacctagtatgtgctctttaaaagagacgtgactttgattcaaagagtttcgagataaaaggatggtaaagatatctcatgcaagcattaactttgggagagccaaagtggctgtactaatatcagagaaaatttaaacacaaaggaattacttaatttaaaaaaaatttaagtgcatagtttagattaggaaatcaatctttgtggtgcgcagtactatgggttttggcaagtgcatagtgtcatgtatccaccattacagtactgtacacagtcgttttaccatgccccaaatgccttctggtacaactattcattcttcccgttccccagtccctgagcttctggcaaccactgatctttttcactgtctatgattttgcgttttccagactgtcaaacagtattgttgccttttcagactggcttcttttacttagcaatatacatttaaggttccttcatgttttcgtaatagctattgacagctcatttatctttatcactgaataatattccattatatgaatataccacagtttttatccattcacttgttgaaggacatcttggttgtttccaagttttggcaattatgaataaagctgctataaacatttgtgtgcaggttttggtgtaggcatatgttttcagttcatttgggtaaataccaagtagcatgatggctggatcatatggtaagagtatgttagcgtttgtaagaaactgtcaaactgtcttccaaaatagctgtaccattttacattcccaccagcaacgaaagagagttcccattgttccacatacttgctatcatttgatgttgttagtgttttggattttgggcattctaataggtgtgtagtggtagctcattgttgttttaatttgcagttgtcttatgacatattatgtcgagcatcttttcattgcttatttgctgtctgtatatcttcttaggtgaggcgtctgtttagatcttttgtctatttaaaaattaggttgttcattttcttattgttgagttttaagagttctttgtatattttagatacagtcctttattcaatatgtcttttgtaaatattttatcccagtttctcattctcttgacagtgtctttcacagagtagaagtttgtaattttagtgaagtccagtttattaatttgttccttcatggatcatgcctttgtgttctaaccaaagagttattaccattccgaaggtcacctaggtctgctcctaagttttgcattttacatttaggcctatgattcactttggggtaatttttgtgaaggatataaagtccgtgtctagatgcacttttttttgcatttggatgtgtagttgttaagcaccttttgttaaaaagatggcccggtgtggtggctcacacctgtaatcccagcactttgggaggccgaggtgggcagatcacaaggtcaggagttcgagaccagcctggccaatatggtgaaaccccatctctattaaaaatacgaaaattagctgggtgtggtggtgcatgcctgtaatcccagctactggggaggctgaggcaggaggatggcttgaacccaggaggcagaggttgcagtgactgagatcgcaccactgcactgcagtctgggtgacagagcgagactctgtctcaagagaaaaaaaaaagagagagagagagaaagagaggacattggggcctataggcacaggccaccatgcctggctaatttttgtattttttgcagagatgaggtgtcgccatgttgtccaggctggtctcaaacttctaggctcaagtgacttgcctgcctcggcctcccaaagtgctaggattacaggtgtgagccaccacacccagactgttgagaatttttgtgtttatgtctgtgaaaaacattggtgtgtgattttgattttttgtaatgcctgtgtctggtttttatactagggttatgctggccacatggaatgatttaggaactattccctctgtttctattttctagaagagattgtaatgaattggtatatttattccttaaatgtttgatagaattcactaacgaacccatctgggcttggcgcttactgatttgaaggttatttgttgttgttgtttttccaactttgttgagatataattggcattaaaaaaactgcatatggcctggcatgagggctcatgcctgtaatcccagcaatttgggaggccgaggcaggaggattgcttgaggcttggagtttgtgaccagtgtgggtagcatagtgagatcctgtctttattaaaaaaatttcaagataaattagctgggtgtgatggcacgcgcctgtagtcccagctactgaggagattgaggcaggaagattgcttgagaccaggcatttgaggctgcagtaagctatgatcaaaccactgcagtccagcctaggtgacagagagagacactgtctctaaaaacaaaaaaatccaaaacaaaaatctcccccaaaaaactgcatataaatttatgcatacaatttgatgattctggacatatgtatatattcatgttgctattgctgtaatccaggtaatacacgtatctgcaactttccccgtgtcccctcttttttttcttcataagaacacttaacatgagatctaccctgttaacaattgtttttacgacacaatatcttgttgttagctatggacagtctattgtacagcagatctctggaactcaccgatcttgtttaactataactttatacccactggataacaactccttttttctccttcatgccatccccaggtaaccctcgttctgttgtctaattcaacacctttgactattttagatgctcatattagaggaatcattagtatttctctctctgtgactgaattatttcacttagcgtcatgtcttccgggtccttccacgttgtgacaaatggtaagatttccttctttttaaaggttgagtaacgttgtgttgtatgtctatgtcacattttctttatccattcagctgtctatgaacatttgggttgtttctacatcttggctattgtaaataatgctgcagtgaacacaggaatgcataaatattttctcccattctgcggggttgcttttcaccccgcggattgtctcctttgctgtgaaaaagctgtttagtttgatgtaatcaaacttttctatttttgcttttgttgcttgtgcttttgatgtcatatccaagaagattattgccctgaacaatgtccaaaagcttttccttgggtttattctagtagttttacagtttcaggtcttacgtttaaatctttaatctattttgagttgattctcatatatggtgtgagataaggtccaatttcattattctgcatgttgctattcacttttcctggtaccacttattgaggagactatctttttctgcattgtgggttcttggcacacttgtcaaagatcagttgaccatagatgtgtggatttatttctaggctctctattctgttccattggtctgtctgcctgatttttattccagtacaacactgattactgtagctttataatatattttgaaatcagtaagtacgatgcctccagctgtgttcttcttgcttaatattgcttcagctatttgggatttcttgtggttctatattttttgagatttttttcctctttctgtaaaaaaatgtttaccgtattttgatagggcttgcactgaatctgtagattgctttgagtagtatggacatcttaccaatattaagtcttctaatccatgaacaagagatgtcttcccatttatttgtatctgtcttaatttctttaatcattgcttcatagatttcagtgtgcagtctttcacctctttggttagggttattcctaatattttatctttttggtgccattataattaggattgtcttctttttttaatatactagttggccacatagatatcttcttttgagaaatgtctattcatgtcctttgccaattttttaacggagttttttgttttctgcctaatttaagttccctacagaatctggatattagacctttcccagatgcataatttgcaaatattttctcccactatttactctgttgatagtttcttttgctgcaggatgctctttagtttaattaggtccccatttgtctatttttggttttgtttcaattgcttttggcatctttgtcatgaaatcttagccagggcctatgtccacaatggtatatctcaggttttcttccagggattttatatttttaggtttttcattcaaatttttaattcatcttgagttgatttttgtgtatggtgaaaggaaggagtccagtttcaatcttttgcctatgcctaaccagttatcccagcatcatttattgaatagggagtcctttccctattacttgtttttgctaattttgttaaagatcagacggttgtagctgtgccgctttatctctgggtcctttgttctgctctttttttcttcgagtctatttttgtaccagtatcatggtgttttggtttctacaaccttgtagtaaagtgtgaagtcaggtaataggatgcctccagctttgttctttttgcttaggattgctttggctattcgggctcattttggttccatatgagtttttaaatagttttgtataattctgtgaataatgtcattggtagtttgataggaatagcattgagtctgcaaattgctttgggcaatatgacaattttgacaatatttattcttcctatccttgagcatggcatgtttttctatttgtttgtgtcatctctgatttctttcagcaattattcagtaattcagtaattattattgtagagacctttcacctctgtggttagctgtattctgaggtattttactttttgtgtgtctattgtaaatggcattgcattcttgatttggtgttactggtgtaaagaaatgctactgatatttatacattgattttatatccttaaactttggtgaagtagtttatcagttctgggagctttggggcgaagactatggggtttgctaagtataaaatcatattgtttgcaaggagagatggtttgactacctcttttgctgtatggatgctttttatttctttctcttgcctgattgctctggctaggaatttcagtactatgttgaataggagtggtgggagtgggcatccttgtctcgttctggttcccaaggggaaggcttgcagctttggcccattcagtatgatgttggctgtgggtttgtcatagacagctcttactattttgaggtatgttccttcaatgcctagtttgttgagggcttttaacatgaagggaggtttaattttgtcaaaagacttttctgcatctattgagatgatcatgtggtttttgtctttagttctgtttatgtaatgaattacatttattgatttgtgtatgttgaaccaaacttgcatcccagggataaagcctactttatagtgctggatttgttttttgatgtgctgctgaattcagtttaccattattttattgagggattttgcatctatgttcatcagggatattggcctgaagtttcccctttttgttgtgcctccaccaggttttggtatcggaatgatgccagcttcatagaatgagctaaggaggtgtctctcctcctcaattttttggaatagttttagtagaattggtaccagctcttctttatacatctggtagaatctttctggcccaggaccctctctggttggtaggctttttattactgattcagtttcagaacttgttactgatctgttctggttttaatttcttctggattaaatcttgggaagttgtttccgagaaatttatccatttttctaggttttctagtttgtgtggtaatgtcccctttgtcatttctgactgtgtttatttggatcttttctcttctttcctttattagtttaggctagtggtctatcgatcttatttattcttgcaaaaaaaccaacttttggtatcgttgaccttttgtgtgttttattgtgtctcaatttctttcagtttggctttgatttttgttttcttttcttctgctagctttacggttagtttgctcttgtttttctagttcctctaggtgtgttaagttgttcatttgaggtctttctaactttttgatgtgggcacttagcactataaagtttcttcttcacactgcattagctgtttcccagagattctagtatgttgtatctctgtcttcattcgtttccaagaatttcttgatttctgccttaatttcattgtttacccaaagtcattcaggagtagattgtttaatttccatgtaattgtatagttttgagcaatcttctaagtattgatttctatttttattgtgctgtggtctgagagtgtggttggtatgattttgtgttttatgaatttgttgagcattgttttatggtcgagcgtgtggttggtttttcagtatgtgccacctgcagatgagaagaatgtaatgtatagtctgttgttggctggagtgttccgtagatgtctgttaggcccatttggtcaagtgtcgagttcaggtcttgaaaatctttgtcagttttctgccttgatgatctaatactgtcagtggagtgttgaagtcttccactatttttgtgaggttatctaacaaaataggtctctaagagcttgttttatgaatccagtgctccagtgttggatgcatgtgtatttaggatagtaaagtcttgtggaaattaaaccctttatcattaagtaatgcctatctttgtcttattttattgttattgatttaaaatctgtgttgtctaaaattagaaaaggaacccctgctcttttttctttccatttacttggtaggtttttctctatccctttactttaagcctatgggtctcattgcatgtgaggtggatcctctgaagacagcataaagttaggtcttgtttctttatccattttgccactctgtgtcttttaagtggaggatttagcctatttacattcaaggttaatattgatatgtgcgatttgatcctgctgttgtgttgttagctggttgattgtatagttgttttatagcatcaatggtctatgtacttaagtgtgtttttgtggtggccagtaacagtgtttcatttccatgtttcgcactcccttaagggcctcttgtaaggcaggtctggtggcaatgaattcccttagcatttgcttgtctacaaaggatcttatttctccttcactcatgaagcttagtctggctggatatgaaattcttcgttggaacttcttttctttaagaatgccaaatataggaccccaatctcttctggcttaagggtttctgctgaaaggcccactgtcaacctgatggggttccctttgcaggtgtcctgccccttttctctagctgcttttaatattttttctttcatattgatcttggagaatctgttgactatgtgatttggggatgattgacttgtatactatctcacaggaattctgtgcatttcctgaattctaatgttaacctttctagtgagttttgggaattttttaaaaatttatttaagttctcagatacatgtggagaacgtgcagatttgttacataggtacgcatgtgccatggtagtttgctgcacctatcaacccctcatctaagttttaggccccgcatgcattaggtatttctcctaatgctctctctcctcttccccgccgcccccgacaggtcccggtgtgtgatgctcccttccctctgtccatgtgttctcattgttcaactcccatttatgagtgagaacatgcagtgtttggttttctgttcctgtgctagtttgctgagaatgatggtttccagctgcatgcatgtacctgcaaaggacatgaactcattcttcttcatggctgcatgatagtccatggtgtgtatgtgccagattttctttatccagtctatcattgatgggcatttgggttggttccatgtctttgcaattgtaaatagtgctgcaataaacatacgtgtgcatgtgtctttatagtagaatgatttatattcctttgggtaaatatccagtaatgtgactgctgggtcaaatggtatttctcgttctagatcctcatggaattgccacactgtcttccacagtggttgaactaatttacactctcaccaacagtgcaaaaggtttcctatttctccacatcctctccagcatctgttgtttcctgaatttttaataatcaccattctaactggcatgagatggtatctcattgtggcatcaaatttgatggtatcaaaaagatttgcatcaaaacttgatgatagcaaaagatttgcatttctctaatgactagtgatgatgagtttttttcatatgtttgttagctgcataaatgtcttcttctttagagaactgtctgtacatatcctttgcttactttttgatgggattgtttgtttttttcttatacatttgtttaaattccttgtagattctgggtattggacctttgtcagatgggtagtttgcaaaaattttctcccattctgtaggttgcctgttcactctgatgatagtttctttcactgtgcagaaactctttagtttgattagatcccatttgtcaattttggcttttgtgcaattgcttttggtgttttagtcatgaagtctttgcccatgcctatgtcctgaatggtattgcctaggttttcttctagggtttttatggtttggggttttacatttaagtctttaatccatcttgagttaatttttgtataagttgtaagaatttgcatatgttgaaccagccttgcatcccagggatgaagctgacttgattgtggtggataagatttttgatgtgctgttggatttttttgccagtgttttattaaggattttctcattgatgttcatcagggatattggcctgaaattttgttttttttgttgtgtttctgacagcgtttggtatcaggatgatgctggcctcataaaataagttaggaggattccctcttttttgattgtttggaatagtttcagaaggaatggtactagctcctctttgtacctctggtagaattcggcagtgaatccatctcctgggctttttttggttggtaggctattaagtactgcttcaatttcagaacttgttattggtttattcagggattcgacttcttcctggtttagtcttgggagggtgtatgtgtccaggaatttatccatttcttctagattttctagtttatttgtgtagaagtgtttatagtattctctgatgatagtttgtatttttgtgggatcagtagtgatatcctctttatcattttttattgtgtctatttgacacaataaaatttatagataaatccatgaagatgagggaaaaacagcacaaaaaagctgaaaattccaaaaaccagaatgcctcttctcctccaaatgactgcaactcctctccaacaagggcacaaaactggatggagaatgacattgatgaattgacagaagtaggcttcagaaggtgggtaataacaaacacctctgagctaaaggagcatgttctaacccaatgcaaggaagctgagaaccttgacaaaaggctacaggaactgctaactagaatagccagtttagagaggaggataaatgacctgatggagccgaaaaacacagcacaagaacttcatgaagcatacacaaatatcaatagccaaattgatcaagcagaagaaaggattcagaaatcaaagatcaacttagtgaaatagtcatgaagacaagattagagaatgaagaatgaaaaggaatgaacaaagcctccaagaaatatgggacaatgtgaaaagaccgaatagactagtattgattgggggtccctgaaagtgatggggagaatggaaccacattggaaaacacacttcaggagaacttacccaacctagcaagacaggccaacatttaaattcaggaaatacagagaagtattgaggatactcctcaagaagtgcaaccccaagacacataatcatcaggttctccaaggttcaaactaaggaaaaaatgttaagggcagccagaaagaaaggtcaagttacctacaaagttaagcccatcagactaacagtggatctttctgcagaaaccctacaagccagaaaagagtgggggccaatattcaacactcttaaagaaaagaattttcaacccagcatttaatttaatagtcagccaaactaagcttcataagtgaaggagaaataaaatcctttacagacaagcaaatgctgagggattttgtcaccaccaggcctgccttacaagagctcctgaaggaagcactaaatatagaaaggaaaaactagtaccagccactgcaaaaacacaccaaatataaaaccaatgacactatgaagaaactgcatcaactaatgtgtgaaataaccagctagcatcataatgacaggatcaaatgcacacataacaatattaaccttaaatgtaaatgggctaaatgtcccaattaaaagacacagactggcaagctggataaagagtcaagacccatcggtgtgctgtattcaggagacccatttcacatgcaaagacacgcataggttcaaaataaagggatgggggaatatttaccaagcaaatggaaaggaaaaaaaaagcaggggttgcaatcctagtctctgataaaacagactttaaaccaaccaagataaaaaaagacaaagaagggcattacataatggtaaaaggatcaatgcaacaagaagagcttactatcctaaatatatgtgtgctcaatataggagcacccagattcataaaacaagttcctaaagacctataaagagacttagacccccaaatagtaatagtgggagactttaacaccccactgtcaatattagacagatcaatgagacagaaaattaacaaggatattcaggacttgaactcagatctggaccaagcagacctaatcaacatctacagaactctccaccccaaatcaacagagtataaattttctcagctgcacataacatgttttctaaaatcgactacataattggaagtaaaacactcctcagcaaatgcaaaagaatggaaatcataacaaacagtctctcataccacaatgcaatcaaattagaattcagaattaagaaactcactcaaaatggcacaactacatggaaattgaacaacctgctcctgaatgactactgggtaaataattaagttaagggagaagtaaagaagttctttgaaaccaatgggaacaaagagacaaagtaccagaatctctgggacacagctaaagcagtattaagagagaaatttataccactaaatgcccacaagagaaagctggaaagatctaaaactgacaccctaacatcacaattaaaagaactagagaggcaagagcaaacaaattcaaaagctagcaaaagacaagaaataactaagatcagagcagagctaaagaaatagagacatgaaaaacccttcaaaaaatcaattactccaggagctgattttttgaaaagattaacaaaatagatggaccactagctagactaataaagaagaaaagagagaaaaatcaagtagacacaataaaaaaatgatagtctttaatctttgaggctgatgacctttggatggggtttctgtgtgcagcttctttttgttgatgttgatgttgttgctttctgattgttagtttttctcttctaacaggcccctcttctgcaggtctgctgcagtttgctggaggtctactccagaccctgtttgcctgggtatcaccagtggaggctgcagaacagcaaagattgctgcctgctccttcctctggaagcttcgtcccagaggggcaccagcctgatgccagccggagctctcctgtatgtggtgtctgtcagcctctactgggaggtgtctcccagtcagaatacacaggggtcagggacccacttgaggaggcagtctgttctttagtagagcttgagcactgtgctgggagaatcctccttgtcaggatctgctgctctcatcagagccagcaggcaggaacgtttaagtccactgaagctgtgcccctgacagccgccccttcccccaggtgctctgtaccagggagatgggagctttatctatagccccctggctggggctgctgcctttctttcagagatgccctgcccagtgaggaggaatctagagaagcagtctggccacagctgctttgccatactgtggtgagttctgcccagtccaaacttcctggcctccttagcactgtcaggggaaaactgcctactcaaacctcagtaatggtggatgccccaccctctaccaagctcaatcatcccaggtcaacttcagactgctgtgctggcagcaagaatttcaagccagtggttcttagcttgctggggtccgtgggggtgggagctgctgagcaagacctcttggcttcctagcttcaggcccctttctggaggagtgaacggttctgtctctctggggttccaggcaccactggggtatggaaaacaacaacaacaaaaaaactcctgcagctagctctgtgtctgccctaacaaccatccagttttgtgcttgaaacccagggccctggtagtgtaggcacatgagggaatctcctgttctgtggattgcaaagaccgtgggaaaagcatagtacctgggctggatagcacagtccctcacagcttcccttggctggggagggaggtccccggctgcttgcacttcctgggggaggtgatgccccaccctgattctgctcaccctctgtgggctgcacccactgcctaaacagtctcaatgagatgaagtgggtacctcagctattcctattcagccatcttgccaaatctctctattatcttttataggaaaaaactttctgaagatgacatcagactcaagaagccaagtaggaaaagactgataaatctgaagatgtaaaaattaagatcctttactcagaaaaagaaaagtacaataaaaaaataaaaaataatttgagcaaaatatttgtgatacatgatgaacaatggttaagtgttcctagtaaacaaagaagtcatcaatctgaaacaatcaacagcagtaaaaaataggataagcatctcacggaaaaaagaaatactaagagcaaataaacacatgaaaacatgcacaacctcattctgaggaaatgaaaaacagaactaatggctgactacaagatttaaaaactggtgatacacaatgttgatgaggatgtgtaaaacagtcactcccatggatcattcattggaaaatatatcagagtaatcctgttggaggacaattttgcaatatctacacttagtaatttattgttctcaccaaagtacatggaggtgtattatggcttgagtatatggaggctgtagagccctcggagtatggagcccgatgccagggatcagataatagctcagcaacttctgaggtatgtgactgtggcaagctaagagccttacctgggaagtggagataagtatgtttttacctcaaaatgctggtgtgaggatctgatatatttatacactttagagaaatgcttggcactttggaacattaatctaaagaaaacatccaactgctcacgagtagagtgctaagaaggaagagcttggcctcatagttggatggctgccacgttccctgaaagtgaatgaagcaaacctctctctgactgggaggctgatgtctttacttcattaagtcctggggcatctcatgttccaggatagcatcactttccacgtttcttcctttttcatgcataagaattttagctagcggagagtaaggcaagtgaccatttcaaagacaggcattttactaaatggtggccactgaaagcttgattcctgtgctgttttctggtactttttgtcttaaagcaggatttctcaacactggcactattgacattttgggctggataattctttgttgagggggctgtgctgtccattgtaggatgtttagcagcattcctgatcttgatccactaaatgccccaagttctgacaaccaaaagtgttttcagatattgtcaaatgtcccttgggagtgaaatcacccttggttgaggatcactgggttttagaggtttggaatgaaaaaaaaaaatgattctcccgttggaagcagagactgtagttcagattatgaaccagttagatgatttcccttcttaagcatgaattcagactgcattgcctttgaaaattaatgtttggggtgtgtgtgtgtgtgtgtgtgtgtgtgtgtgtgtgtgtgtaaatattacggttaacagttatccactgggccctaggatgaataaggaagcatagcttcaccttattctcgacaaagtccttaagagggtccagattatgttccatcacactttcatgcttctgaattccacttaaaaaaaatagacttattggccaggtgcggtggctcacacctataatcccagcactttgggaggccaaggtgggcagatcacaaggtcaggagttcgagaccagcctggctaatatggtgaaaccccatctctactacaaatacaaaaattagctagtcggggcggtaatcccagctactcgggaggctgacgcaggagaatagcttgaacccaggaggcggaggttgcagtgagccgagattgcatcactgcactccagcctgggtgacagagcaagactccatctcaaaaaaaaaaattgacttattaattattttgaattagcaatatattcccatggttcaaaattgaagcaatataaatgagtgtagagtgaaaagtttctctctcatccctgtctccagatatctgggtcctgcccatgagaaagccacatgaacaggttctttgtttatccttccaaatatattttttgcatacacaaatatgtatatttgtatttataacatatttgtatatttcccttgtatatttgtatatttccctatctcatcccccccttttttaacaaaaacaggtcatacactgaacatacatgtgttcacccagactcttctatgtgcatatgttatctcttcaccactgcttcctttctaagagaactccgattttgtgcagttcttcagcaccataccctttcccctacctacccacaaacacacttcatggaatccatgtgactcaggggaagtggattccacccccagatctgggagtagctggtcaaagggtgacccattctctttgccagaggtcagttcagaaaggggcatgaaacccaactcaggccaatggacatgctgagaattttgctgggctttccagggaatttttttttttctcctgagagagctgtggaagaagtctcttttgcctcctctggacaccactatggggagaagtaaagatggggcagacacttgagggatggcccggaagaaactggagcgcctggattaagccaatcctgaagtctgcacgactgctgtcctttcaggcagaggaaagatgggtgatgtcactattagcagtctagggtgaggtgacaagtcagtgaagccatttcaaatccaagtctggtgtggcttgaaggcttttggtttacaacggtaaaatcagttctccgatgtgtagcattttacagtacaaacggtgctcccacattcaggtttcattgagagtaaatacgccaggcaaggcctctgtgcccactgcacagatgaggaaaaggagacatggaggggaaagtcttgtttaaggacacatatcctgtaagaggcagaactggaatccaaccccaagtttgtttctgttaccgaaacaccgggagtttggtctgggtcctgcggctcacagaacagaaagccaatgactgagacgatgagtattgccaaggacgaaggctttagtcgggttctgcagcagaggagatgggaactcagtctcaaatgcatctccctgactaactaaaactaggggtttatatggcagggaagcaatgtaaccgtgtgtaagaaaacgggaactagggaggggcaaggaagcaatcatggtgaatgaggggtcccacatcttattgtctgatgtgacggtctggtgaatttcagttctttggtactttttttgagatctgaagctcctttcctgaggaaggaactcggataaaacaaatataagtttcaagctttaagactagaagggtgaatttctatgtttatcaaaagaaaaaaaaactgtctatgggacaattgcattggttttatttaaacatcaaggttattttctcccaaaccaccagatactctggctggaggcattcatacccacagatgcatgccaagtgttgactctaccctcaggagcagcaggaccaggaagctctgggaggtcaggacacaggagagaggcaggaagagcccccgcaggacctactgtggtggccgagactgctacagccatatgacctccgactgtgcccagttccttttagcatgtcctcaagagtcagtgcctcggagcaaatgggctgacctctggactacactggggaagagagaaaaggaggtcctccctgttgcccaatggaagattcctcaagatggagattgagctgctcttctagggcaccccaagggcaaatgtccccatcgtctctaaggctccagccagctccaaacactctgggtggtaaatagactgaatcccctttagtgacctctctcactggcaatgttttttttctcttttttcttacaatagttgaattgatcaaaaaagaactcaatctcaaaggtgagagtagagttgatgatggggtcagggagctgacctcaatcgaaagttgagaagaaaagcatgtgtgaataacaacatccttggtttagaatttacttacaaagcttcagctgagcttatgaatgtgtcatttggatatttgctgggcttcgcacacaccccttcagtttctacacagggccaggcatatcacaatggtgtggttgcattttgtttttaatgttaggttcattttttatagatcctaaaacacaaaacgggattcgggagtgtgaatttacttgaaccaaactgaaaaaaggttttctcaacctctgcaaaatgaagctgcagaattcacaacagttttaattataacacactaaatagatacaataagtggctctttgctctgacgttgaaatctctacctatttttatctccaggcaaataacaggcggctggggaaagttactacattatgagtgggttattgaatctctgagcatcaacaacctctatgtcattacactgcattgtatgctaaagaaaatcattgtatccaggctgggcacagtggctcatgcctataatcgcaatattttgggagactgaggtgagcagatcacctgaggtcaggagttcaagaccagcctggccaacatggtgaaaccctgtctttactgaaaaaaaaaaaaaaaatacaaaaattagccaggcatggtggcgcacacctgtaatcccagctactccagaggctgagacaggagaatcgcttgaagccgggaggtggaggtggtagtgagctaagatcgtgccattgcagtccagcctgggcaacaagaatgaaactccatctaaaaaagaaagaaagaaaaaaaaaaaaaagcaaaacaaagaaaatcattgtattcaaaaataccaagatgagcaaaaatatttcaagatttcttagaagaaatttgcttcccataggcaaaggaaaactaagcacattaaaactactgctctaaagtaactttaaagcataattctccccttgagtttcaggaaagacctggaaagaggggcaagactttccctttctcaccttgccatgacctccagggccttgtagctcaggctttgaaaatgaaggtcaccataattactattacaacccagatctggaggaaggtggagaaccttgaacagagcccaccagaagtggctggctggggtcccagtgggctgcagggccagggaaggccctgcggttgctgccccacctgcctgctcttggcctcacttctttgcttctcctctggaagattctatcagaattgctttgtgctcaggaatgggcctatgatgaagagtctggctcactttttcctctgtactttgggattacatcatggaacccaatatcctgagcaagcataagaaagggaggggaaagtggatgaatctgatgtaagaagaaaacagacactcatattttcactcaattttcaaagcaatccacactacagatgaggaaactgagatttatggacgtgaagagacttgctgaaaaccacagtttggtggctgaagctggtttgaattttattctaacacaaatctttatttattttagacagggtctcactctattccttaggctggagtgcaatggcgtgatcatggctcattaaaacctcttcctccagggctcaagccatcttcccacctcagcctcctaagtagttggaaccacaggcatgcaccaccacccctggctaatttttgtatttcttgtacagatgaagttttaccatattgcccaggctggttgtgaactcctgagctcaagtgatccacctgccttggcctcccaaagtgctgggatgacaggtgtgagccactgcacctggcctcaaatatttttactgtattttattttttatttttgttggtacatagtaggtgtatatatatatggggtacatgagatattctgatacaggcatgcaatccataataatcacatcagggaacatgacatagccattatgtcaagcatttatcattgctttgtggtacaaaaattccaataatactactttagatatttttatatgtacaataaatgattgttaactatagtcaccctgttgtgctatcaaatatgcgatcttattaattctatctaaccatatttttgtagctattaaccatcttccctctcctccttcccagcctctggtaaccatcattctactatctccatgaatttaattgttttaatttttagctcccacaaatgagtgagagcaggtcaagtttgtctttctgtgcctggcttgtttcatttaacataatgacctccagtttcatccacagtgttgcaaatgacagaatctcactcttttttatggctgaatagagtactccactgtgtatgtgtacgacattttctttatccatttgtctgttgatggacacttaggttgcttccaaatcttggctattgtgaataacacttcaataaatgagaatgcagatatatcttcaatatactgatttcctttctttggggtatatactggcagtgggattgctggatcatatggtagttctgtttttagtcttttttgaggaacctccatacttttccccatagtggctgtattaatttacattcccaccaactaactcaaatctgtaaattataccatgaggatgtctaaatcaagggggcgatttttgcagtttctacaagaaaatcattgagtagttcacctaacttgattggcaaattcagtcaaatgactgtacaagttttatataaatgtagtctcatgttaaacatttaaatcatgtgttaccataaacaattattaaatcacttgaagatgtttgagaactaaataggatatttcttcatgatatatgctttaaaaagttttaattgcggtaaaatacacatgacaaaactttaccattttaacaattttaagtgtacagttctctagtgttaagtatatccacattaatgggtaaccagtctctaggacttatctcataaaactgaaactatacctattaaacaacaacccctcattttcccttctccccagcttctggcaaacacaattccaccttctgtttctatagctgactactctagagaggtcatatgaatgggatcattcggtatttgtccttttggattggcgtatttcacttagcataatgtccttaaggttcatccacgttgtagcacgtgtcagaattgtcctcctttttaaggctgaataatattccgttgtatgcatagaccacattttgcttagccattcttctgtcgatagacaggtgagttgttgccatcttttggcgattgtgaacattgctgctatgaacatgattgtacaaatatctctttgcaatcttttcaattatttggttatatacccagaagtggagttgctgtatcatatggtaattctgtatttaattttttaagaagctgccatagcgttgttcaaaactgctgcaccattttacattgccaacaacagggcacaaaaaattgaatttctctgcattctctacaacacttgctattttctgggttttttttgcaagcagttattctaatgggtatgaggtggtatctcacggtggttttaatttgcatttctttattgatcagtgatgttgagcatctttgactatgcttgttgtacacttacatacattatttggatagctgtctgttcaagtccattgcccatttctaagctgggttatctttttgttgttgttgagttgtaggaggtcattatatattccggatactaaccctttgtcagatgtatgatttgcaaatattatctcccattccataggttgccttttcattctgttgactgtttcattctgttgacttttgtcttttgacagacaaaagtttttaattttgatataatttatctatttttacttttgttgcctgtgcttttggtgtcatagccaagaaatcattgccaaactcagtatcaagaagattttcctctatgttttcttctcaggcttatatagttttggctcttacatttgggtctttgatcgattttgtgttaatttttgtatatagtataaggaaagcatccaattcattattttttgcatgtggctatccagttttcctagcatcatttgtggaaaagactgttctccccctttgaatgatcttggcactcttgttgaaaatcatttaaccatatatgggagggagggtttatttctgggctctctattcaattccactgattcatatgtgtgtctttatgccataaaggtactatggctttgtaataaatttggaaatcaagaaatatgagacctccaactttgttattctttttcaagactgttttggctattcaagatcctttgaaataccatacgaattttaggatgaattttttttttaatttctgtgaaacatccatgagattttgacaaggattgcacaaaatgtgtagattgctctggttagtatggacttcttaactatattcagtctttaaatataagaacatgtactgtatttccatttatttgtatcttctttaatttctttcagaaacactttgtagttttcagtgtacaagtcttttgcctcttggttaattctgagtattttattctttttgattctattagaaatggaattgttttcttagtttcctcttctgactgttcattttagtgtatgataatgcaactgatttttatatgttgattttatattctgtatattctgcatctttgctgaatttgtttattagttctaatagtttgtggaatctttaggggtttctacatataagatcatgtctgtgaacagacataattttacttcttcctttctggtttggatgcctttatgattttttttttttttttttttgagacagggtcccactctgtcacctggctagagtgcaacggctcaaacacggcccacttcagctttgaacttctgggcttaagtcgtcctcccacctcagcctcccaagtagctgggactacaggcacttgccaccatgtccagttaatttttttaaaaattttttatagagatgggggtcttgctatgttgcccaggctggtcttgaactcctgggctcaagcaatctccctgccttggcctcctaaagtgttgggattacaggctgagccaccgtacctggcctatgatgcatttttattgaaagaaaaacagacaccattattttgcattacaaaatataaaacagaagaaatttcacagccaatcaaacgggagtttagaattggatcctcctgcactttcccctacacttctttcaaagctgccttcctctgcaaggcttctgcctcacctctgatcacccacaacctgagctctgagcacccacacctcacctctgagcactatgacccatctggatggagctactgcacggtcagtgtgggaacatctctgaggaagatgcattgtcttctgtggagttacctaaaaacactggggcatgttctcctaactgccttcacttagtctaaagatgaagcaattcaacaaaagtacatgtaaacctcaaaactggacttggagttttaaagatcaatggactctattgtctattgtctggatggtttgggggtttcctagctcatttttttttcttttatggtatagacacctgaaggctctttgctcagtactcctcactgtgtggctgccttccactgcagacgctgtgctgaaggttgggttctggccactctgtttacacccttttggacttgaggcttgcctgttggttccctgaaacgtggactctggatctgggtgctaaccaattccctttctttccaggccggggtcctgagacctcactgtaatgagagactgtgacctcttttctcatgtctcaggcaggctatgatgccttttctagttaaggaccgtgttgaaccaggtgaaatcgccatttttgttggctgtttttgtcctgcaaaactgacaatttcatgtccttaaatttaatacctttggagtagaaactacctattgttgtccaatagaggaaacaaagtttcttcctgaaagcatttgtctgaacaaaacagtatttgttttatctgcatttccccttcattcacttgtatcattcagggacttgcacatctcagtcacatgtgtgacgcactcacatgtatggctccaatcccatcttcacggcacagagaactaaattctctcccaccttcccgtggagagccctctgtcctcatcatcactggttcctttcttctggatccttccacctcaattatgtttctctgagggtgcaatgacaagaataaaatgaaattttgttcttgttcagttaagtaataaattgtcatttcttccattttctctttgactaaagatgtattagctttattattattttttaaatagagacaatgtctcaatatgttgcccaggctggccttgaactcctgagcttcagtgatcctctcgcctcggcctcccaaagtgctaggtttacaggtgtgagccaccacgcccggtaaaagatgtattagctttaaacaaagttaaaatttcttctcagttgtgtaaaaatcacagaagaatgcagcatgtcctctaagtgtcagcctgtgtggggctgaaaaaacagtggagtcctttgttcactgtcttaggagtctttgggatttctgttgatccacagacttgcataaagagtttgtcatgatgacagggcctctgcacatgatgtgaggatgtggaccccctttcctccccacagccagtgccggcccgactcataaaagctcaaagatccagtgagaccagcctcagtcagatcagcccatccatgagtgggggttgttgttatatatatttatgctccatctcactgccaaagagggatttggggtggattatagaaatgcatacaacaggggccgggcgcggtggctcatgcctgtaatcccagcactttgggagagccaggtgggtggatcacaaggttaggagatcaacaccatcctggctaacatggtgaaaccccatctctactaaaaatacaaaaactagctgggtgtggtggcgcgtgcctgtaatcccagctactgggaaggctgaggcaggagaattgcttgaacctgggaggtggaagttgcagtgagccgagatcacgccacagcactccagcctagtgacagagcaagactctgtctcaaaaaaaataaataaataaatagataaaaataaagaaagaaatacatacgacaaaataaaaataaaataagcaaagaagtggaggaagaagaggagaattaaggtaagaaattaagatgaagtcatttgtttctttttgcctattcatattttgagttttctcttttcttattgatttgtaggagttacttgtatattctagatctgtgctaatacgttagccaccagtcctatgtggctattgaaattaattaggctgggagtggtggctcacacctgtaatcccagcactttgggaggccaaggtaggtggatcacttgagctcaggagttcacgaccagcgtgggagacatggcaagaccccatctctactaaaaatacaaaaattagccaggtgtggtggcacacctgtaattccagctacttaggaggctgaggtgggagaatcacctgagcccaggaggtaaaggctgcagtgagctgtaatcacaccactgcactccagcctgtgtgacagagaccctatctaaaacaataataataattattattaaagttaaatagaattaaaaatttagctcctcagtcaccctcctcccatttcaagtgctcagtaaccacaactatccagtggccagcatagacctacaccatttccatcatcacagccaattctcttggatagtgttggtctgtatattaatcccttgtcaattttattcatttcaaatatcttcttcgagaaaattgttctctgctaactttgattaagatgtcttcactgaacagaaatgtttaggcttttttgagacagggtcttgctctgttgcccaggctgtagtgcagtggtacaaccatagcttactgtaaccttgaattcctgggctcaagcaatcctcttgcttcagcctcccaagtagctagaagtataggcatgcaccacaatgcctggtcaatttaaaaattttgtagagatggtgtttcactgtgttgccagtcttcctacctcagctcacgagttctcacgagatctgatggtttaaaagtgtgtggcacttccccctttgctgtctctcctgctccaccatggtaacacgtgcctgcttccccttcgttttccaccatgattgtaaatttcctgaggcctctgaaccatgcttcctgtacagcctgtaggactatgagtcaattaaatctcttttcttcataaattacctagcctcagttagttctttatagcagtgtgacaatggactaatacaccttaaatgtttagtttttatatggttgtgttcatcatattttgccctgtaatatgtgcatttggagtcttgtttaagaaatctcctccctgaggtctcagagatatttcccctcaccttttggtatctgggttgtggatttccttttcatatgtgggtagtgaatccaataggactttgcctttgctacacagcgtgaggcagggatccaaccctatgctctccatctagtgaggggttttccccatcattgctgttaacagattcatctacacatccatcgtctccccacaggtcttgtgtgccactgctttcctgtgcccatccaaggtccatgagggcaattttgggctcttgcaggctgcatccatctctttatgtttcctctgccaggaccaaattgtcttatcactctgactttgtgcaacgacttcacgcagggagagtgctctattctccctcactcttgtgttgccaaatgttcatagctcttctaggaccttgctcatctagattcactttaaaatctatctttttgagtttctcaaaatgtgtatagaaaatcagcagtcactcactaatgaaatactctcttttaagtgaaaaataatatatgtgctgtgaagctccgtgatctactttaaacctaggaatgaagttccaagtgttaacggtgatttaaaatccattccattgagtttcggtttgtctggggcatcagtaaatgctcatttccaaaagtgctttgcctttgaaggctactaatgcatgcagtgtgttgccatggcaacggttacttttagttagtactttttatagattaaagtgctacaccctggagtctattcatataaatgcataaatcttaagacagtatggtacttcatttaatgtagatatttaatggaacagagtcagacttaactgaccagaaatggaaaattttcaacacttatatttgatacggacatgcagtgttaccaaaaatataacattttcattactttgttttacaaaatataaattaaccttgctatccatttaacttggtcaatatttaataaattgtggttgaaatgtatgtgtctgtcagaaatttgcacatatcactttgttttctaccctagagtaaaatccccaattattgtagggattcagaagacttggggaacaaggtgtttcccaggcaaatggaggggaagtcagtggagccctgggtgggaaagagtatatgggcctgggcttggattttggcagtgatttttattagctgtgtggccttgaacttcagtttccccagtcataaaatggagatcatcacatctactttgcacagcagttgtgaagattaattgtatcttcagtgagtgatatctatgatttaaaaatgactagataatgatttcaagtcaatatttaagacagaaagagagggtggaaatatcaagtacaaaagtgctgcggaaagtcaatagtcaacgatcctggtggatgggaggtctcagagacaggggaattgggcaccgcttccacgcacacgagaggagaaggacacagaggcagagatcagcagagcagtgggcatggaagagggaccatggggttggctgggtgaggcttggtcaggaaagacaaaggggtggcggtaggagcccccaagggtgggttgagagctctgtgccttacacaaagagtgaccctgaactgtgccttatacagaggtgacaagaagtgttttagaagggagatctggtaaacaaaggggcacatggagacaagcatgagggctggatgtgcccctggcctgaggacagcaaggcctgaacccaggaggggtgtggagagtgagatgaagatgagaatctcacagtcacaaagaagacgatatagggattagctctactggaaacaggagtggaaagagccaaaatggtctccgaagctttgatctcttccgatgaacaattgtttaaagcaacaataatgacaataacaaaacagtcatcccttggcatctggggggtattggttccaggactcagtttcttgccacgtgaatctctccagtttgctttgtcagagcaagcacgtgaaaagaatctgaacaagatggaagtcactgtcttttataatctgatttccaaagtggcatccatcacccttgctgtgtttattcattaaaaccaagtcacgagtccagcccatatacacaaggagaaggaactacacatgggcatgaagacaaggagacaggggtcgctgggagccatgctggaagctgcctaccatactaggggactggagaagtggaaatactcttgaccaaaataggacaggaggatggaaataatttaggacccagatgatgaattcagttgtaatcatggtgtatgagctaatggcatggcatcagaaccagaatccacagccatttgagccatgggagagctctagaaagaaggcaagccacggacatggattaggaagcatcctgttttgaccatgttcaggacatgtattcttagcttcattgcacatgtctgcaaaacaaatgagtctgctacagggctgtcagacagggctgtggtttcatctgaaggttcaacaagaaaaggatttacttccaacctcactcacatggttgttggcaggattcagttctttgcaagatgttaggatgaggttcttgattctttacgaacagtggcctcgtgagaagtcttgagttggataatccaactcaactgtggctggatacctgacccacagaaactatgaaataataaacgtgcttttcaagccactaagttttggtgtgatttgttatgccgcaacagataattaatacacccagtttccaactctttgatcctatcagttaccataaggcacctagaagttttcccacccttccaagtcctcaaaatttatgcttttctggaatttgagagaaggtaatggtccacttagggaggaagctattgtttggtacatgcctccaggcaccctttctcctgctggacaactgcttctccagtctaatcctgctctagctttttgctgggaaataacactccactcactctttcaccttggacttcctgtgctcccaaacttggcttgggtccagactgtagtcttctgtgtccctgacctggatttctattccagaacctaaatgctgcatgtctaagctgatctggtcagcaaattttttatcgctcttgcatttgatagttggattgtggcattcctgaccttgcattgcacccgcacaaatcaaaacagccttggcagccctgtaagataatttgattccattccctagcaatacagggccaggtccaaagttaccaaatcagggccctgactgctcctggcacccagccctggcccatggcttcctgactgatcttcctgacctttgcctttccagctccaccacctcaaggaggcatgaacgatctttcagaggcatgtgccaagttctgagcttggtcttcccatccttccagggggtgtgggatgggacttggagttatgccagctcttcagaaggggatgtgcatgcaccagctccaagtagagttggcaataggcaccgctactcagtggcacagtggtgactcatgaaagcagtggggagtaggacatggtggcagagaatcagttcccaggccctgctcagcaattatgaaaaaggctgttaacttggcaccaggaaaatagagtaaaggtcgcttttcctgacttccaaggacttccacagactgaggccaacctgctcgcccaatgtgttctctactgtgagccctctgctctcactgtcactttctagtctggaagtcaaaaaattcttctccttcttcttctctttcttcttctcctccttctcctcctccttctccttctccttcttctttctcttcttcctcttcctctcctttccttctcattctcattcttcttttttttttttttgagacagggtctgactccatcacccagggtggagtgcagtggtgtggtgtcagctcactgcaacctctacctcccaggttcaagcaattcttgtgcctcagcctcccaagtagctggaattatagccgtttgccaccatgcctggctaattttttatttttagtagagatggggtttcaccatgttggccaggctggtctcaaactcctggcctcaagtgatccacccacctcagcctcccaagtggcctgctaggattacaggccactgtgcccagccaaaaatatttattattaataaatggatgagccttgtagaaattatgtggaacaaaagaatctggacacagaagagtaaagactgtatgctccacttagatgactttttagaataggcaaaattcatctaaagtggataaaataaaggtcatacttgttgccctggttagttacctggaaagggacatgagggagctttctggagtgatggaaatgctctatatcgtgataggggtgtgagttacagaggtgtgtgtttgttaaaataaggccgggtgcggtggctcacacctataatcccagcactttgggaggccaaggtgggtggattacttgaggtcaggagtttgagaccagcctggccaatatggtgaaactccatctctactaaaaatacaaaaattagccgggcttggtggtgcatgactgtaatcctagccacttgggaggctgaggcaggagagtcgcttgaacctgggaagtggagtttgcagtgagctgagatggtgccactgcactctagcctgggtgtcgcagggagactccatctcaaaaataaataaattaataaaaaatcggctgggcacggtggctcatgcctgtaatcccagcactttgggaggccaaggtgggtgaatcacgaggtcaggagatggagaccatcctggctaacatggtgaaaccccgtctctactaaaaatacaaaaaaaattagctgggtgaggtggcgcgtgcctgtagtcccagctactcgggaggctgaggcaggaaaatggcgtgaacccgggaggctgagcttgcagtgagcccagtatatatatatatatatatatatatatatatatatatatatatacacttaatttttgttactttgtcattatggcattttgatatatgtcaattttaccttcaataaaactgtaaaaatattaatggttgagtaagggcaggggagtggggtgagctacagaagaccctggaatggcagaatgctgaatgtcgaagctgggtatttgccgcataggggtttattacgctattctgtttactttgtacatgtttgaaaatttccacaataaagagtcaaaaaaaattttatggtgcacatattctgcaccatgtcctatgctaaagggcatgcacaggcagacaaggctgcagaatacagaaagaacaaaactgaagatggaatttatttttttacatttatttttagagatggggtcttgctatgttgctcaagctggtcttgaactcttgggctcaagcgaccctcccacctcagccacccaagttactgggattacagcattattcaacctgaagattggaagattttttttttttttttttttttttgagatggagtcttgctctgtcgcccaggctggaatgcagtggcacaatctcggctcactacaagctccgccttctgggttcatgccattctcctgcctcagcctcctgagtagctgggactataggcgcccgccaccgcgcccagctagttttttgtatttttagtagtgacgtggttttcaccgtgttagccaggatggtctcgatttcctgacctcatgatccgcctgcctcggcctcccaaagtgctgagatttcatgcgtgagccaccgcgcccagccaagatggattttttacttacaaacataaagtgcattgaaaagggggaaaggtggactaaacggaaagtcatgccagccccaacatgtggctccaagaagagaaccctgcaccagaagggaagtcatccaactgcttctttcatggctcacaacatgtcacgagaccatcgccagcagaactaaacactgggcgaagcgatgtggttgatttacattctggctcaggctctattcttgaaccatcagccagaaatgtgaccaacactaaggcaatgatttattagattcacctgggagcacccagataaactaaatcagaatcccttgtggcagggctcggcatcagtgtattttgatgttccagatgcaattccaatacacagccagggcaagaaccagcgatctgtgagctgctcaagtcacattgcttccaggaagtctctcttcatgctcgctcacaaagagccttcttttatccaacaccctaaacattgctgactgacagtctgctatctaggtatatggggccttgtactgttttgaacaattcatgcttgtcttctttaatgaggatgtctgcacatgtgttcttgagggtaagaattaccttttacatttttgcattccccacaacactttgcactatgatgttcaataaacattcaattttcaaatttttatttagacaatgaaatatttccttattataaattggctgcattctttaattctcagagtactgaactaaatgattaatcattactggaacatgttctttcataatgaaaatactaaaagatttataaacttaaacataacttttcagttatttaatttggggattttccaagtcaacgtatttcctattgaacagatttttgtctatattatttttgctctctgacctgatgtgaatctttcagacgctgggttggttgaaggggaaacagtttttctaatgcagctactgtgagctgagctgacttaggccttggagaattaccattcttaccaattgaccacaaaagcagataggaacagtatctacgtattacaaaccagaatcaaaatgaccttcacacatgattagtgtggaattcttttcagtggaaaatggcaacatttagcagcacagggtgcagttggcttcaaatactctctgaagtgaaaccattgtgttttcctgggtgactgagcccagggctaatgcccatcggagaagctgctgggaactgcaatgctttgattaaacagagtattaaccacaggctggctgtttgaaccatatcgataaagacaaaattcaccctatctaccaaaacattctttcatgtaagacttaacaatgaaaataaacaaaagctttagctgtcaactatatataccatgaagaatggcaaaactggtttttgttaatgctattttgtcttttaatcgctcagttggctatgaaaactcttgtttacattcctttacatattgttgagcttcaaggtaattgtgaaagaaaacggggaattaatatcacttcccagaagccacattttatttaacctcaaaaactttatgtaaaagattttgttatgaatcaaaggctggcagttcttcccactggggtgatttaggaaattaaagttaggagtagatggtgctaatgggaatggtaagactagtaagagtgatttattccttgcagaaaaaaatcactgtcgatgctcagttgaaataatgtggaatttaataattacctcatagtaccatctagtggtgctatatttctacccttgtgttaagtgaggactgtagttttctgtagcccgaagccagcaaagccaggtcagtggtctattacaaacactttaactgtaagctgttagaagggtgagttcacagagaaaatgtaaacaaagtattagtagctcatatgacaatattaaattttaaaatgttcccagaactcagacatgttcaatatggattctcaataaattgtgtttttaaatattgaacaaatactgtgattacttttttcacaataattacagcaatttgggtagttttgggtactaccgtaagattctaagcactattttatatttttcctattctgaacaattgtggtttgtgcatttcttccagtaaatgcggtctggaaaataaatacctttcacatggtacgtgttattggaaaacaattgtctttagtgagatttatggaatgtggagaaaaaaaattttttaaggaactattgctcctatgaaagcttgagagtgttacgggcaatgtaggcacttttagatcaaattcaaacataaaaaggcacttacacacattttaagaatacttgtaattataagcacattttcagatttacaggactaagtctagtttaagcataaaccagattcaatgtgaatctctatatatttttcttgcttcaagtattattttacagaagggacactgatttgtttggcctgtgtaaacctaagaatctaggtttgatctagtagatatcatatctagtagatgtcatatctcaacaataaagggtctgaagaataaatattaatatttaggcctaagttattttttaaaattcataatgtgtctgtcctgttttgcttactgaattaacaaatctttaaagaaaaccttcatatattatagcgatatatttataccacagtgatatgatttattgaatgtgagagaaattctcacactcaattttaattttcttaaaaagaaaagatgggaaaatgttacagtatttaaatagtgaatgctgggcggcgacggcgacatggagagcggggcctacggcgtggccgaggcgggcggctccttcgacctgcggcccttcctgacgcagccgcaggtggtggcgcgcgccctgtgcttggtgagcccggggagggcgggccgggggcaccccgaggaccccccccgccgccaggcccggcgggacccctaacccacgagcgtgacaggtggaggcggccgcgtccgggccctggcggcgagcggggcgggcatttagcgtcccgggccccgccttcccgccctccacagtcttcgccttgatcgtgttctcctgcatctatggcgagggctacagcaacacccataagtctaagcagatgtactgcgtgttcaaccacaacgaggatgcctgccgctatggcagtgccatcggggtgctggccttcctggcctcggccttcttggtggtcgacgcgtatttcccccagatcagcaacgccactgaccgcaagtacctcgtcattggtgacctgctcttttcagctctctggaccttcctgtggtttgttggtttctgcttcctcaccaaccagtgggcggtcaccgacccggaggacgtgctggtgggggccgactctgcgagggcagccatcaccttcagcttcttttccatcttctcctggggtgtgctggcctccctgacctaccagcgctacaaggctggcgtggacgacttcatccagaactacgtcgaccccagtccggaccccaacactgcctacgcctcctacccaggtgcatctgtggacaactaccaacagccacccttcacccagaatgcggagaccaccgagggctaccagccgccccctgtgtactgagtggcggttagggtgggaagggggacagagagggccctcccctctgccctggactttcccatgagcctcctggaactgccaaaccccctctttcacctgttccatcctgtgcagctgacacacagctaaggagccttacagcccggcgggggctggccgagccacaccccacgtgcctgtgcccagagggcttcagtcagccgctcactcctccagggcacttttaggaaagggtttttagctagtgtttttccttgcttttaatgaccccatccccgcctggagtggctagaagccagcaggcacccatgtgctactgacaagtgcctcagcttccccccggcccgggtccggccgtgggagccgctgttacctgcgttctctgccaaagactcgtgggggccgtcacacctaccctgtgcagcggagccggaccaggctcttgtgtcctcactcaggtttgcttcccctgtgtccactgctgtatgatctgggggccaccaccctgtgccggtggcctctgggctgcctcccacggtgtgaaggcggggctggtgctcatggcacttccttcttgctcccacccctggcagcagggaatggctttgcctgacaacacccagctttatgtaaatattctgcagttgttacttaggaagcctggggagggcagaggtgtcccatggctcccaaactctgtctgtgccgagtgtattataaagtcgtaggggagatgcccggccctgggatgctgtttggagatggaataaatgttttctcattcaaaaaaaaaaaaaaattagtgaatgcttttgtaaaatagcagccaaaccaagaccaaaatgtttctttagtgtactttcatgcttaatgctgacagatagcattgtttgaactcacaatcaattttttatatataccttttcattacaaaacaaataatattcatggcagaaaatgaagaaaaccaaaaaacaaaaataagataagaaatttcacctgaaatcccaacacttaaaatgccatttaaaatattttcccaagtagccccattttttaaaatgagcaaattagcttcccacttaacttctttcacttaatactaaactgtgaataactttcacagtgtgattttcatttctgaaattgcccagcttctaaggcccactgcatgcaaggaatttagctaaaacacatagtccttgaggagatgacagtctagaagcagagacaatatacactgtagttaatgacagttaaaatgtccttaacaagattaaaaactcgtgggaaaagaatgaaatcctgtcattcacagcaacatggatgagcctggaggacataaggctaagtgaaataaaccaggcacagaaaggcagataccacatgatctctctcatgtagcgtcaaaaaggttgatcacatagaagtagagagcaaaacagtgattaccagagcctggggaggggaaacagggatgggaagaggttggtcaatgggcacaaagttacagttagacaggaagaataaatgctggtgttcccgtccatagtacgatgactacagctaataacaatgtagagtatatttcaagtgagctaataaagaggatcctgaaagttatcaccagaaataaatgtaaattttgtggtgaatgatatgctaactacccagatttggtcattatacaatgtatacatgtagtgaaacatcacactgtaccccataaatgtgtacaattattatatgtcaaatataaacactttttttttttgagacggagtcttgctctgttgcccaggctggagtgcagtggcgcaatctccgctcactgcaagctccgcctcctgggttcacgccattctcctgcctcagcctcctgagtagctgggactacaggcgcccaccaccacgcccagctaatttttttttgtattttcagtagacacggggtttcaccgtgttagccaggatggtctctatctcctgacctcgtgatctgcctgccttggcctcccaaagtgctgggattacagacatgagccacagtgcccgtcctaaacatgttttttaaaagaacacacaaaaaagaataaaattccctgagaactagctttatttcttccatttctgtggtctcctggtctcagactggaattgttttgttattaagtaaaaaccagccctcaactggccaaagcacaaaggtaagtcactgactcatgtaactaaactccctaggaacagacccagcttcagacagagctggatacaggctgctcatctgcctaatttggtctgggtgctgctccttggctcttggttagcttcctttctgttggttcctttctcctttgcagaggcaaaaacagcacacgcttttagttggagtcttgctgcctcctgggatgttcttcaccaccatcctggggattcactttgactcaatcttgggttgggttctttgtctccttatcccatatattcctcttctttgatttgctctcttattttggtggaggctccactctactagtttcctgagagaagctgccttggaatgaaatgttttgagactttgtatgaccaaaatgtttctttagtttacccttgtggttaatagttttgctggtgtgaaagagactgccagtgttacatatatcttgtcctcctttctttcctgggtacatgacgggattacctttgcaaaggactaacagtatctttgcagttaggtagtcttgtgatgagtgtagccaataaaatgaaaaaagaagtgtgtgacctccaggcccagggaattaatagcttgggtgctactccaggctctcttcccctgctgcaggagctttggaggccccttgtttcagagcaacatctcaaggtgaaaagaacctggatacctgaatcacaggatggaggggatcacctgccaacttgcctttgcatgaacaagaaggaagcgttgttaggctggcctactgagatgctagggtttctttctttccttcattttaaaattgcaacgttatctcagtggaatagattattcttaggtgcatcgttcatataaagaaaaattcatgtaatcccagcactttgggaggccgaggcaggcggatcacgaggtcaggagatcgagaccatctggctaacacagtgaaatcccatctctactaaaaatacaaaaaattagccgggcatggtggctggcgcctgtagtcccagctgctcaggaggctgaggcaggagaatggcgtgaacccgggaggcggagcttgcagcgagctgagattgtgccactgcactccagcctgggcgacagagcgagactctgtctcaaaaaaaaaaaaaaaaaaaaaaaaattcaaaacactcctgagggatacaaagaaaagtcaaagaggtggaaatctgtaatcttggaaaggaagattcaccaccaaaacagtaaccatagtggagagtgtgttaataataaagttgatgcaattccaataaatatcccaacaggattttcttttttgagggagagcgaaacaatctgattctaaagttaatgtggaaagaaaaactctaaggaaatataaagttaaattcggatctcacacctgactccaggataaattctagttgattaaaaaattaaatgtaaaaaaaagataccataaaatattagaataaacaatcatacttgttttgaatcaaatgctggggagggcatttctaggtacaacataaaactggggagccatcacagaagagtttgatagattcaattattctaaaatcaaaaagaaaaaatccacatgtaaaaaccctccccaggcaaagtcacaagacaaacagtaaactggcgagcatttgcaactcaaatcacatataaagaataatttcattgctgtatgttttagtccatttgtgctgccataacctgagatgggtaatttgcaataaatagaaatgtattaacccacagttctggaggctgggaattcctgagaggtcagtgtctgacaaggaccttcttgctgcatcatcccatggtggaaggcagagggcaagagagagggcaaggggctgaactcactcttttataataacatcaatcccacccatgagggcagagcccccatggcttaattacctcttaaaggtcccatctcttaataatgttacaatggcaatttaatttcaagggtatgtgccaccacacccagcaaattttttttggtattttttgcagagatggggttttgccatgtttcccaggctggtctcaaactcctgggctcaagcgatccacctgcctgggcctcccaaactgctagtattacagatgtgagccactgcacctggccttgtctcattttaatgtctctctggacctgataattaaaaagacttgcatttctcagataaaagtgattttctttttctcaaaaggatatgaacagagagaaaagaaaatgcatatggatcttcaaagatgaaatgatgttcagtctcactcataataagtaatttcacacaaactacaatgggatataatttttcacccactagaccaacaaatacttcaaaatttgataacacattgtattactgaggatacagggaaacaaggacaatcacaaattacttgtgggagtctaaattgtttgtaacccttacagggcacaatttgacaacatctaggaaaattttgcatgcaaataccctttgaaccagcaattctcttttaggaattcatttatatttatagatatgtgacatgatgtgtgcacaagtctcttcatggtgacactgtaacagcaaagacgagataagctaaacagtagtcaacaggggattgcttaaataaataacagtacagccacacaaagaaatattctgtagctctaaaaatgaataaagaagctctttatgaacagacatggattcatctccactgcatattgctcagtgaaaacagtgagttgtagagtatgtctacattatactactatttgtggttttcttaaatgaggaaaatatgtatagcttttgcatgaaaaaaatatctctagaatgaagtatgtacaaaaatctgttaatcatgactgttcatgggaaggggactggataggagagaaggtggaagggagaattttcaccattgatactttgaacccattgattttgggaccaagtgaatacactgcttatctaaaaattagaaatagttaaaatttaaaaagaaaatgtgcagtggctcacgcccgtaatcccagcactttgggaggccaaggcaggcagaacatctgaggtcaggagtttgagactagcctggccaacatggtgaaaccccgtctctactaaaaatgcaaaaattagccaggcatggtggtgggcgcctgtaatcccagctactcgggaggctgatgtaggagaattgcttgaaccccggaggtggagcttgcagtgagctgagatcgcgccactgcactccagcctgggcaacagagtaagtctccgtctcaaaaaaaaaaaaaaaaaaagaaaaaaagaaaaaaaatgtgaagagaacagtttgggcacttgaaacctacctttcagcatcattggtgatgtaacccttggggtggtcagtttataggccacacgtgtgagagtgccactctgctgtctagtctatcttagcaattttagggacactattgctgtgaggagtgacactgtccctgtccaccatatgagaagaatgtgggttttggtttccatttgctaagatgacattcagctgatatagtccagaggaaagaaaggaaaacagagcaactcccttttgatatcttagttgatgacagccataattagtgagtaagaaaaaatgaaaagatttccagtcgaagatgactgactaaacatgagaatttacccttcctccctgtttaaatcctatttcagggaccaaagggatataaaatggagagtaattctgtagcagcattggaaatttagaaaaggtgctttttgtgttttaaaaatagatttagggggtacaagtgaagttgtgttacatggatatattgcatagtggtgaagtcggggacttttattgcaactgtcacacaaatagtgtacatgacactcattaggtaatttctcatccctgagccccttctcaccctcccaccttttggagtctccaatgtctattgttttattctcaatgtccatgtgtacacattgtttagctccacttataagtgagaacatacactatttgactttctgtttctgagttatttcactgaagataatggcctccagttccatccatgttgctacaaaagacatggtttcattttttttaatggctgagcagtagtccatgatgtacatatatacaccacattttctttattcagtcatccattgatggacacttacgtttattccatgactttgctattgtgaataatgctgcaatgaacatacaagtgcaggtatctttttcatataatgatttcttttcctttgggcagatatccacgagtgagattcctatatcaaatggtagtactacttttatttctttgagaaatctccataccgttttccatagaaattgtactaatttatatttctaccaacagtctataagtgtttccttttctccacatccttgccaacatctgttgtttttttgacttttcatagccattctgactggtgtaagatttttgtttgtttttttgagatggagtcttgctctgttgcccgtgctggagtgcagtggtgtgatctcagctcactgcaagttctgcctcccgggttcactccattctcccacctcagcctcccgagtagctgggactacaggcgcccaccaccacgcccggctaatttctcttttctttttgtatttttagtagagacggggtttcaccgtgttagccaggatggtctcgatcttcttgtgatctgcctgcctcagcctcccaaagtcctgggattacaggtgtgagccaccgcgcccggccaagattttatctctttgtggttttagtttgcatttctctgatgattagtaatgttgaacattttttcatatgttcgttggtcacttgtatatatccttttgaaaaatgtttattcatgtcctttgcccactttttaatggggttatttttttcttgtacagttgtttgagttccttgtacattctgaatattagtcctttgttggatgcagagtctgcaaatattttctccctagacttcataaattacttcagtaaagtttcaggatacaaaatcaatggtacaaaaatcagtagcatttctatacacctataacaaccaagctgagaaccaaaccaagaactcaatcccatttacaatagctatgaaaaaaatacctaggaaaatatttaaccaaggaagtgaaagatctctacaaggagaactacaaaacactgatgaaagaaattgtagatgacacaaacaaatggaaaaatatcccatgctcctggattggaagaatcaatactgttaaaatgatcatactgcccaaagcaatctatggattcaatgcaattcctaccaaactactgtgttagtctgttctcaaattgctacagatacatgaaactgggtaatttttaaacaaaaaaggtttaattggctcacagttctgctggctgtacaggaggcatgactctggcatcttctcagtttctggggaggcctcaggacacttacaatcatagtggaaggcaaagggagagtgaggagtctcacatggtgggagcaggaacaagagagagaccggcaaggtgctacacccttttaaacaaccagatctcatgagcactcactcactatacagtaccaaaagggcatggtactaaaccattcatgagaaactgccctcatgatccaaccacctcccacgaggccccacctccaacactggggattacaatttcacatgagatttggtggggacacagatccaaataatatcaattaccaatgtcatttttcacaaaattaaaaaaaaatcctaaaattgatatggaaccaggaaagagtctgaatagccaaagcaatcttaagcaaaaagaacaaagctggaggcatcacattacctgactttaaactactctacaagtctatagtaaccaaaacagcatggtactagtaaaaaatagacacatagatcaatggaatggaatagggaacctagaaataaagccacatacctacaaccaacagatctttaacaacataaacaaaaatatacagtggggaaaggacaccctattcaataaatagtgttgagaaaattggccagtcatatgcagaagaatgaaactggaccaatatacaaaaattaactcaagataggattaaaaacttaaatgtaagacctgaaactataaaaatcctagaagaaaacctaagaaaaactcttctggacattggcctacacaaagaatttatgattaagacctcaaaagcaaatgcaacaaaaatgaacaaagaaaaacaggacttaaactaaaaggcttctgcacagcaaaagaaataatcagcagagtaaaacgacaacctacagaatgggaaaaatatttggaagggatgtttttaagagatcagaagagacaaaacattcttgaagatataaagtagatggaatcagattggtggcagttctagaatttgggtgcagaataaacctgctagcattgctccaaaataaaacaagaaattgtactaaaggtttaggtagtgctaaagagaaagagagggctgggcgcggtggctcacgcctgtaatcccagcactttggaaggccaaggtggacagatcaccagagatcaggagtttgagacaagcctgtccaatgtggtgaaaccccatctctactaaaaatacacacacacacacacacacacacacacacacacacacacaattagctgggtatggtggcacacacctgtaatcccagctactcgggaggcttaggcaggagaaggcggaggttgcagtgagctgagatcgcaccactgcactgcagtctgggtgacagagcgatactgtctcaaaaaaaaaaaagagagagagagagaaagagaggatgttggggctggagaatagaatcagtactctcaggtaacagatgcatggagtggggacaaggaggatacctactaagaagtcaagcaactcggagaatctaaatgtcagtctgtctagtcacaggtcaactcgttgctatgtcagaaaagcaatcagttctagaaaattaaaaacacattctaaaataaaaaatcgaatgactgtttcacaaagaatgggcctaaccgaagatcttatcagagagctgaaagactgaatagaggaattctcttagaatacagtgcaaaacaagatgacagggataaagccgaataagtcagcaattataattaatatgaccaatgtgtagtgctcatagagtacttgggttcaaatcctgcccaatcctttctgatcttgggtaggtcatggaatcactcaaatcctcagtttcttcagctgttaactggggacaaccagaagaactacctataggctaggtctgagcactgtataaaataacgcgggtaaagtgctcagtagaatacctgaattgagaggactcaatactgcttagctacgttcctatcactattaatattactaatgggccatcagacatgctaaaaataaatacctacaacagagtggagaccctgtcactaaaaacataaataaataagtaaataaaatatacaaccacactaacattcacaaaagtattctaaaataaaattattcaggaatgttgaaaattaaatgacaaaggtagtcacttatttacaaaatctgtgaaagatgagaaatgtgaaattaaaaaaatggaatttaaagccaaaaatattcaataggacagattttatatttacacataagaatacgaagacactagaagagcaatgaatctttatgcctgaacaacatgctatcagaatatataaagaaaaatgaattgataagttaacagtcaaaatgagaggatttagtaactttctcaggaaagaactgatttaatagacaaaaagcagttttagattttgagatcacaaggctgactctgtagtaatatacagaaatttgaactcagtatagaatatacactctttgtaagtacacgtatactatctacaaaaattgacatagtaataaaccaaaaagtctcaatgaatttcaaaaagcggaaaacatttaggctaattttctaactaccatgcaataaaaccagaaattagaaataacaaagaaaagaatatccccaatcaaaaaaaaaaaaagaaaaagaaagaaaaagttatatgtatttggagataaaaacaaagcaaaacagagaggctttctgttatttatgcgtaaaccaggaaatcatggttgcgattgccaacagtttatgctgggacaagggctcagtgtagtaaagccagcaggatgtggccaaaaaatgtaagaagacaagggaaaataaatgaactctaaatattaggagacaaagcatagaaagtagaaattttaaaataaaaaagcagaaattaatgaaacaaacaaacagggcaaacaacaaaatttgttaagccccaaatcgagttctttgaaaaatagctaatacaactgtgaaactactggcagacctgacccagaaaaaaaaaaggaagaattagaaaagaaatataactataaatagggaagagatttaaaacttgtaatcaactctatagaaataaattggaaaatgtgtaagaaatgaatatttttataaaaatgtaaactaccacaattaacgaaagagtcagaagacccaaatccttgctggttctgttgaagaaatggaaaaggtagtcagaggtccggccctgaaacaggcggcagatataggtagtgttatgggggatgctagtgaaccttcaaggagcatgtgattccagttattcaaactgtcagagcacaggaacagatggaaagttttccttctccttccaagtctagcaaaatcttgataacaaaactcatttgaacgataagtatatgaagtaatgcatatgttaattagcttgatttagccattccacagtgtctacatatatcaaaacatcatgttgtacaccacaaatatatacaatttttatttgtcaattaaaaaaataaagtcaaaacaaaacaaatttgcactcaaggggtacagaggtttgcatggaaatgcttcaaaaaggcctggaaataatccagatgctagcaggctacctcctagtggctggagaaagagggctgtcactttttaccctacacacttctgtacaattttatcttttttctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgacatcacgcccggctaattttttgtatttttagtagagacagggtttcaccgtgttagccgggatggtctcgatctcctgacctcgtgatccgcccgcctcggcctcccaaagtgctgggattacaggctcttttttcaataagtatgtatgagtggattaacaatggaatgattgtttaatgcattcattattttattactttttaaaccataagaagaggtaggaagtattatctacataaggggttggcaaatttttttctgtagagagcaagatagtaaatattttagtctttgggggccatgcggtctgttgcaactactcaaccttggtggctagcatggaagaaaccacagactatatgtaaatgaatggatgtggctgtgttccgttaaaattttatttcaaaaacaggctgcaggttggatttggtccactgccatactttgctaaatctgatttctatatcagtggggaaattggtattttgatatattttattaagcctcagtccaatattttattcatttatttaaaaatatttactaaagacctttatgttccaggcactgctgtaggaactaggagtactgggaacataccagtgaataacacaaagccactatcgtcatggtggttgcattctattctgagaaaacagacaacaagcacatgcagaacaaaaacaacaaaacaaaacaaaacaaaaaacatgctcaagagtgatcaatgctataaagaaaacaaagcaggataagagatagagggcgctggagtgggggttggtacagttttagaggggatggtaagaaaagcctctgggccgggcgcggtggctcacgcctgtaatcccagcactctgggaggccgaggcgggcggatcacaaggtcaggagatgagaccattctggctaacacggcgaaaccccgtctttactaaaaatacaaaaaattagccgggcgtggtggcgcgagcctatagtcccagctactccggaggctgaggcaggaaaatcgcttgaacctggcatgcggaggttgcagtgagccgagatcgcaccactgcactccagcctgggcgacagagccagactccgtctcaaaaaaagaaaagaaaagaaaagtctctctgaacgatatgtgaccatcagggagtgtgaagtcctgagccagaaccaggagaaggctgatgtgtctacagggggctgagaggcgggtgatggggtgacggtggtgcagggaatccagggtctgggcagtgactcggaggaagacaacatggtgagcagttgtaagatcctgaacacagtttgaaggtggagctggcaggaatactggtggctgggatgtggagtgagggaaagagaagggcggagaatgattcaagtctttggacagaatggccatttgctaagacctgagcaagtaatgggtttggtggggcgctagttctgagttgttgttgttgttgttgttgttgttttgaagacggtgtctcactcttgttgcccaggctggagtgcgatggcgctatctctgctcactgcaacctccgccttcccggttcaagcgattctcctgcctcacccttccaaatagctggaattacaggcgcccaccaccacacccggctaattttttgtatttttttaggagagacggggtttcgccatgttggccaggctggtcttgaactcctgacctcaggtgatccaccctcctcggcctcccaaagtgctgggattacaggcgtgagccaccgcctggttttgcatgtgttgttggggctgcctgttagactgcaagtggcttctgtgaataagcagtgaattggagggtctggggttcagggaggggtcaggctggagaggcaaatatggtacttatagggtagaggcccatgagatcatcaggaaaacactcggagagtgtgcaatgaagaagacctggggccccggagcaatataaggatacaggatccaggattcagaaaaagagaggaaaagctgggcaagagagcaaggaggaacagggggaagtgtgagcctcagaacccaagagaaatgttaatgaaaggccaaaagatgagaaccaagaaggttctcactggcaaccttaacggaagagtggggtacagaataggttcaagaaggaatgtgatgtgaggaagtcaaatccagcgcttggaggccccggctttgggacagagaattggtccctgcagagcacggtctgaggccagtgtgactttcacctctgctcactgcaggacaaccagagagctccatcccaggctgagctgggctctgaaattaaaaggtggattgaaaaggttccttccccttttgtgtgtatgtcggggtaggagggggtggagggtgagggctgctggaagaaggtgaggaatgaaacaaaaatgggcaatacattctgataagcatgtaaacaggggccaatgcaagggtgtatggaaacagaggaggctcccatcccatttgtccaggtctgttcagtggaggacaaggggagtttgaaaataaaatgcccaaggatttaatcaaccaaagagccaggaccctccatacgtacgatgttgccatgatgaccatgcccgtgtgggtggtagtttggccgtttcctatccaaggcggacgccccggtgggcaggggtaggtgggaggcctgtgtttccatcctgaagcttaagaaccaggccggcccatctcgggtttgtgtctgggcacatgcaccctgtgggtgagatgcaccaggtcattgtaggccacaggctctggaaagggcacagaacacggggcctgaagcaagtcacttcagctcagaacctcagtttccaagcctgccattttggggaactggggttcatgataccagggagtgaaaaattctaggtataatacatgaccagcatttctttctacttctcccacacgattcccttttcagcagattaaatgtttgtgagccaaagcacaacgtgggcttcgcttctctctgcatgcttcagccttgtccagacatggcgtgtcacctgtgtctccggcagtcaccagctgtcctccaggctgctgctgtgggcttctcattggtggatccgaggtcctggatactgtcgccttggtgaatgcacagtgatgcgtgtggggaggtgcagaagctcttccgagttattctctgcacttacagattgagtttatcccgtgatgaagctcaaaatcagttatgcttttctatctcctctgttgtatttctcctcaacgtccacttctgtgagtgagtaaggttgtctgttttgacagctgaatgaacagaaaaaggaggttttaaaagcaaaagtctgctgtgtcccagtttcccagttaactccattctctctagccattcatggcatggagacagaaaaatcacagagcaatcagagtgcattttctgaaatcagtctcaactgcggagtgggaacgtgccactctgaggaacttccttccggcccggcttttgtgacatgtcgtgtggtagcggtcgtattccatcccaccttgtcctccaatgctgagctcaaggatttgggaaagcacatggtcccaccccgaggtcacagggagggctttcgccacagcagatgtgtgtgccgttcacatgtcctcgacagccagcggagtcacaattgattttgatgttaatatggcaaaatccattagggagaaaaactttcccccattcattgactcacaacccaagtagaaattgttttttgacattatccacattcctgttcttcccatgaggcatatttgaggcgggcagatcacctgaggtcaggagttcgagaccagcctggccaaaatgctgaaacaccgtctctattacaaatacaaaaattggctgggtgtggtggtgcgtgcctgtaatcccagctacttggagaagctgaggctggagaattgcttgaacccaggaggcggaggttgcagtgagccgagatctcaccactgcactccagcctgggtgacagaaaaagactgtctcaaaaaaaaaaaaaaaaaagagctgacattctaggtgtttaataataccatactatcatatctagtgtgataaaataacaacatgcattttccacaggactatatttcaaaagagtatgagatgattatattatatttttagaccaaagtttcactgatgcagaaaaatctgtaagttgcaggtttatttttaataaacaaaatcgactttatgcaccttgtaggttaacctaaccgacattattgtaatttattcagtaggtagggaagtttgaactctactcttgaattcatggcgggatatattaatagtagggagcatgcggggaagtacgcagacattgttagcaataagcagtgaacacacagggagtggtgatataaagataaaccaatacagacagaatgtccaaataaggccccagtagggcatgttttccacgtttcctagcagggttgggaataccctatttagattttcagaccagaaaagggtaatgaagtcagagagattagcctgggcagaaagggaagaatggaccaggggccatccattcttccctgtgctggtgagagcacaggtcacggctacagagaggggggtcaacctaaggatgcaggcagggttggctataacagttccttgggaaatggaagtgtaggaatattgttggcttagttttaaacccagaagaggaaatagctctggaacttaggctgggggatgggggcagaaaggactcaggtctttattcctagactactccagtacatatcttaccccatgggcacctgtatcaacagactctgagggaaaggtttgcagcagacatggaccttgaaaatgctggaaaaagagaaggtgctgatcctccccaggaatcagaagaccaaaagccttagaaactcaaagaaagaaagctatagcaggggggctactttggctcccagacttcagctctcagggccaacatagagctatgatttgaggactgttctttccatctgtattagttagaattcctccagagaaagagaaccaacagaatacaaacacacacacacacacacacacacacaaagatattgagataaacatctcagtatatatgtgtgtatatttatatacacatataaaatttgatgaaatgtattttaatgaattggcttaagagactgtgaagcagtagtagatccaaactatgcagggttgaccagcagactggagacccaaggaagagttacagttagattccaaatgcagtctgttggcagaattccttctttctcaggaagggttagtctctgttctattgtctttaactgattgaatgagatcccccacattttgaatagtaatctgcttttactcaaagttcaccaattaatttattaaattatttatttgagatggagttttgccctgtcgcccagactggattgcagtggcgtgatctcagctcactgcaacctccacctcccaggttcaagagattcccctgcctcagcctcctgagtagctgggattgcaggcgtgcgccaccacacctggataattttttttttgtatttttagtagagacgggatttcaccatgttggccaggctggccttgaactcctgacctcaggcgatccacctgcctcggtctcccaaagtgctgggattacaggcgtgagccaccgtgcccagcccaaagttcaccaatttaaatgttaatttcatccaaaaaaaaaaaaagaaacatccagaataatgtttgaccaaagatctgggcactgacctggccaaactgacacataaaattaattatcacaccatcttaacactgtccctgggtaaaggactaaaaaagaaaagacagaaggaagaaggagctaggacccagggataggtaggatgtatcaaggaataagaatcagcatactgtgtttccacaaaacacaagaaagaaagtaaaaatctagaaagatctgcagcactgtttaattcagtacatgtgcctcaggtatttctgggggctggttggggggccagtcccaggcaaactgaaggtgcggaagcggtggtgggattagcttagtcagcaggcctggtacgcatggactagttgcataaagtactggaagccttggacctgatggttgtcttcagagtaaaaaaggaggtaagcagaaaaatgcagtctacaagctgctgagtcagttaccacttagcatgacttgagtgccaaagatatgacaggcatagagtagtttggggcacagaagaacagatcagaggaggttacaggtttttgtgcatttaatccttacgacaaatttatgagacaggtgctgttctttatcctcattttccagatgagaatctaaggcatagaaaggtttagcagtttgcccaaggctgcacaatacttgtgatgcttaattttgtcttaacttagccaagccgtggtgcccagttgtttggtcaaacatcagcctacatgttgctatgaaagtatttttttagatgtgatgaactttttttttttttttattgagacagagtttcactcttgtgacccacactggactgtaatggcatgatcttggctcactgcaacctctgcctcctgagttcaagcgattctcctgccttagccttccgagtagctaggatcataggtgcccaccaccacacccagctaatttttttgtatttttagtaggaacagggtttcaccatgttggtcaggctgctctcaaactcctgacctcaggcgatccacccgcctcggcctcccaaagtgctgggattacaggtgtgaggagtcatgcctggccagatgtgatgaacatttatatcagtagacttcgagtaatacatatttcccttcataatgtgcatgggcctcatccaatcagtagaaggccttaagagcaaagactgaggtttcctgaggaagaaggaattctctttaaaactgtcacatggaaactctgcctgagtttctagtctcctgccccatggaattcagattcaagactgactgcaacattgactcttacctgaatttccagcctgtcagttttccctacagattctggacttgccagtccccatagttgtgtgagccaattccttaaaatagatctctttctctcagcatgtgtgcatattacagttacatataaatgaggctctgtctctctctccatactgaaagcaggaagtagaagaggaaaagaaacagaaatcacatttttgtcaaatcccagaggcacttgcagtccagaatcttgtattaggaagggcagtgggtgatggggcaaaccttacctcctggatggggctgtcaggacttcatgtctccatggagggggcccaccccagaaccaccagctcagccccagccagcaaaagcctcctggctcttcaggagcctgctatcacagggaacccaagtccacccacgtcaggctcagggaccttggagggctttgtcctgcgattacattggtctctatccagcaaaagaaaagttggaaagcagtctgtgtgctttctaaatgaacacactgtgataatgggggcccaaagtacatatttctaataacaaacctgattagaggtaaaattaattgtatatgctatttaaacatagtatatgttgagttgtatattatatttttttacaatacttactcatggttgtgccttggatgcttatatgccataagcaagttaaagaaaacatatggcttacataccaactattgacattccattcatgcctttattttttattgtttatttttattttttttgagacagagtcttgctgtgttgcccaggctggagtgcagtggtgcaatctcagctcattgcaacctctgcctctcaggttcaagcaattctcctgcctccacctcctaagtagctgggattacagactcccaccaccacacccacctaatttttgtatttttagtagagatagggtttcaccatgttggccaggctgatctcgaactcctgacctcaaccgatctgcctgccttggcctcccaaagtgttgggattacagcatgagccaccatgcccagcctccattcatgcctccagaggtgggaaggacactgcatggagtagggaccatttggatcgttgctttgtgttctcattttatgcaaattcttcctatcagacagtctgtacctgcaaggaatagccatgaaggcttaccgcagttcaagtgttactctagcccacaaaacacataatttatgagccaaaagagaagctggaggccatttatgttggagcaacttcaaaatgtctcaccagcaattaagactatttttgttttcctttcggagaagcattagcacacattttagagaatgaccgcttaatttataacctcttactcatattttagaggtttactactgaagggcagagttatttggaatgttcggaatgagttgcatcatcttgttttaggctccagcaaagaacaaaaactaagaacagacaccaggcacacacttcaacggcatcaagtgcccacagtcaaatggagtcaagtgcccacagtcaaataccattcttctcatactgcggaacaaccaaaaaaatcacacagtggcctaagtatgtcctagaaaatattagcatcagcaaaacaacgtgtaagtagccaaaggacgcagtggaacaagaactatgaggagaggaagaaaatgaaaagtaaaaagacaggcctttttaaagattacaaacacaccgagaatgttaacatacttgttacataattggagactttgttcttgatcttcagtgtcaaaagcactgctacgatcgggttgagttccaacccttgctttttcttctgcagcagatgcattttgtaaggtcctatgggtttattctgcattataacacaaatgggtatcacatttctggcaagctcacccactggttgcttttcttttttaaaattataacaatatgttgctggagatttagctatcccaaattgtatacaaaagaacaaacattattcagtttacatttctctaaacaaacatccattcattcattgaaaaataagtcattaccagttgttcaaaataaataagtgcttgtctcggctaggaatagagtggccctttttcaaaagtgcatgctgctatttttctgaacatgcggctttgagaggaaatacccacattcttttttaatttaatttaattttattttattattattatactttaagttttagggtacatgtgcacaatgtgcaggttagttacatatgtaaacgtgccatactgctgtactgcacccattaactcgtcatttagcattaagtatatctcctaatgctatccctcccccctccccccaccccacaacagtccccagagtgtgatgttccccttcctgtgtccatgtgttctcattgttcaattcccacctgtgagtaagaacatgcggtgtttggttttttgtccttgtgatagtttactgagaatgacgatttccaatttcatccatgtccctacaaaggacatgaactcatcattttttatggctgcatagtattccatggtgtatatgtgccacattttcttaatctagtctatcattgttggacatttgggttggttccaagactttgctattgtgaatagtgccgcaatgaacatacgtgtgcatgtgtctttatagcagcatgatttatagtcctttgggtatatacccagtaatgggatggctgggtcaaatggtatttctagttctagatccctgaggaattgccacactgtcttccacaaaatacctaggaatccaacttacaagggacgtgaaagacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccagtgactttcttcacagaattggaaaaaactactttaaagttcatatggaaccaaaaaagagcccgcatcgccaaatcaatcctaagccaaaagaacaaagctggaggcatcacactacctgacttcaaactatactacaaggctacagtaaccaaaacagcatggtactggtaccaaaatagagatatagatcaatggaacagaacagagccctcagaaataatgccgcatatctacaactatctgatctttgacaaacctgagaaaaacaagcaatagggaaaggattccctatttaataaatggtgctgggaaaactggctagccatatgtagaaagctgaagctggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaatcaaactaaagagcttctgcacagcaaaagaaactaccatcagagtgaccaggcaacctacaaaatgggagaaaattttcacaacctactcatgtgacaaagggctaatatccagaatctacaatgaactcaaacaaatttacaagaaaaaaccaaacaaccccatcaaaaagtggacaaaggacatgaacagacacttctcaaaagaagacatttatgcagccaaaaaacacatgaaaaaatgctcaccatcactggccatcagagaaatgcaaatcaaaaccacaatcagataccatctcataccagttagaatggcaatcattaaaaagtcagaaaacaacaggtgctggagaggatgtggagaaataggaacacttttacactgctggtggaaatacccacattctttgcaatatttaaaaaagggcttcatggaatcaggggaggaaggaaaaggaggcaccagaatcactttcaaatatggcttcttcctgagcctctgaccgatgatgcgcacgacttccccatcttgggcttgggtttgggcttggtccctcttgagcttgggaaccagaatcagagggggttctggctgacttctaagactcaccagttgaactcgtcttgctcttcctcgggatctgaccatgatttctgcctctgcctggacagcaccttcacagcacacctggttgaacgcttctgccacttggttccctcataggcctttccaccctgcttcccatcaggcccaagaggcaatggtccccagcaaagagctgatagcacatggattgaaaccttctgtgggtcccctttaactctcaaagcccgccccacgcacctcttcacccacccctgcccaaaccaccctccacctttgttcacgtcttctgctcctccagctcctgaaggcggcgtccatcctcccatcatcgtgtagtcagtggcagccctgtgcctgctggttgtaaacacataagcatgcaatcacactgaatcacgtcactgtggaaaagcccatcccaagagacaagctatgggaaagatggtttcgggaaccactttccctgagctttcctggtatgttcacacttcaattgcccttctagctctagctcttgctcatcttcccaatgggagaaggtcaggaacaaaagaaatgtggtggccactttaagaggtgggaaatgctgtagggatgagcctcttgcccctactccccagtccctgggaggtggctcttcccctgtaattagaggtgccagtcattctttttatggtacaagtgacctgttgcaacaaccagtattgtccacaaacaacattaaaatgtggatataaaacatgaagagacagtataggacttccaggccccatgaatatcactagccatgatagcgaaataccgcaggttcttgccttcagctttgtgctgaattgataatcctgccttctacggagcactctgcagccacactgctcacttggagctttcttgctgtgctaccctaggatgcagttatttaatagtctgtgtttctaatcacggcagctgattgtttttgtatcacaagaactataaggcttcctcagaatttatatgagctgagtctaccccatacagtgagaggaaatggatttccttctgaagttggatgtcgttataaccgatcataaatcaccctctttgggggcacccacaaagggtgagccccattgaacacagatggatcacccagtgctgagagggacttgagactttgcaaagtacttgctttatagcctgggattgattattacccagggcatcacttacaaacattagtctgaaagtctacattctgaccactggtatgacattcaggtagcaaaagaacttgaacattttcagattttcttttttctctctttcttttcttccttccttcctttctttcttttcttttctttttttttgagacacaggtattataaggtattataataataatacattattattattatttttgagacacagcttcgctcttatcactcaggctggagtgcaatggcatgatctcggctcactgcaacctccacctcctgggttcaagtgattctcctgcctcagcctctcgactagctgggattacaggcacctgccaccatgcctggctaatttttgtatttttagtagagatggggtttcaccatgttggccaggctggtctcgaactcctgacctcaggtgatctgcccgcctcagcctcccagagtgttgggattacaggcgtgagccaccacgcccagctgagaattttatttttcaaaaaaaaaaaaaaaaatctcaaaaacaatctctccagttaaactctggtaatataattgctatatctttttttaaaatacaacttttaagtagttttagattctcatggaagttgcaaaaacatgtagctttcattcagctacatagatgaataaatacttctcagaaaaaaattgtattacatgacagcctaaagtaacataagaagccattcataagtattcattttcaccaacttgactttttcaggggattgattattttattcaatgttatgggggctgtggaatggaagggcttgtaattaacccacaatttgccacaactatcctaaaagccaagggcaatttttccagagacaaatcttaaaatatatgatgtcaatatattgtaaaatataaaagcttaactttattacaaaagcttaaaatataagcctgggcccttatggttctgtcttggagaaatgtaggcaaatgaagaccagcaaccaaatgctgcttcaaaatagttcaaatccttttcttgcaattctctaaaacctgaataggtccacatgcacacaggccatcgtatcacaaaataggaattccctgttcttgcatctgtccccgttactcctgcaactttcccagaacatccgctgcagttaccttccccaaacccttctcttctgaccagccctgttcaccttttctttctcacactcttctttccctcccccactcttcatttctttatgacattggtcaacccaaaccctctcctagcaagaaagaatcttttctcttgagaaggaaggaggttgggaaattagaataggcaattataggtctctctttggaaggctgggagaagagaaacagttgggaagacttccatgccagtttttttttttttttgagatggagtctcactctgttgcccaggctggagtgcagtggcaccatcttggctcactgcaacctccgcctcccaggctcaagccattctactgcctcagcctcccaggtagctggggctataggcatgtgccactacacccagataatttttttgtatttttagcagtgacagggtttcacctcaaatgatccacccgcctcggcctcccaaagtgctgggattacaggcgtcagccacctcaccctgccccatgccaatttttttaaatgacaactttattgagatgtaatgtgcataccacagaaatcacccttttaaatatatgtaacatatttaatatattttaaaatatttactatattaaatattaacatatttatatttatatagcatattatataacatatttattatatattatatatttattataatatatataatatataatatattaatataaaatatatactatatattatattaatatatcattatatatgattacatattataatatattaatacaatatattatattaatatatgatattatattatcatatattatataatatatgatatatcatatattatataatatatgatatatcatatattaatataatactaattattataataatatattatataatgatatataataataatataataattatattatatatttatatataatattatattatattatttttattatttattttttattttttatttttttatttttattttttatttttattttattttattttattttttaaatttatttttatatttttattttattttattttatttttttattttttatttttattatatattatattatattatattataatattattatataataataatgtaatatattatattatatatatttatatcatattatataacatatttatatttatataacattatataacatttatatttaatattaacatatatttaatatattaaatatatataactatatataaatatttatattagttcagtagtttttggcatattcacagttgtgtgcaaacatcataatctaatctcagaacattttcattatctcaaaaagaaatactgtatctgtcagcagtcacttcccattcccccactacttctgctcctggcaaccactaatctactttgtctctgtggattttcctattatggacatttcataggaacggaaacctacagatgtacgttttgtgatgggcttctttctcttagcataaagttttaaaggttcatctgtgttgtagcatgcatcagtaattcatttctttttacaaaataatattctgttgtgcagagagaccatattttgtttatccatctggttgatgggcaattgggttgtttctactttttggctattatgaataatgctgctatgaaccttcttagaccagtttttcatggacacattttcatttatcttgagtttaggaaccaagaatggagttggtagatcatacgtcaactctagcattttgaagaaccatgatcatttttgtgcctctacgtgcagaatgaaagctaagtccagcttccttaacctattaatattttatgtcttgcacttaaaaatcctcattaaaacaagaaagatataaatatttctataagatgattagaaatcatccctcaggttgtgtcaggagctgtgcacggttttattgggcatcacagatgcttacttctatatcacgagattttagagagaagcattgggtatttttattaaagtaaaaatcaatgcagggttgaaactcatgattacatactgtggctgggtacctgatattttggttagatcataattaagcttactactttttagagcaaactatgtccttacctttgtaataaagaaaaaaacaggtgagtaggtaagggcagaattcctccagatgagagcagaaagcacagaaggcacttgcacctttgaaaaggagctacaggagaaaagcctccactctcttgggatagcaatcctgagggaggatctctcggtactcctttaaggagaacagccatcagacgccaagtgcgggagcgcctgactcacagtgaattccttcaggatcttctctttataactcatcagtatccgagagccacttgttcctcttctccttttctctctgtgttcttgtctcactgtcataaaaccaagacttggctcttctctcaaacatcctggtgtgtggagaactcgggaaatatctccctcctgggtcttgctgctctgtgccctccgtgggcaatgtccacaccgcaccgacacctacaaccaaaaccatactgccacctggaattattacagatctgcgggaggaagggaggcttcagattaaagccaggagctgcccaatgctgaccgtcctgtcccaagacaattgtgctgcactaatcaaccccttgccgcagtaaacttcaaaagacgaaaagagatgcagtctggctaacccctgatcaatgtaaatccctcctttatctccaaataatcatttccccagctccccacaccctcaaatgatgactttcaacactttgaatataacaggctcacagtctgtattcaatggtctcatcataaggcaggaagccctatcaggaactgcgctgctctcctatccctacacttcccaccacgtagttcggggttaggcagggaattgcagtaaagctatacacagtaaagaaaagttggtttgtgtgtgtgtgtgtgtgttgtttgtttgttttttgagaccgagtttcgctctttgcccaggctggagtgcagtgggacaatctcggctcactgcaaactccgcctcccgggttcaagtgattctcctgcctcagcctcccgagtagctgggattacaggtgcatgccgccacagccagctaatttttgtattattagtagagacggggtttcactatgttggccaggctggtctcgaactcctgacctcaggtgatccacccaccttgacctcccaaagtgctgggattacaggcgtgagccatcttgcccggccggcatttcagttttattaaactgtctactgcatgccagttcttagtagcacagtctctttttttgttttagaaactcaaaaccttctaagtgatcacctggttaaataatgcaatcccataaatgacccctctcttctgatccatgcctggtgtccatttaattaaaccagattagaaaaagggattattgctggctcagggaggctgctgccacagacaatgcctcacttcggattgtgcagatataatatgattgctccaagccagccttcatgtttacacctgcctggaagctctcaggccctggagtaacctcaggacactcctggccctgtctgcgggtaaccagttcttctctcagatgtgcggtctgtgctgttcctccccatctgccagtacaagtaaggtgtggcacctgggcccttctcccactcacattgcctgtgtcctctctctaaaagtcaccttaagaccatgcgggtaaagaggagtgacttaaaggagctcaaattcatcttacttttttccagttgggaaattggcaaaaagttctgtagttatggaaatattcttgccagtttatagaagcaattagatctttttctatagcatctgtgtggaagatttccttttcaggaaatcaaaactcctttgagtggcctgacaatagtaaccataagaaaataattttcctggaattgcttctgagctcgtttgtgaactggagagtataactttgtgtcactatactccattttactaaccatgtggttcagatgctttgtcattttggagccttggtgaccctggagagactgcgtcttccagggttagccagttcctagagatagcaaagaacttgcctgaaagcctgcctttcatacacaaatcaaccaatccattacagaccagcctggccaacatggtaaaaccctgtctctgctaaaaatacaaaaaattagctggacatggtggtacatgcctgtaatcccagctactggggaagctgagacaggagaatctcttgaacctgggaggcggagcttgcagtgagccaaggtcgcgccactgcactccagcctgggcgacagagcgggactccatctcaaaaaaaaaaaaaaaaaaaaaaaaaaaaaaaaaatcaagcaatccagtgctcataccccagccccctcctttctcagactcctatactctgggccaggatccacctgccctagtcaccccagggccagctaccagaatactacggacagccgtatgccccagtcaatcatgccccagaaattattcaaaccagtcagtgctaagtctgcttaccctgcctcacctgtcccttcccgtggaaaccacaagaaaggctcttgccctcgttttcctcctgctctgtctcctgacctacctggtgccccttcctcttgggaacagtaaaaaactctctttccagcagcagtcatctcctgatctgttggcctcatcacacctgaatcataataatacctatctttaataacagccatggaaagtataaacctggggttgggctgggacaacattgtgaagctcttttagcttcatgaataacggggccgggggcagtcacaatccctgctacactcttcagcagtagcaatttctggaaatgcagccctcattgaagcttccga
